United States Patent 9,567,581 (SELECTIVE REACTIVATION OF GENES ON THE INACTIVE X CHROMOSOME) - sequence listing, part 19

SEQ ID NO: 2953 - DNA, 254730 bp, human
ggccggcggcgggggcggacccctggcggtcctcctggctggggtccgcgcgctcgcggcagctccccgtggaggtcactgtccgtgccagtccctcccgctgtcccgccctctcccgctgccgccgccgccgccgccgcgcccgcctcagcgcccccactccgcgcttgggagcgaggagccgccagcgcccccgccccgccgccgccgcagcgccctcaggccgccattcgccaccgaaactttccagcgcccgcgctctctccgggactcggcggcggcggggcgggggcggcccgggggcggcgcgcggctgctccggggcgccgggccctcttcggccgccgcacggccgggactcggaggctgccggctggagggaggttcggagcgcggccgggcgcgcggcgccgccacaagttgcgctgctcgcgacgaggtgagtgcgcagggctcggcgggccgggcgcggggtccgcaaacttctgcggggaggcgggtcccgcgctgaccctccagggtccggccggcggctcggggcgcccgaacgctccacccgcccctggaactcctgtaggtgcaggtcgccaactgtccccgcggcgctcggactggggtgcggcgcgctcccaggagcctgaacaataccccgaggtggccgctccccgaagtgccggcgcgccttgcggggagagacggaggtcggcggggggctcctttgttttggggagggggaagtggccggtaagtttagggaagcgctcggcttttcctccggtgcccctttgtctgccgattcaggggcttgctgggcaaacctgcgccaccgcgggctccggggaccggggtggagggcggtggcgggatttccccgctgttggggagaagagccccattcatacccgggacgcgggccggccctcccggacccgggtggaagcgcagcctcgcggagtggggcaagcggcgggcgaggtggcgcgggccccgtgtctgctcagtttctgacgcgcagaaactgtcaaggaagtcgggagccccagtcctccgcccatctccccggcctgagcgcacggctgggctgggggcacccttggcccgtcgagggtctgcagagcgccgcccggggagagcgcagacctgttgctgctcctgggctctgacggggcgggtggggtgggtctcgcagatcctgggccccggccttgctatccagggggaccttccctaacgatgggaccggtgctcggagtggagtatggggagtgcgccttcgggagtcggcgctggccggatatgtgacaactgtgggtcgctggaggcccgcctgcgctgggatagggcctggacttcacgtgcgtcgcctgtgttccgtcagaccggggccggggctcgctccctgcaaggcctcgtgttcccccagccagctgcgttggacgttccacaaaggtagggactgacgtttattctcgagtcagtgatgttctggagcaaaacctaaaaagaaacaaaaacctaccctctattgtatttgcaactgtttctgctttgcattgtcatgtgtggtttgacctgccttttggatgttttcctctcctgaaacatcgcccagtccctggtttaacctggaaggcgagggggaaggaaggcaacctccctgctaaggttccaggcagtggctttggtgttggaagtggcacttgacgattttatgaaaagtttacaagtccttcctagaaaagatgtaattaggaaaaataaaatacagaagaacgttgagtatgacgcgtttattttaaagggtagtcctgtctcaaatgtgctgcacatttttgtggaaagccaccaagctgggtaactaatgcaaacaacaaaagttgttcatcactggatcaccggcccttaaggcgattccagcccttagtagaacacacacctgtagggcaaatatggagatttgtggtgtagtgctgccaccctcgctccccaactctcaggcattttgcccctttacctcagagaacttctctctgtcagtggttttaaagaggaaacagtttgcaaaaataactttattgtagacatacttagaagtgaatgtttcaatttctggagttttcccatcaattatatcagtaccactggttctgtacaacatcatcttagttagaagattttttttcaccttttaaggtgacgaacagaggcgggaaaatggtccctgcagagggaggccatctccagcaggtcccgagggtcaggaattcagattatccgatctactcctgctggataggagcacacctccgctagaacctgggtccggccccctcccagttttctgcagggcgtccagattccggtgctctgccccgcagcagtgccctgtgggcctcctggcttagctgatcagcacagcttctctgcccagcgaggcaggaccatcctcccactgctttcctgatgccttggatttgctttttttcctcccttaggaaaagcaaaaaaacctaatatgctacatccgagaagttgttaatctttcactaccacatgcattgaaaaatcagttccacccaggaagcaacactaaaggcatattgtaaacacttttttttttttagttggaaagataaacttttttcccccataactatttttagttagccggagactggactcgagtttttacctccggtcttgccccctccactcccgccctcactttctgtggggctcgaccacatggaccatgctggccagactggcaaacatgaaacccaccagaaccaaaagaaaagctggatatgggaaggggccgaagaagtccacatgtttctaaagggcaaagagcctaggctgaggagagacgtttcagatctccaggggagaaagacagccgttaaggagtccgccgggctgctgcctgcctggccagcgggagcctgacttcagatgcctgcgcctcccaagctggccccctcccacacagccatcgccatccagtatttagggagaatccaccgcatgcctgaaggttgcagaagtgaattggaaaccgttacaaatggaattggaacaaatttaaagttaagatggaagagagaatatgttgagttttcagaggaagtcgggtactgcttccttttcttgtctaggtttgttcttgtccgatgggatcagagagatttgagatggggcatgataggcggcgggttcaggagaaagggaagctttagaaatgaaggtagaaaagatgcttgcttattggaacagtattttcaacgttgagctctggaatgttgcagccaactaatggttctcatttgggacagttttgtcccccacttttgaagggagcatttgccaatgtctggagacatttcccttcctgcaactgttaaattagcaaacaggttgagccagctgggtgtggacctgcattttcctcgtggaggccctcttccaagtgtcagtaggaaaagggctcccagagtgtggtcctgctgcgggaccttggcccccacgtccaagtgagccccagaggtgccccaagccctgcctggtcatggggaatctgggctcccgctgaacttgggcgctggggacagctatgagggaaacctggtttgcagctagcttgccgtgcactgactggagctttgggcaaatcagtgaacttctctaacattaattttctcattgagagaggaggtgggtaggagtatatatatatatatgtaattatatatataggggtcgggtagagggagagagagatttcccaggctccttgtattaaaggagatagagttattatatttctcatttagtttttatttatttgtttattttgagacagtgcaattattatagctagctgcagcctcaaccttctgggcttaagcaattctcctgcctcagcctcctaagtagctgggagtaccaaatgcgcactaccatacctggcaatttttttatttttatttttagtagacacaggctctcactgtgttgcccaggctgctctcaaactcctgggctccagtgatccttcctccttgacctccccaagtgttgagattacaggtgtgagccactttactcagtcgaccgacatagaattattataatgcttggagcctaacatgccttttttgtttgtttgtttgttttttctgagacgaagtctctctcacagcccaggctggagtgcagtggtgcgatctcggctcactctgcctcccgggttcaagcgattctcctgcctcggcctcctgagtagctgggattacaggcatgctccaccacacccggctgatttttgtatttttagtagaggtggggtttcaccatgttggccaggctgggctcgaacttctgacctcaggcgaccctcccgcctcggcctcccaaagtgctgggcttatgggcatgagccatcgcgcccggctagcctaacatgcttatagtttcctgttttctgaagttgggaattgggtctggaaaggtatcaccatcagtcacgatggtgtctagtagtttgctttgtttttttccttatcttttccctcttacattttagggctgtatctatataattttattatttaaattaccatatggtaagtttgtctctttgggtgcattatgagtcttgacacatgcatagattggtgtgaccaccatcatcatcaggagagagaacaatctcctcagcccagagatgttcatggctctgtctcccacagttcctccacagtcaccccccccagccccgaatctggggcacccagccatctgctctgctctggaagtcttggggatcccatctgaatgtaacacatggtggaatgccttaggtgaatccatccgctcttccagtaccacctttgcctcctctctctgatgacacatgaacttcatgcctttgtgtgctttggccaaccgcttttcttagaacagcacattttgcactgtagatgttatcacaagcaaggaaaaaacagctttgctccttaatgtaagaaaccacagtggaaaaacatcaggtgtgttgttgaggctgctaaagctttgctcctttttaaaattttttaaaaatttttctggatacgtaggtgtatatatttatggggtgcattagatattttgatatagtcgtgcagtgtataatcacatcatggagaatgggggtatccattccctcaagcacttattctttgtgttacaaacaatccaattatactcttttagttatttgctcttttttcttttattttgagacggagtctcactatgtcgcccagggtagagtgcggtggcgcgatctccgcccgcaagttcaagcgattctcctcctcagcctccggagaagctgggactagaggcatgtgccaccacacctggctaatttttttgtatttttagtagagatgggtttcaccatgttggtcaagctggtctcaaactcctgacctcaggtgatccacctgcttagcctcccaaagtgctgggattacaggcgtaagccagcacgctcggcctatttatttcctctttgttctatgccagttagttcttgatgcctcattgtttcagatgggacattttctaatgtcgtgtttttgtttttgtttttttgagacagaatttcattggtgtttcccaggttggagtgcagtggcatgatctctcctcactgcaacctccgcttcccgggatcaagcaattctcctgcctcagcctcccgagtagctgggattacaggcatgcaccaccatgcccggctaattttgtatttttagtagagatggcatttcaccatgttggtcaggctggtctcgaactcctgacttcagatgatccactcgcctcggcctcccaaactactggaattacaggtgtgagcaaccatgcccgacctctgatgtccttttagaggatgttaccctcacctttattgcacagtcctaccaaaaggtacttcatatgtgaaatgtatcagaaggttatagtcatggctttagtttaaaaacaggatacatgttcattaaggacctttgccgttttcccaatgggttaatcacgtaaatataaaataggctaaaaatatcaagttgtttttgcctttgttgtagaaataaaaaaatgaattcctacatctgtgtttctatggagctgctaacctgtgttttactctgggccatatgtcgctttctgtgatctcatgacgtggcatgttttctaatataatccttgtcctggcattttggtgacttttgtcctgcctgaggtggtctacctggttgtgtgaagtcacagaacctgtgcatgtcctaccgtgtagagttaaagggctggatgagtggcctcaagccttttcctccctcccaggtgtgaagatttggtttggaagatggaccctgcttcaaggtctgggaggccatgtttttttcagactggttaaggatgacggttttatgttaactaaacattgggatcaagtgacagttgtttatgtccggtgcctagagtatcagttttcccatgattaaaataagcgatattttggtaaacattgataagttagttgcgcattttagttcagaaacccacagcgagtcagaaggcgctttgtgctgctgggcgcctctgagtgattccggggagtgcggcagttctccagccccaggagaccctgtgaaagaagcacaaacaatgctcacggcaaaactcacagtgtttattcttgacctgggtgtctgccttgaattcttgtcatttttcctatcgtggtggatgtagccggaatgctttaaagaaaacatgagagttttttctgcctgtttcccttgagcctggaaccgattatgaccccagatagcctgcacagggctctttcctttctggaacacctgcccaggctagaatatgggagtagggaggaggtgaggctctctcctgcccggtaaccttcccggccagctctccaagacgctgaaaccttccttcgggtctgttgaaactgcatccccagcaccatcatgtcggagcaagaagagaagggcatgtgtcccctttaggcttgactctttccaattagggacctgcctgttgttaggatttagagtccatgtgaatgtgcagtattgttcagtgctgcgagcatttttgcttgtctgaatttcctgatagaagggaatttggacaaaaagaagcttattgtacatggtgccattttattccttaaatcaataataacaaatactttatttatgtatttttagagatggggtcttgctctgttgccctgatcatagctcactgcagccttggctttctgggctcaagtgatccttctgcctcagcctcccaagtagctgggccgacaggcacaagtcagcatgtccagctttttttttttctttctttttttttttttttttaattttcaatttttttctagagattgggtcttgctgtgttgcctaggctggtcttgagcacctggactcaagcaatcttcctgcatcggcctcccaaagtgctgcgattacagttgtgagctactgttcctggccaacatatactttaatatggcaagaccatataaaataattttaagaggccaggtgtggtggctcatgccccccagcactttgggaggctgaggggggcagatcacgaggtcaggagatcgagaccattctagctaacacggtgaaaccccgtctctactaaaaatacaaaaaattagccaggcatggtggtgggcgcctatagtcccagctccttgggaggctgagacaggagaatggcgtgaaccatggaggtggagcttgcagtgagccaagattgcgccactgcactccagcctgggtgacagagcaagactccgtctcaaaaaaaaaaacaataattttaagaactggaggaaaattcagcaggactgagtcgtgatttcagtttctggtgcactgtgggtaattgggtaattgtcagcctggatgcttgtgctcctttagttgtcactgttaccttgtcatctatgtgaagatgagaaatgaagttgagtggagaactgtcgccaaagtctgccatgtaaaaatcggtagtgccaatgtgcaaaggtaattcccaggtgctataaaagtccaggtggcttcacagtttcagattgtatttcccgaaagcgtagagaattgatatccctgaataggaaattgacgtccctgccatttggttcatttggggaacagaataaacttgtgtccttgccttcagttcttttttcaacagaatcttatcaagcatttgaatcgtacacaactgtaatgccagctccatgttgataaaaactcaagaattcaaaattataaacttgaaaacagcaattgccaacttctgacagtagcaggagagtctggaggacctgttcagaggaagtcgggtactgtttccttttcttgtctaggtttgttcttgtccgatgggatcagagagattgagatggggcatgataggcggtgggttcaggagaaagggaagctttagaaatgaaggtagaaaagatgctttcttattggaacagtgttttcaacgttgagctctggaatgttgcagccaactaatggttctcatttgggacagttctgtcccccacctttgaagggggtttggtttaattcccaatttgattatgaagaaaataccagattcagcttgcattttcaagacacagtggttctatgtcaacttcagccatttccagggatctgtcttaggatacttcaaaaagcctaacctttgagatgcactcagctcataagttcgtgaaaataagaatgaataatcttccctgtccagtacatgacagaaattattgtagaccagatgagagcaaggagagatacttgttgatattacatgtcacgggatgctctgttaaattttatgggactctgagtgtaattcctttaagccagtagtctctaaatttgggggaaggacaggggacagaaatgacttgtttcagattttaattcccaaaagggtcttagtgagtttcatgccctctggcaggtgcacagcaagatttattgggatgcaggaagaaattatgaaaatgtccattaagaaaatctctaatacttgtaaaaaatatatttcttgtccatgaaatgcatgttacttgagtattttatatatttaataaattacatgagttaggagcaccttctgaaaacttttttgctgaaaaggatatatgatgaaagaaacatttatgatgtaggtccccaaaggctggaagagggggtgataccaacgtccctgcctgcaggtaggacacagttgtactcccctttcctctgacttcagctactaaggtatgtgtgcgtttgcacgcacatgtatgtgcgttaagtaactttgagatccaccagcttaaggactggacatcgttccagaggtacaggtattagtgatttgacttagggaagaaagaatatgcaataacagggaaccatgcacatactggatctattgtattttgcgtgttgtttttaaagctgaaaaaatgcgcttgtttcggaactagatgacagtacctgtttgcaggtccacaaggaaaccttggaacaatgctatgctttttaagcgttttatgactgcattgttttcataatcactgaattctgtttataaatcagctgatttcattgacggatgccctcagggctctggagaattaggcgttttgctgcagaaatggttcagaatttcaaagacatcaacgtgagattgtactggaattgagttgtgataaaagtcctagggtgctttaaatctttaaatctggttatttgtttgtttgttttttgaggcagagtctcactctgtcgcctaggctagagtgtagtggcgtgatctcagctcactgcaacctccgcctcctgggttcaagcaattctcctgcctcagcctcccgagttgctgggattacaggcgcctgccactgcacccggctaatttttgtatttttagtagagacggggttttgccatgttggccaggctggtctcgaactcctgacctcaggtgatccgcccaccttggtctcccaaagtggtgggattaccggcgtgagccactgtgacctgctgtttttgtttttgagacatatttcatctatcatggttattaagtgttttgtttttttgcatttctcattggtgttttttgtttgtttgtttgtttttttgagatggagtctggctctgtcgcccaggctggagtgctcagctcactgcaacgtctgcctcccaagtttaagcaattctcctgcctcagcatcccgagtagctgggattacaggtgcccaccaccaccacgcctggctaattgttttatttttagtagagatgtggtttcaccatgttggccaggctggtttcgaactcctgacctcaagtgatctgcctgcctcggcctcccaaagtgctggaattacaggcgtgaaccaccacgcctggcctcattaggttttttttttttttctgagttgctgctacactactggtgttacagagtgaataaacataaaaattatattcacaactcagaccacattgtgggctgtggaggtgagaaataggaatcatctctaaatttaaggtcttctggctgagctcatttgcttagaatggctgaaggtttggttttcatgagatgaaatgccaacctcaagtggttctgggtttccagaccagtttttagtttgtttaacttgagagaattgatatgtcagctttagtttttgtgtgtaatttttggtgtttgcatctgttttcttctttgtgaatattgaattcgcaacataactttgttatatgaaatgatgctcatacacttgcgcagtgcattagaaagcctgccaggagcagtacttgtagatttccgtgtaccagcaggatgcctaatgccgaccatgattaatgctcatcagaatctatgtagacctccatttgtcctttgataagctgaaatatttgtgtctactttttaaaaaacctgttgcttctctttatggtaatactcagaaggcactcactgtgaagagaggagaaacaggaagtagaattttttactatctagattgatgcacctatctcccctctccagagaccaatgcatttaggccccagtaagaaatttagttgtaatgaaccataaagcagatgcagagtatatttgggaatataccttatctgactccacagcccaacccctttaagaggaaagagatggcacaatatattttgctttaagccttagactggtcttgacttcatattggaaccactgaattgcttcagctgtgaactggaatcctctcctgtctttgttgttgagtgatgacactcttaattaatcatttgcttatttgccatccaaatcaccctatataatctttcagaagtgtatctcagagaatgaccctaagtcggctgacctctgaagcctgtaccagaattgactttatttcttaagcgcacacttcctgtgctttcaaggggcagctgtctaggtttagtttctgggagtttgaggcacagaggtatgtaggggaatgggaaggccaaatggtaaaagcccctgggacgtggaatctgtgagtacactaaccttgaaagagattatgaaaacaaactttagagcattgttgaagcaccatctacataatttatatcaatgaagacagtaacttattaggaagacaggattattaaaattaaccattttcatctttctacaaaaataaaaatcaaatcaattttagttcagataattgtatgtgaagctttataagtgaaaatttgaagttagcaaaattatataaccttagttaattatattagtgtactcaaactaaatatagaataagattagctcatggaaacattgcatttttatctcagtcagtactgctcatatccacccagtagttagtttctagttacgttttgtaattttttgaatatcctggacatggttttagaaaagttagttgaaacaagatattgtatgctttcattatttcccagttcatctttaagcataataaaaacacagagtaagttgtcctttttgaattttctttcctttctaatatgtgtctggcacaacagaggaccaagcccagggatcattaatcccatttttctgcatggcgtttgctgtgagagaagtttgggctggattcgtagtttgctatctaagagtaaatgttcaaccttctctaatttcctgttttgtttgcttttccattcagtgttctatatttggacaacaaatatatttttctgtatgggtttctggtggcccagatgttcattggagtggaaattctttctgtccacaccactgagttgggcagttactggtgtttggctttctctatctcttggagttgacttagatacattgtgtattcaggttgggcactcatcccctttgcaagctctattactttgttccatttggctttgccataaatgtttgcccttggcttgccaagacgtcagctttaagagatatgtcatttaacttagaactcttgagtctgacttaaaattaagtcagttttcttaaacattgttattgaggtataaatgacatgccacaaaagtcacctctttgaggtgtaccattcagggatttttggtaaatttactgggttgtgtagagatcaccatgatgcagttttagaacattttcaattcccaataagatcgctcctactcggttctcacccatttctgctcccacctccagccacgggccaccatgaatatccttcgtgtctctatagattccccttttgtggatattttagagttgtgcttccaagaatgagtatctctgtgcttggtcgaacttcccggatggtgagacctgatttagtgactttgccttccgccccttcatccccaggagaggaaggtggggaaaggggaaagacggcaagtatagtagtataacaggcatcgtgcctcagtttcctcatctgtaaaatcaggataaccatggactagtttcaggctctaaatgtgaaactctgtaggaagtaattagctgggaatctggcatagaggaggagctcattgtttgcgtgttaacagtgggaaatagttaaggaggtgggaaaagagctacctgtagaaaggtggcctaagtccctggagagctgagcacaggaccccagggcacacacccccttatgcttcccctgtctttcatcttgaaagcacctgcctgtgaacctcaggcttggagggaatctggatgttttcccaggatctacctctgctctatggtcctcaatccaaggtagttttgaaaccgcctttgcaaaaattatatcaatgagaaaattataacagtatgttaagctaacccatcccccatcttgcctttcccttaatattcttgggctattgggccaggtgaactttggaggacttttaggctacggtttaaatgataataggccttgtcccaaactcaaaacttgccccaaactgtaacactaatgggaggccatcaggatgggggaggagaggagcctgattgctgctaaggcaaagacatgaaccattgccagattgtcaaatacgcagattcccagttactcccgcagataacatcactgttgtagaacctaagattggccttttgagatatcttttcaggtttttaaaattttcttttctctgaactacctttggggagattctagatcttttaaaaattccttaccaactctttggagatacctcctgcgttcatggttaatccatccccttagttaaggcttattgattgcacataggaagttccctttagtaaaaggttcaaaagctagaaatgtcctggctgaaatccggtaaaaagagattttaaaatgatttttcttttgagagctctgtagttagaaatcgacttaattaaagctgatatgtgtacagatactgttttaaagcccctgttctccctctgaaagcttctgtcaatggacttctgtcttgattcttcattcctgtctttctgtgtattcttctctgttatgtagtgtttatataaaacagctctaaataattggcgtaggccaggcgcagtggctcatgcctataatcctagcactttgggaggccagggcgaggtcaggagttcgagaccagcctgaccaacatggtgaaaccccatctctactaaaaatacaaaaattagccgggtgtggtagcacacgcctgtaatcccagctactcaggaggctgaggcaagagaatcgcttgaacctgggaggcggaggttgcagtgagctgagatcacgccactgcactccagtctgggcaactgagtgagactctgtctcaaaaataaaataaaataaaattggcttaaagaaaaataagcacttaaacattgtcagaaaaatggaaactttaatggcttttacatcacatgactctgatctttcaaaaataaggacagtttaaagattatttgtaaagtaaaataaaaatgtcttcaaagttaacacactttgtctaaattaggcaggtcagatactctttgctggatgttttaaggtcataaactgcttctgtgacttttaataattgtttgacttgtctgtcttacagccattagattctaggtaaggtctggggacacatggagttagccggctcccctggctaggctgggaagaatcatgggttctgtagttttatacatggttaaaattgcttatttaccaggtttttcaccaaaaataaaagttgctgaaagttaagattgtaacacgtataattgagactactggagaaacagttttacatgcaaggcgtagaaggaaagtagaatgtgtgtgtgtgtgtgtgtgtgtgtgtttgagatggagttttgctcttgttgcccaggctggagtgcaatggcatgatctcggctcaccgcaacctccgcctcccgggttcaagcgattcttctgcttcagcctccccccggcgtagctgagattaaggacatgcgccaccacctccggctaattttgtatttttagtagagacagggtttctccatgttggtcaagctggtctcgaactcctgacctcaggtgatctacccgcctcggcctcccaaagtgctgggattataggcgtgagccactgcacctggcgggaaagtagaatgtgtcttgtgggaggctataagaaagcatgggaatatggtttttgtaaaagggaatataattttgtctggttcggaggattttaaggatcatcttaaaagagtaatgggacaaaactgaaagtttaagcaagttgaaaaaggtttgtaaagggttcatcttgtaaaggaagttctgtgggtatgagcaagttggctaagacttgaaggggattatttagtttttctgtaggttgaatattttttgtttgacttttgaatgaatgacagaaaaacgaggagagaggagcctcatactgtctttattttgtcctgtttggaaagttgagtttcccctctatcagtgagtgaagatttttgccttttaaaaattcttgagttattatggctaaataaatgacttctagtgacttgggattttattttgtaatatcaagggtctaaacatttgatatttgacaaaactttccaaagtcaaaatctaaattaagccacccccccccccgcccttattttaatctggttaaccttccagatattaaatactgtaaagtccaaaagagacatatttggcttatttgatatattaaaactataacagtaagcattgtcaggtatgcaatagtgtttggctttctttggactgtatttgtatgaatgtgttgttagtatgtgtttcagaattgtataagatttcctgtaattctgatatgttttagtatatgttatcagtaataattatgattgttaagttattgtatgccacagagatgatcagaccttaactgtggctgttctgaaacttttgtcatccacaattgttttactttggttattttcagggtggttttataatcagctataggactgtgacagttttctgataactttggagattgtgacattaaaatagacgaaaaagcttccaaggctcccattaagagctaatgtattcatggatatcgagcagaacaggagttaattacatggactgaagtaatggaagaccgaaataaactttttctggcttttcgtttgaaacattgctcattcttttgtttttcagagtccagaaaaccttttttttcttttgagctatttatagcttttaacaattggataaagtatgctcttgtgaacaaaatctgaagcacatttctctctctacctgatttctctagaatttgaaaactgtttgcaagtatacttaatttatgatgttatagttgtttgttaaatacaaatctgttttcttttgtagcaggacacaattggagacactggttattttaccaaagctttgattggaatggcatactttcagattgctttaaggaatcaaagttgacttacagagccaataaaagccccttgggtaagctggcctcataccttgtctacacagtccctggacaggttcctaagtaaagaatgtcactttctgacaggtccaggagctccaagttatcttgagcccttgaggtgaggaattcacccaattaatacaagtatttgcaggcacagataaatccgtggctgggctaaatgctttgaagtctaatgtgagatttcttagggaataaagttgcagcaaagccaattttaaaaaggagcatatatggcaaataattgttctagctgaccttatgcaaacactcgggccaggtatagtaagaataaaacttattttgcacataaattagtcctaatgtgatttgtctttagtaaaaatagggactggagagagaaattatgtttcagaaaaaaactatagaacacctgttgttagaatctagtcttgttcactatttttgaatttttattattttctgtcatttggactgaatcgtgaattctttctggactacaagtcccaaactaatgctttcaaatttttctttcatttctaacttggcctcaataaaattgctactacctctttcctgaggtcctataagctgaagcttattatgagagaaaaacatgtcagattgccaccaccttcctcgtctataactaaagatgttttgagtctaatgtctggataaattgtgcccagtgttaatctttgttttttttccgtgtctatggaaatgcctcttacagaagcttagcccatctgcagtgccacctcctgatatgggaaacagctgtttaactgatctagtcttaggacttggacactgactaaaaagatatgggacaatatatttaaattcactctttcctgtttatcccagtctctctttctaacaacatatagtctactgttgacttaagtgttgtactagaactgtgagtaagaacattaacatctttgtcatacacccgtgagtacatgcaggtagctgcacggtggtgagctcactcctattcccctgggaccaacccctgcaactatgccccctgtcagcaggaagaagccagagtgatggtcaccctttttctatctctatagccagcaccttaagaataaggtgtatgaaagccaaagggggtattgaaaccacctttgcaaaagttatatcagtgagagaatgatgacagtgaaagagatctgagctaatccaccccccatcttgcctttctcttaattattcatttcccttaattattgcatttcccttagttattccatctcccatgtggtgtggctggccttgtgtctgttaaactctttctctactaaaatgcccatggtctttatgcagccggcaggaagaacccctcaggcggttacagttttgctcccaggggacagttttggttgttataaatgaggaaggtgtgctcttggcatctagcaggtagaggccagggctggcctcctgaagtgcagaggaaggtcccctcctctttcaagagagttatccagccccaaaaggtcagcattgcagaaattaagaaaccctgacttagaagctttgcacctcgtggtagctgtaaatgaggtatttacatcctccatgaagacgtaaggaagttgaaggaataaaaatctcatggggctttgaaagcaatgcaagcatcttttagttttcatacattccatggaagtagggatttttttctaaagcaaaaagaccaacaagactttggagctcagtttagaagaaaaaagtgactttcaaaccctttagaagtattcatttacaaatgaacaatgaaatgactgtgtagatggagaaaccctgagcgccccttggctttgatctggtggtcacgttcatccgtgtctgttccctgaagaaccagtgcccacatttgcctgccttctttacctaactccccccaacaagagctgaccctcctcccatcttctcgcctggttggtctttttcctccctccccctgaagcctgcctgcctctgctttccaccctccgacaagccctgatctgtgctctgaacaaactcctatgcgggtctctttgaagtctttttgcctgcccctaagtgcatccctcccacccccacccaggtgatactgaatctatgtgaatttgtggagttctcccttccttcccctctggcagaatcaccaggattcagtctagagtacaacattatagatgttttctagcacttttcagctgtccatacgctaatatgtagtcttgggtctttatccgaatggagtcctattatatttgtttcacaccatctgctttccttatttttgtatctttactgaggtatattgaagtacagtaagctagacttgtatgaagtgtgcagttttaatctgttttttcttttttatttctttgtttgtttacatacattttttagagacaaggtctcactatgttgcccaggctggtctcaatctcctgggctcaagcaatcttcctgcctcagcctcctgagtagttgggactataggcgcatgccaccacacccggttaattttttattttttgtagagatgagggctccctatgttgcccaggctggtctcaaactcctgggctcaagtgatcctcctgccttggccttccaaagtgctaggattactacgggtgtgagccaccgtgcctggctcgttttttcatacacacacacacacacacccatatttgtgaaaccagcaccacagtcaaagaatatttccatcactctccaaagtttacttgtgcttttttgtaatgtctctccccctccctctacccctttcccaggcagccattggtgggcagtctgtgactattgcattttctagcaatttatattactgaaatcatatggtatgtactcattattttgcctggcgtctctccctcagcatcatgattttggggcttcatgttgttgcacatgtcactaactcattcctctattgctgcgtaggattccttcctgtatggatgcactatggtttgtgtatccattcaccagttgttgaatgtttgggttgtttgttttttattgtgacaattatgaataatgctgctgtaaatgtttacatggctgtacagtggttctcaaacttcatcatgcatcggaaccacctgcagagcttgttaaaacacagagcatccaggcacggtggctcatgcctggaattccagcaccttggaaggctgaggcaggaggatagcttgaaccgagaagttcgagaccagcctgggcaatgtagagagaccctggcactaaaaaaaaaaaaaaaaaaaaaaaaattagccaggtattgtgtgcacttgtagtcccagcttctcgagaggctgcagtgggacaatcacttgagtccaggagtttgaggctgcagtgagctgtgattgtgccactgcactccagcctgggtgatagagcacaagaccctgttgcataaatactccccccaaaaccccagaaaaaccaacacacagagtggcaggccccatccccagagtttgtgattcattgaattaggggctgggttaagactctgcctttctaatgggctctcagctgatgctggtgccaatggttcaaggaccacatagacttcgagggctgctgccttaaaggaagtctttgtaaattatgatagttaatcgtttgttagttgttccaggtatttctcttctagaccattccttgccatgtaatgttgcttatggtttgaagcatcaagctcgcatttttgtgtagtcgaacatgtcagtcttttctttgggcttctgggcatggcttccttccagcaaggggcagataccaagaataacttggagtaggtgaggcaggttttgatgttagcaaaactcaaaccatgacactcccccaaatgggagtctgccctcattgggcctaattgtgccctctgctgcagatgctgggatggccttctgatgggatggccgggctgtgttgtcagcacccgcccacatgagacgagtttgtagctgtgcctggtgccaagagctctgaggtgctactatgccccctggaacctttgggcaaagcatagctagtcatcaggcttgcctttcacaggcaaaccaaatccatcctttcttcatccccctgccctgccaaaatcaaccagtctcaaatcaattcacgaaagggggccaatttgcctttcgggtgtctgatctaacaagccttggagcagctaggaagctaccagaagatgtgtatgatcaatgtatttgttatttattttattttatttttttaagtttggggaaaggtaatacttttggtcaaccatctgaagggactccctcctctaggccagggcactccatagttaacctgaaaaactggttcagggcatgacaggaagggggtttgaacatgcttcattatgccctcctcccttttggaattcatgaacagccgacagcatttaacacagaccttaagtctgataagaaacagttacaatctattttctctgaagcctgctacctggaggcatcatctgcgtgataaaacctaggtctctacaaccccttatggtacctggacatttttttctattgataatagcttttttttttttattattgagacaagtgctgttgcccaggttggagtgtgatggcatgatcacagctcactgtagccttgacctcctgggctcaagcgatcctcccacctccgcctctctagcagctaggactacaggtgtgtgccaccacacctggttaatttttgtattttttgtaaagacggtgttttgccatgttgcctaggctggtctcgagctcctggactcaagcaatctgcctgccttggcctctcagagtacagcgattataagcatgagctaccaggccttgccgataataactctttcaaccagttgccaatcagaagaattttatcccagaacacacaccccccccccacgcccccgccgcctcaagtcttcccacctttctggaccaaaccaatctatatcttaaatgtattttgatatctcatgtctccctaaaatgtataaaaccaagctatgccccaaccgccttgggtacatgttctcaggatctcctgagggccatgtcacgggccatggtcactcatattcagctcagaataaatctcttcaaatgttttgcagtttgacttttttcattgacagagagcagctttaaattactgtggactctttgttgcaaaagcatcttcttgaatttgataataaagccctactcttccagtttgtccctgagtgcattctgcaggtacctccggtcaccgcttcttatctttgctgttgacctcagttcattcctttcagattcttcactcaggagaagtcgtggaacagattcctggaggattccaggctctgtaaggaggcttatctccttaggatggttaaattttggatttgcagtgacttgtaatcattggctaatatcctagtttcttcttctcttttttaatgacaactttactgagcatacacacaactcattcctctaaagtgtgtaattcaggaatttcctagtatttttacaaagttgcacaaccatcaccactgtctaatttttgaacattttcatcactcccaaaggagaccctgtacctgttaagacatcactgccccttccccttctccccagcccccctggcaaccctgaatctggtttctgcctctatggatttatctattctggacatttcatagatacagaatcatgtgatgtgtgaccttttgcgcctggattcttacttcatatttctgagtttcatccatgttgtagtatgtgttgttctagtttcttgtaaatgttctgtcaaaaccccaggtgattaaggaaggtggaacaatgttctgagataagtcagccagagacacaggctgctcctccctccaattacatttaaaatggaaaatcgttcacaaatggaacattgttcataaaattgtttatagttcagcttctattctagcatgaacggtaattttctctttcgcatttgctgtagttcctccaaatttctcccactttcctatacctaaaggtcaacgtagaaaacaattttcgtcagctagagctgggcctgcaggtctctcttgtgttgcatcttttgggtggagtcagaaggtcctttcttggtgtaagagttaggaagcttgcatttcccaaaggggttgtgtggtgttccttccagagctgaggttgtgggattccaagcagcaagacttaggctgttttctacggcgtccccaaagtcacaaccctgactgatgcaggaacagaatcataaggttgtttacttttctgaatttatcaaaccttttgtctgtgtttgaccaaaattacttttcccgggttgggttggagaatatggagggtgattttctgaaaccattcatgggacatgattttctggggcatctgtacctgcaatgaagggcttactgataagactgaaggccattgtactttactggttggtgttataattgatcatattcatttcttgtcctactgtgacaagtgactgcacatttactggcttaaacaaaaactattatcttacggttctgaaggccagaagtctgaaatgggtctcactgtgctaaaatcaaggtttagcagagccacaactttcctggaagctctaggggagaattggcttccttgccttttccagctcctggagactggccgcattcctgagcttgtggccccttcctccatctgcagaggagcagcgtagcacctctctgactgtccttccataggcatatctctctgagaccatagctgggaaaggctgtccacttttccgggctcctgtgattacattgggcccatccggaagatccagaataatccccacatctcaagagacttaatttaatcacatttgtaaagtcccttttaccatataaggaaacatattctcaggtcccagggattcaggcatgagcatctttgggggccattattctgcctactacattgtcagtcttcaaggacagacttacttcctttgtttctgtctcttaatttgctcctctgaagcctgcaagattcataggcttatgtaacgtttgtgttttgtctctcgaataattgagaaatctggtactgttgagccatttggtttgtattgctcactcactgagtcgattgattggttggttgattgagtgattaatagagacagtctcattttgttgcccaggctggtctcaaactcctggtctcaagcgatcctccctccttggcctcccaaagtgctgggattgcaggtttgagccaccatgcttgccctcagtattgattccctctgaatgagccaggatttgctttccattttggagagcccctagattgctgaacagctcagagacacacttgtgtattgaggtcctctttcctgccactcttggttttggactttatcagggactctgccagagctacttttctggacttggagtctcagagtctgtgtcagctgtgggtaaggaatgagaccaccatgaagcaagcagaggtagcgggtggggcctggcttccaggactttgcagatgctgtgtgtggatttctggggcctgaatcaagagcccctgggtttgtggcttcacagaatggtggaggaagactggtggagttaagggacagaagactcaacaataattagcttgttaatcagcattttggctcaaaaatagtttgggagtatactggtcagctttctgccatgctaatgttgcataacaaacagcccccaaattcagaggcttaaatcgtttctttcttgctcactagtcatggttagctgtgtctctcctgggcttatatgggaataggaaggcctggtcaggttctgggctaggcttagggttgaaatgatgtgtctcctcatcaggggaccctggggcatgttgtttgtgcctctcccatcaggtataggaagccaagataaatcatgcaggcacatttaaagtctctgtttgtcactacccctaacatcccattgaccaaaacaagtcccatggtgaggtccagcctccacgggttggggagggctattctagtctgaaagccctgaaaagtcacatggcaaagggagcagccatagacttccactatgggaggatggaagagttagcattgcagtgcctctgccatgtttgtgggtggaagggaaggtgatccctgtggaagagactgtggatacatccagtcataccctagaaaatcagctctataggtggatttttgaagcactgtgtgcttgttatctttttattattactttatttttgagacaggatctcactgtcacccaaactcgagtgcaatggtgagatcatggctcactggtgcttctttcttctgggctcaagtctcctcccgcctcagcctcccaagtagctgggaatacaggtgcacactcaccacattcagctactttttaaacattttttttgtagagacagagtctcatcatgttgtccagactagtcttgaactcctgggctcaagcagtcctcccacctcggcctcccaaagtgcagggattacaggtgtgagccactgcacctagccagggtgcttgttaaacctgcagcttccttgattccatcttagagccctgttctcacctgaggagaggggattgtgccccttggggaacatttgacaatgtcgggaaacacttttgcgtttcacagctgggtgggggttgctcctggcatcttgtgggcagaccccaggggttccactaagcactgtaatgtgcacaggacagcccccctcaaagaattatctggcccaacaaatgtcagttctgctgaggccaagaaaccctgcacaaacaggcaattttaggtgattttcatgcactttatagtttgagaaccatgtcttgcaagactgttccaactgggaaggggaattggtgattctttccatataagtagacacggacacatctaggaaggaaggtttgatatctcgcagatagttgtgtggagaggcgaattcaaacccaagggtcttagttagatctattacttctgtaattaaaaaatatgttctgctcatattgtattaattctttgttgtattaagtatttactcttgctgtttattagtagcttaataaatggaccgtttatttggtgtgggaagaaatctatgttttattagatttctattatgagcttattttttttctaagtggccttttgccagctgtttcttctgtcctgttattcctgctcaccagcaagattataaattcttaaaaaatttgtttttaattttttttttgagaggggatctcactctatcacccaggctggagtgcagtggctcaatcatagctcattgcagccttgaacttctgggctaaagcaatcctcctgcctcagcctcttgagtagcttgggactataggtgcatgccaccatgctctgctagtttttaaattgtttttgtagagatggggtctcactgttgttgcgcaggctggtcttgaactctagggctcaagcaatcctcctgcctaggccttccaaagtattgggattacaggtgtgtgccactgcaccaccgcatcaccgcacttggccagtatatttatatatatatatatatatatatatatatatattttttttttttttttctttgagacagagtctcactgtgtcatgcaggctggagtgtagtggcatgatctcggctcactgcagcctcgacctcccaggctcaagtgattttcccgcctcagccacccgagtagctgagactacaggtgcataccaccacacccagctagtggccagtaagttcttaatagcagtgatcacgctttatattttgtttctactctgcacagtactcagcatacgataatgatcagtcagttgctaatggtatcaattgcaatgtgagttgcgctctgtggttaaagactcatttatgaggtatccgtggaccagccttttatactttgctataaatcctgtttctaggcttttggggctgaatggttggcatattgatgctcggtttctgtgtggcaattaggagaaaaggtccttgtcactggcaagctgacagcctcctttcttctcctaccctcaagttgttttggtgattgaaatgtttcagatattaaaaaaaaatcaagaattgcttgctgataggacaacagaagtacagttcagggagttaaagcttctccattccccacctcaattgtacacagcaagcatggacagatttccttgtagaaagcatgcaagcagcatttctatggaggatgctgtgtcacctgaaatttgctatgctcagatcagccaagtattgcctctgggggctaccagcaagttatagaaataactttgttatgaaatacttctttaagggggtgttagtattgattcactgaagtggttctccttgtgtacatggagtagttgtgagacgaaggtttcttttcttcctggctccccatgtgggaaggacgcttagtggtttgtgggatgcagggagaggaacagagtccatccttcagttgctctttttactaatttattaacttgcctctcatccccttggctgttaagacactaagctggtgtgtctgacaagcagatgacctaaaaattcacgcgtagtaaaagggaagatgaaaatagaagtatatgaactaaattaggaggaggacttggcttcattaaaaaaatgagaaagccatgttgtgctttttttaactgccacttttccaagtgcaggactaacagtttcagatgtcattatgctaccagtcttggtaatttctaatcatgttttgtctaaagaatatttacattaaaatgagccagcctctttaaagtcacattttagtagtgagaaaaccaatgtccgtttttggaaagggagcccttacctcagctggtgtgagcgttttgtggaggtctgcggtgtttgtgacttgtgccagaggccttgagctagaggcaacataagaaggaatcaaacttccctttctgttcggtatgcctctgtaccaagacgttttgttgattgattcatggcacggtgatacagggtgcatggtatcagatgcagggagtggaatattgttgagattggggctagagggtgtgtgtgtgtgtgtgtgtgtgtgtgtgtgtgtgtgtgtgtgtgtgtgtgtgtgtgtgtaggggaggaaggaatggaaggatgaaaccatttgggaatgtgctggaagacatgcttttgaggacaagcaatgcgattttggcattggctgggtttctgagccagtgatgaatgtagtgcattgctatgtgactgggagtgtgatagagagatattccgctggttatttccctccacctgcttcttatcagtgccatagggcagagtctcaattccacttgccagaatgctttctaggaactctttatgctcaatggaggtgatgttttcccacttgctatgctgtgccttagggaacaggaactggtattatcacataagcaatctctaagtcccttggaagattgtctcattcatcaagagggagaggattctgattttcctgcctggctcctccaggaagtctaacttcttgcaggggacctgttctctcggcccacttgtacagcatgtataaaaggaaatgaagacttttggggatttgttgattcacttgtttggaaattggggttatgtaagcccaatttgagttccaggactcatctatgattgcctggattaaatcaaaggacacccatgtaggctggacgtgatggctcatgcctataacccaagcactttgggaagctgaggcgggcggattgcttggacccgtgagttggagaccagcctgggcaagatggtgacattccatctctactaaaaatacagaaaattagccaggcgtggtggtatgttcctggtcccagctacttgggaggctggggtgggaggatcacctgaacctgggaagtcgaggctgcagtgagctgatatcctgagatcatgccactgcacttcagcctgggcaactggagtgagatcttgtctcaaaaacaaaacaaaacaaaaaaaaccaaaaaacaacctgcgtaattgtagatttttgttgttgtttgatatactgtctcttttcctggaaagaaccctctcgtgggaacagaaatgttgaatttagtcctgatgctgtccctaaccaccccgtgacactggtcccaggaaaatataggaattgtctctctttttctgtcatctcagagcttgagacaaatgttctctgaggttgttttagcaccacactgtgattcatcttcgagactgttcacagcccttgatctgaattgatggagctgtgggggatcataccgccactgccagtgctgagagctgcatgtggtgcggtccagtggctacagcgttgtctttgggatcttcacttggcaccacagcggatttgtataattattatgttgactggaacttagagtgactcaactgccttgaacaggaaccaagaaagagaggaaccaaattccagaagagaatttgccagaacattccagcatattccatactctagggttgtcttatagggtctgagggtacttcttggttatctactcatgtgcgtctgacataattaaaggccgacttagaccctatcagagaaaatcaagttcagacacttagtctaaatggaagtaaggaaaacgattacctttatctcattatcttagttctctttggaagatatataagcttgaaccatggtgacaggtgttgcctttaaacatggtgacaggtgttttcctttaaagtccttggcaaatcaactcatagacttcttcaacttcaaaaaaaaagtttttttaaaaaatattttaaaaatatttaacttgaggatcttcattgaaaattggtcatctttcgtgaatttgcttaagtaggctttgatctctttttaaaggattccttcctgcctgatacatttggtccttttagaattcgggctagaacaattctccatgaaggtggacgtgttaaaatctatttggttcattgttaggatcactcacattacaagagaaatttcggtcttgagtttttgtttttgcttatttgctttcttggaaatgtttccacatcaggtcttagaggagttgtaaaacaggaaggaggagttgacatgctgtttcataaccaatgcttgcttctcgccttggatactaacattttttccatccatttcccacataaaacatggagacaaacaccagagctgctcctgagaggtgctgagtcataggaattgaagggggctgttgggccctcgtgtgtgggatgggctcaagagctatcagtctacagagggaaaggttcatctctgtccctcattgcctgcagtttctctttggccctggctttttccgttcacagctgccctcgacgttcattttaatcaaatttcacctgcataaaagggctatgggcagagagtcttctctgtgatggagcgcagctatcctacaagtatgtagccctgatttagtagagaagaggcaggaattgtcgagggcggaggagcaggagaaatggtgcacaagggagaggggataatgacaggtcattcagggatgtctacggaatgtgaaaatgcagcaagatgggtttcggtttctttttttttaggtccgacagagattcctgggatagctgcatcttcatgttgtacacgcatacacttgattcccattattcactggagctatgttctgtaaagtcgctgagactttatagaaagcatcaccccagggaaaatacacagtgaggcttctgcgaacctctggtcacaatgttgttgtcaagcagtcagtgcataactttgttgtatgtatttctattgtgtgtttctgttggttcctttacattgcactcacgccaacagcactgtgactcacgcctggccgaacctcatctaacgcacgtattttccccataagacgcatcccagccttgtgcttcaggacatgagacagcactgcagcatctgggggccattttaagcagcaaagtcacccagaaactacaacatttcaaaaaactggcactgtgaatagactgcgaaaaggacacttgtttacggagtgagagccttgttcaccctcagctgggaacatgtgcatttggtgacacagccacacgctgcatgtttgagaatgaccatgaaagcgctgcaggtactgattttggagctacaaataaatgttagccaataggcaaattcacagacacggaatccgtaaataacaaggcttggctgtgtgtgtatacatagtgtagtgttgatagtgtgtatacacaatacacattgatattttgggagagattttgaagaagtcaccatgaaagccagtgtgtccgtttggccctctggaaagcgtgcggtgaggaggagtcagggtacaagtgtttaaattggggacatggcctgaggagatgaaagagaggtggggactgagtagggaaagctccacaccacaatgcataactgataaggttttggccaacaagccagagaaccctagagcaaagagtgccccttgcttacagccagagggccttgctcagtgaatatagggggctaggagtggggaggcatctccaaaggagcatcgtggatttgcaactctgtctttctggaaaggatatgagagtcttgccctctcccccagggctgacacagttgtaaaccaaacttttgacttcagttgtacatatcaattattttgcacccacattagattgaaccaaatgacactggctcttttaaattaaaagtggtcaaatgctggcagcctcttagggttcaattcaatggaatcttttaaaggtgcaataatgctgtttgaaatgaggagaacgcctgtgttttgtttgctgagagaaatccactatctctcatccagaagatgattagacccataatggaagccagtcagtggcatgaggaatcatggagatgattctcacctggttgattggatcagacgttcctagcccgaatgagggtggaaagggaaccaagagatgaagtggattgttgggtttatgagaggacggtggttgtctgtctatagttaaggttgtttaaactcatgaccatgagaatgagctttttctggataactctttccttttccttctgatttttgagagtgctgaaaactcaagtcctgtatttaaaaattccatcgttgaaaacatgtttcaaggacagatgacacacttatgattatagcatctgaagtgatgggaatattaaataacctttggttggacatgtaaccatcagggctccacttggtcttaaaaccaaacacacacagttcttgtcgttaaagatatccatggcctggcacagtggctcacgcctgtaatcctaacactttggaaagccgaggcgaggggttaacttgagcccaggggtttgagaccagcctgggcaacatggtgaaaccttgtctctacaaaaaatacaaaaattagctgggtgtggtgttgtgtgcctgtagtcccagctactagggaggctgaggcaggaaaatcacctgaacccaggaggtggaggttgcagtcaggcaccatcctgcgattgcactccagcctgggagacacagccagactccatctcaaaaaaaaaaaaaaaaaaaaaaagacttacacagagaaagcctgaagcccacaagagcaattagcaaaaggaaccctgacataacaaatacggtggtgtcattagcaaccaggtagttaagctcaggggttgctatgtgtcataaacttgaaagctacattggccacgagtaacacaaatgtaggtgctaatcacagatagttggtgggcatttcaaactttctcttcatatctatggatacccaaaacagtgtgcttccatttagaaggcttccattgggaggctgagacaggaggattgcttgagtccaggagatcgagattagcgtgttcctccctccctccctccctccctccctccctccctctctctctccctccctctctccgtctcttcctccctccctctcgtttctttcttttttcttttctttctctctctctctgtctccctctctctccctctccctccctccctcccctccttcctcctcctctctttcttttgaggtggggtctcgctaagtttcccaggctggtctggaactcctgggctcaagtgatcctcctgccccagcctcccaaagtgctgggattacaagcatgcatgagccactatgccaggcctattttccctttcctgctatttcctcccagctaacgcgcttttaaaatttgatacaaattaatttttctttttttgtcttttgttcaaataatgatttgatttctgttctctgtctgggtcgcttcaataacatggatacctacacatagttttatcagtaaaggtcattgacataatcagtgtgttgtgagaacaaagataggccctcatttaagctgctccattactcattttataagtcagagaaggaaggggacagcgtcctctgttttcagatggctattgaagtgagtcagagtgacggtgagcagcatgcattgaattctagctggaaagagggtttttaggcctgcgtttgagcttgccctgaatgaataaggctggaaacctataggccctggagaacattaatgaggaatctgctttccctgacagctccttgataaacgaaatgatggatgtgcagcgtgcagccctgagcaaaggcctggcagctctgtggctgagccctagagggctgagctgggccagggctcccagtagtttgttcaggagcactgagagccacagcaggtgctgatccagctcttgccttcttcgcgagtatctgacaagtctgcagagaccgcaggagcctggctactccttgagttcactgtcttggagcaagcctgtgggggaatcacatgcccccccactctagtgcccattggggacatggaggagggagtttccctatttgcagttaggttttgcgtgctgtccgcgagcttggtttcccctttgggttgcacagtgctgagatctgagcccaaggcagttgggacattaatgatgagacagaggaggctttgctgtgttccacatctatcaggctgctttgcccagggagacgccccccttgcttggggtcttgggcttgggtaggggttctggaatgtctcccctccagcaggctctgcctccttggcttccttgattcagagagcagtgcagtggctttgttgaggagcagcccctgtggaggcgctcatgggtgacaggctgtggctgaatagtggacagccctggtcactgacattaacatggtgcaatagagccttcttatgtgttccttggttcccactgccctttcatggtcgggtgtcctgattgtctgtggctagactatgccaacgtgatcagtgtccttcccagaacccctgaaagagggtcatagattgagatgtctgtcaccacccctgtccattgcagagtcacatacatgctagagaccagctcgcccttgatgcgacctgaggacctcgcccgctagtcattacagggaggggaaagacaataaaaagatgaaagagagtgctgtccctggtaatggaagttactcatcattgtaccagtgggcagccacatagggataggtcggaagagaaaggggaaagagtgaataaaaaacgctgatgtttgtgaggccgagagaggaacagaactattactgctggtcaagggggccatccacttaaaatgttcacatcctgtttcagccacaagctggccaagatcatcacataaagggacaaacgttggccccagaaagaacgcatggtcatcttgagtcaaggctgtctcatttgatgtcagaattcttaagagctgctctggctaggtgcagtggctcatgcctgtaatcccagcactttgggaggctgaggcgggtggatcacctgaggtcaggagttcgagaccagcttggccaacatggtgaaaccctgtctctactaaaaatacaaaaattagccggacgtggtggcaggcacctataaccccagctacttgggaagctgaggcaggagactctcatttgaacctgggaggtggaggttgcagtgagctgagatcaggccattgcactccagcctgggcaacaagagcaaaatcctgtctccaaaaaaaaaaaagaactgctcttggctgggtgtggtggctcacacctgtgatcccagtgctttgggaggctgagacgggaggattgcttgagcccaggagttcgagattagcatgggcaacataacaagaccccatctctttaaaaaattagccaggcatggtggtgtatgcctgtggtcccagcaacatgggaggctgaagcaggaggatcacttgagctcaggagttggaggctgcagcgagccatgatggcaccactgcactacagcctggacagcaaaggaagaccctgtctcaaaaaaaaaaaaaaaaaaaagcaagaaaaaaaaagcatccaggtgtggtggctcacacctataattccagcactttgggaggccgaggcaggcagatcacctgaggtcaggagttcaagcccagcctggccaacatggtgaaaccccgtctctactaaaaatacaaaatattagctggatgtggtggcgggttcctgtaatcccagctactcgggaggctgaggcaggagcatcgctcaaacccaggaggtggaggttgcaatgagccgagactgcgccattgcactctagcctgagcaacaagagcaagactccgtctcaaacaaacaaaaaaaactactctccaaacagaacctgcacctacccaattgtggtgggtgcccctcctggggctcctgcagtagcggtggtgtgggaattgagaatcttgcaagtgctatgagggagctgagacactgagtgtggcagggccatgtgcccagagcatgcacaacccatcctaacgtctgccggggaaggtgggggatttctgtgcattgcttttcaaccagaaaggtaatttttgttccccaggggacactcggcaatgtctggagacagttttggttgtgacactgggttaaggagtgctactgtcatctaatggatggagagcagggatactgctgaacatcccacagtgcacagggcggcctcacaacaaccaagaccacctggcctcaaatgtcagtagggctaacatccagaagctctgcgagtctgtgggaagccctggatgccccaatcctctttcattttcttctcaccacgtaggacagtttagctggacagtacacaggactcattcaaggggtcatgagaggagacctcatagcataagggtcaagtacaaggactttgcagtcagactgacgtgggtttcagtccctacccatcctagtggtgtgaccgagagcaagttgggcatagtgacatctgtcttgattgactttggagtttgacaggcagtacatgcaaagttctctattcccatgtcactcagagtgagtgtgcaaaacatactattgttggcatccatcgtcataagagtcactgtgaacatgggtgagcttagcaccttgtggcacggggctgtggtgagggactcagacagctttatgattgagtttgggcctcagcgagatggcaaagctatgcttctcttgctccttggaccatggtgacctgtgaggacccctgggggctgccttctccactgttgcagttcagggagctaaggccaaaggctactgcagtggtggactctggggtccccctggtgacaaggaagggactttgagctttggaatgccctgggctgagtcttgccacctgcaggtttgtgaacctcatcatgccttgtttttagcacaacaaaatgggataatagtgactttattattgatatactattatgctgttttcaggtatgtgacactgctgctattttactgtttcttccagatttccgtgagggtggaagaaaatcataccatatcagatgcctcgcagagcaccaggcccaccgtgaaaggtacagcaaattttacttccctcttcttgcctcgttggaaattctttcctgtgagatttcctcccctccgccctccgcgccttctgccatagcctatagcctcctctgggagttcttggataattttgttgccttatacctttgcaatttccagtatggtagccatgcgccacatgtggctgtggagtgcttgaaatgtggccagtctagattgagatgccttgtagaagtataaaatacacactggatttcaaagacttagttcaaaaagaaagaaagcaaggtatcttattgataatgtaatacagtttacatgttgaaatgatcacttggatacgtggagtaaaatagaatgtattattaaatgtaacttcacctgttttcttttgacatttttttgtggacccagaaaattgatagacaggtggatttccttcacacttacacacttgtcttgctcaagaccagccctgcttcctcactggctgctcagtcaaatgcctcctccagtttaagctgtccatcacggggccacccattatgtgtccatctcatcttctctgctcagtgcctgtgcaggcagctggtgttcctgctcctcccgcccagctttgcttatgatgctagtcttgagtgcaggctgctgagcttctcacctttcttcccatacatgtagaacctctcctccagaaacatggggtacttaccagctggcaaggagcagagctggggttcacattcatttctgtcttgctccaaatccatgtccctaatagattactgtctccaattgctttgtggatgtaaacacatagtaagttcctagagagcagggaccatttttatttctttcatctctgctgttcaagacctttctaaagcttttttgaaagaattaagatttctagtctcttgcccttccactttctgctatgtgaagacacagtgttcctgccctctgccctctggatgctacagcaacaaggtgccatgttggaaggaagcagagaacatccctcaccaaataatcaatcctgctggtgccttaattgtgaacttctcagcctgcagaactcacgaaggtcatcaccatgtaggctgattgatcttggacttccaagcctccagaactcaaatcagtgaatttaaaaacattttatggagggcggggccaagatggccaactagaagccacggtgttgggaggctgctatcagaaaagaccataataagcgtgtgaatccttcatcagcaaccaaggtatctgggttctctcatcaaaattgactagaaggctggcgtgacccacagagagaaggaagaacagtgtggtgtggcggcccacctgagagtcacatgggaaagggaaccccctcactccagataaggcaggaggtgagtgagcacgctacccagccggggaaactgcttttccacagaactgtgaaacccacggattggaagatctcactcgtgaacccacgccaccagggcctcgtgtcccagccccagaacacacagattcttacagcctctcagctggaatccgcttaagcttaccaaactcctcggggaggggtgaccagtaccagctgcagctgcctgctgtctaagccctttgaactcctgcagggaggggcagcagccagcactggcaactgcctaacatgctaagctccctggacagggggaagggtggcacccatttctgtagctacaggctacgcttttcccctgctagagccagggaggctggacagcttggtcccaagacttgtccccacagcccaacacactggctgtggcagtctgcggctagagtgcctcttcaggcccaatcccaacccatcctttcttagttggggtgtgtgtggggcggggcgcttccctgctggatctccagtaactccagccagaggctaagggacagaatttggatctcctgggcctcagcccataggggaggggtggccgcagtctctgctgaccagcagatttagcttttcctcctggtagttccaaggaatctggacagcccagatgagtgggtttcccccaagcaaaacacaccctctccaccaagggacagagtgctccattaaacgggtcctgctccctgtgtcacccaactgggtgagacccttcaacagggcttgtcagataccctctgcaggagtgatcctactggcatcaggttggtgccccttgaggtcagaggtcccagaagaaggagtaggcacccatctttgctgctctccagcatccttaatgacatctccaggcatgggagcgaatcagatgaataaggcctgaaggtgaaccaccagcaaactgcagcagccctacagaagagggactggactactgaaagaaaaacaagcagaaagtgacaacaacagcatcaacaacaacaatcaaataaaaggtccccacaaaaatctcatccaagggtagcagcctcaaagactgaaactagacaaactcatgaagatgagaaagaatgaaaaaatgctgaaaacccaaaaggccagagtacctcttctcctccaaatgattacaacatctctccatcaagggcacagaactggacggaggatcagatggatgaattgacagaagtaggcttcagaagatgggttataaaaaactacaatgagctaaaggagcatgttctaacctaattcaaagaagctaagaaccttgataaaaggttagaggaattgctaactagaataaccagtttagagaggaacataagcaacctgatggagctgaaaaacacagcacgagaactttgtgaagcacacacaagtatcgtgaagcataaacaagtatcaacagctgaatcgaccaagtaggagaaaggatatcagagtttgaagaccaccttactgaaataagacatgcagacaagaatagagaaaaaagaatgaacaaagcctaccagaaatatgggacctcataaaaagactgaacctacgattgagtggagtaccagaaggaggtggggagaatggaaacaagctggaaaacacacttcagggtattatccaggagaacttccccagactaccaagacaggccaacctgcaaattcaggaaatactgggaacaccattaagatactctatgagacgatcaaccccaagacacataatcatcagattttccaaggtcgaaatgaaggataaaactaagggcagccagagagaaaggctaggtcacctacaaagggaagcccatcagactgacaatggacttctcagcagaaactctacaagccagaagagattgggggccaatattcaacattcttaaagaaaagaattttcaacccagaattttatatctagccaaactaagctttctataaaatcctttccagacaagcaaatgctgagggattttgttaccactaggcctgccctgcaatgtctcctgaaagaagcactaaatatggtaaggaaaaactggtactagccactgcaaaaacacatgaaaatataaagaccaatgacactacaaagaaactgcatcaactaatgtacaaaataaccaaatagcatcatgatgacaggatcaaattcacacataacaatattaaccttaaatgtaaatgggctaaatgccccaattaaaagacacagactagcaaattggataaggagtcaagactcattggtgtgctgtattcaggagacccatcttacatgcagagacacacacaggctcaaaataaagggatggaggaaaatttaccaagcaaatggaaagcaaagaaaaaaagcaggagttgcaatcctagtctctgacaaaacagactttaaaccagcaaaaataaaaacagacaaagaagggcattacataatggtaaagggaacaattcaacaagaagaactaactattctaaatgtatatatatgcacccaatacaggagcacccagattcataaaataagttcttagagacctgcaaagagacttagactcccacacaataatagggggagactttaacaccccactgtcagtattaggtcagtgagacagaaaattaacaaggatattcaggactcgaactcagatctggatcaagtggacttagtagaagtctacagaactctctaccccaaatcaacagaatatacattcttctcagtgccacatggcacttattctaaaatcaaccacacaattggaagtaaaacactcctcagcaaatggaaaagaactgaaatcatgacagacagtctctcagaccacagtgcaatcacattagaactcaggattaagaaactcattcaaaaccacataatttcgtggaaattgaacaacttgctcctggatgactcctgggtaaataatgacattaaggcagaaatctagtatttctttgaaaccaatgagaacaaagagataatgtaccagaatttctgggacacagctaaagcagtgttaatagggaaattttgcactaaatgcccacatcagaaagctaaaaagatctcaaatcagcaccctaacatcacaattaaaagagctagagaggcaagagcaaactaatccaaaagctggcggaaggtaagaaataactaatatcagagaagaatcgaaggcgatagagacgcaaaaaagccctccaaaaaatcattgaatccaggagctggttttttgaaaaaattaacaaaatagatagactgctagctagactaatagagaagaatcaaatagacaataaaaaatgataaaggggatattaccactgaccctacagaaatacaaactactatcagagaatactataaacacctctatgcaaataaattagaaaatctagaagaaatgaataaattcctgcacgcatacaccctaccaagactaaaccaggaagaagttgaatctctgaatagaccaataagctctgaaattgaggcagtaattaatagcctagcaaccaaaaaaagcccaggaccaaatggattcacagctgaattctaccagaaatacagaggagctggtaccactccttcagaaattattccaaacatttgaaaaggaaggactcctccctaactcattttatgaagccagcatcatcccaatacccaaacctggaagagacacagccaatatcatactaaatgggcaaaagctggaagcattccctttgaaaactggtacaaaacaaggatgccctctctcaccactcctattcaacatagtattggaagttctggccagggcagtcaggcaagagaaagaaagaaagggtattcaaataggaagagaggaagtcaagttgtctctgtttgcagatgatgtgattttgtatttagaaaaccctatcatctcagcccaaaaacttcttgaactgacaagcagcttcagtgaagtctcaggatacaaaatcaatgtgcaaaaatcacaagcattcctttacaccaacagtaggcaggcagagagacaaatcatgagtgaactcccatagacaattgccacaaagagaataaaatacctaggaatacaagtaacaagggatgtgaaggacctcttcaaggataactacaaatcactgctcaaggaaataagagaggacacaaacaaatggaaaaacattccatgctcatggataggaagaatcagtatcatgaaaagggccatattgcccaaagtactttatacattcaatgttgttcctgtcaaactaccattgacattcttcacagaattaggaaaacctattttaaatttcatatggaatcaaagaagatcccacgtagccaagacaatcctaagcaaaaagaacaaagctggaggcatcatgctacctgacttcaaactatactacaaggttacattaacaaaaacagcatggtatgggtaccaaaacagacatatagaccagtggaccagaacagagacctcagaaataacaccatacatctgtaaccatctgatcttcgacaaatctgccgaaaacaagcaatggggaaaggatctccttattcagtaaatggtgctgggaaaactggctagccatatgctgaaaactgaaactggaccccttccttacaccttatacaaaaattaattcaagatagattaaagacttaaatgtaaaacccaaaaccataaaaaccctagaagataacctaagcaataccattcatgacataggcatgggctaagagttcatgactaaaacaccaaaagcaattgcaacaaaagccaaaattgacaaatgggatctaattcaactaaagagcttctgctcagtaaaagaaactatgatcagagtgaacaggcaacctacagagtgggagaaaacttctgcaatctacccatctgacaaaggtctaatatccagaatttgcaaggaacttaaacatatttacaagaaaaaaacaaccccatcaaaaagtgggcaaaggatatgaacagacacttctcaaaagaagacatttacacagccaacaagcatggtaaaaagctcaacatcactgatcatcagagaaatgcaaatcaaaacctcaatgagataccatctcatgccagtcagatggcgattattgaaaggtcagaaaacaatagttgctggcaaggctgtggggaaataggaatgcttttacactgttggtgggaatgtaaattagttcaaccattgtggaagacagtatggcgattcctcaaggatctagaaccagaaataccatttgacccagtaatcccatttctggatatatacccaaagtaatgtaaatcattctgctataaagatgcatgcacgtgtatgtttcttatagcactatttacaatagcaaagacatggaaccaacccaaatggccatcagtgatagactggataaagaaaatgtggcacatatacatcatggaatactatgcagccataaaaaggaatgagatcatgtcctttgcagggacatggatgaagctggaagccatcatcctcagcaaactagcacagaaacaaaaccaaacaccgcatattctcactcataagggggagttgaacattgagaacacatagacacagagaggggaacaacacacaccagggcctgttggggagtggggatgagaggagggaactatgagggtcagtagggatggtgctactaattaggtagtagggtgctgcagcaaaccaccatgacacacatacacctgtataactaacctgcacgttctgcgcatgtatcctgttttttttgttttttttttgtttttttagaaaaagccgggtgcggtggctcacacctgtaatcccagcactttgggaggccaaggcggacggatcacaaggtcaggagatcgaaatcatcctggctaacatggtgaaacaccgtctctactaaaaaaaaatacaaaaaattagccgggcgtggtggcgggcacctgtagtcccagctactcgggaggctgaggcaggagaatggcatgaacccgggaggtggaggttgcagtgagctgaggcgacaaagcgagactctgtctcaaaaaaaaaaaaaaaaaaaagatttctagtacattgcctaaaagaacccttggatgaagtcagacacatgggtagtatgagaccccagatagcatcattttgtatgtacagaatcgcttttttttttttttttttttgagtcaggttctcactctgtcacccaggctggagtgttagttatgtggtcatggctcactggagccttgatctcgtgggctcaagtgatcctcttgcctcaacctcccaagtagctgggattacaggcacacgccaccatgcctggctaatttttgtattttttgtagagatggggttttaccatgttgcccaggctggtctcgaactcctgggctcacgcgatcagcccacctcggcctttcaaaatgctaggtttacaggtatgagccactgtgcctggtctagaattgcttttagtggatgattttttgctgtcactgttaatggcgtgcattttctgagttatcagagatggccctgcatgctgcgagtctgtgttgactgtactgttggctgtgtgtgtggagggcaggaaagtgccgtccttgctgtaacttgtgttattaatgatatggacactgtgagttgcttctagagagctacacctcacttctgtgtcagcaaatgaaggcccaggaactgacagcgttccctctagctttaattgcggtataatcaccacaccctaacattctcctgttttacctttggcaacatctagagtttggttgtcacagctgatggggtgggggtgctatggcattgggtgggtagaggccaaggatgctgctgggcatcctacactgcccaggacagccccccacaaattatccagccctaaatgtctacagtgccacaggtaagaaatcctggaccgtagggtagacagatttgactggagtggagaaattgtatcctggggtaagtgggatttggattgcagttagtgcagagcttgtgtgtgtggaacgccttggacactggactaatccaagaagttgggtggggaggaggggggctttttctttaggtcctggaaaccattaaaaacctttgaacaggtgctttagaaagacaaaactggcatctgtctgaaggatggattacaacaggcaccagcagactgtggcccacggggccgtgtccagacttggcacacaaccatgcccattcattcatgggttgtctctggctgctgtgatggttaactttatgtgtcatcttggctaggccatagtattcagatatttggtcaggtacttaggaatgttgttgtgaaggtattttttagatgaaataaacacatcagtagactttgagtaaggcagatgacttccataatgtgggtggacctcatccaatcagttgaaggccttaagaaaaagactgaggtccgccaaagaggagggaattctaccagtatcctgcctttggatttgagactgtgacatctgcgctttcctgggtctctggcctgctctggaaagtttgggcttgccggcctccacaattgtgtgaaccagttccttagaatctgtccatctgtccgtccatccatccatccatccatccacgcacgcacacataaacaaaccctattggcactgtttctctggacagccctgactaacatcactgctttcttgccacagcagccaagttgaatacgtgcttgtaagtacagggattgtgtggcccacaaagtagaaaatatttactctctggccctttacagaaaaaaggccaagcattggatttggtaagtgaagtccttccatgaaactgagaagtgctgagtcagtactcaatgggagttaaaacagagaaactgtaaaagccaagagggctcaggatggtgataatcacggtctttcattcttttctcctgtgcacatttgacccgctggcatgcaggagatttaatctctctaatccagaatgtgttttagggaatggcttgcctggcttgtgggttgaaatgttctctcctcagatgtggctcctgcaatatcagctcacctgatgacaagaagtggaagccatgtaaccacctgagacgcaagttaattagggtttatcagaaagacaacctgaacccctgtgggatgtgctgtgggtgaagaaaagataccagtattctgtgattccaaataggagattttaaaaattctacccctggaggatgggttggcatttgtcttccaaacataggttaaatacgttttatttctgtctgttttgtacacattttaatcattttccagctcacaattacagttggtacttctcaattctcagtgaattgtgtagtggaattgtttgcaacatcatactttggaaatgacgttggcaattaaagttttggtccaagtttaataatgaagactatttgaaaggccaaaaccgatggatgcttttgagatgaaatagtcatttgggaagaaaatgagggcaggttgtctacttcttaacatttatctgtttttttttcttttttgagagggtcttgctctgttgcctgggttggcgtgcggtggcgcgatctcaggtcactgcagcctcaacctctggggctcaagtgattctcccacctcagcctcccaagtagttgggattacagacacatgccaccactcccagctagttttatttttttgtagagatggggtctccctatgttgcccaggcttgtctttaactcctggtctcaagtgatcctcctgcctcagcctcccaaagtgttgggattacagacatgagccaccttggattacaggcatgagtcaccacgcctggccttaacattgatcttgatgacactgaaatcgttgatgtgtgccaagggggttcctttttctaaatggaagctcactgttttgggtatccatgaattcatcatagatatgaagagaaagtttgaaatgcccaccagctgtctgtggtagcacctacatttgtgttactcatgaccaatgcagctttcaagtttatgacacgtggcaccccctgagcttaactacctggttgctaatgtctttggacatcactgtatttgttatgtcagggttccttttgctaattgctcttgtgggctttcagactttctctatgtacgtttttttgttttttggtttttttttgggagatggagtctctgttgcccaggctggagtgcagtggcgtgatccactgcaacctccacctcccgggttcaagtgtttctcctgcctcagcatccctagtagctgggactacaggcatgcgccaccacgcctggctaattttttgtagttttggtagagatggggtttcaccacgttggccaggctggtcttgaactcctgacctcaggtgatcctcccgcctcagcctcccaaagtgctgggattacaggcatgagccaccgcacccggccagtgtaagtcttttgaaacacagacacctagtgcctttcccgtgagtctttcagggaaagattgagttccgtgtcaggttggagttgctgatcaagcgactgactatacggcttcctagccccctttatttgaaaaaccagcgtggtcttcacttttcccttgagcctacaaccacagggtgcctgttcatgtatttccaggaccttatgcggctcctttgctctgcttattccgagaaccaagccttgggactgtgcattttgaatacaaatgaaggcacccggaggaagcccccagagtctcggcacagttgaggaaacaaacaaagcatgctacacgtgcaggaagatccctctttaattcctatgatgacctctctgcttttttattttttaagttaaaaggagtcaatgctttgggttttgttagactggacaaggtagcaagtcatattaaactaacccaggttgttgcttgagttttcactgaacttagactctactgacgagtatagtcaagcagaaattcccctcacgaggtggcctgatggtgtactccagtgggggggtgcagaagatttggagggatctgcttcccgactggggcaggttaacctctttctgccttagttacctctttgcatgtcctaagagcacctgcttatcagatccttaggaggattcactgaattcgtccacttggaatccacatggaaggctgcctggcatgtaggaggtacccagtaaattttagactcctgttatttttgccagttggattcaacagatgtttgttccctggactagtgtttctcacctgggggtgatctgcacctaggggacatttgacaaagtctggagacattttgggttgtcacagcttggggagggagtgttactggcatccagtgaatagtaaccaggtgtattagttttctgtcgctgtaaaggaatacctgagactgggtaatttagaggtttatttggcacatagttctacaggctgtacaggcatggtgccggcatctgcttggtttcttgggaggcctcagagcttttgctcatagcagaaggcaaagggagagcaggtgtctcacatggcaagagagggagcaagagacagagggaaggctaggctcttttaaacaaccagctcttgcatgaactgagggaactcactcagtaccagggggagggcaccaagccatggttcctccatgaaccaaacacctcccaccaggccccacctccagcagtgaggattaccccactacatttcactgtgagatttggaaagggaagacatccaaactatgtcaccaaagatgctgctaagcatcctaccgtgcacagagcagcccccataacagggttacctggcaccagagtgtcagtagtgttgaagttaggctacactgtagttcacttgcttattgtgtgtaggaagaccggaggccagttacctggcaataacaacaacaacatcaaaaccccctcaaacccaaaacaaaaaaaccccacatgacactgtgagtgttttttttttaatttgcaggagattgagtcttaatccagttgaagacctttatttccttgctagttacagagaggtttttcctggttcgttgcctgtgtttgttgcagttagtttttattgacctttctagggttcatgtgtgtcccttgggtttgccatgttttgttctccaaagccccaggagggttccccagtaacagagactgtgttagatttttaacattttcttttactttttgttttaaatgatttcttttgattaattacacactcacactgcgttgcaaacatagtgctgtcagatcccagtactgtgtcctttaccggctttccccaaggggagtggcttctcacaggatcatagagcaggaaaacccaggaaatccacgttggtgcaacacagttacctagccttggagcccttacttggatttcaccctttttgcgtgtactcatttgtgagttgcatgttaaagatgagagtcagtaatatatttccaaatgtcaacagaacataaattgagcagaagagtttataatgagatggaggattgagcagaagagctcatagcgagccagggcgaacaacctggcgaggagctccttgactttcttggaggccgaggtgggagcgttggtgacaacccccgggaaggcagatgttatcaggagttaaaatgtgatgtgtgtaccgctcatgtgtgtatggggtgtgctccttttgtttttgatgctgaaatgagacaaatcatttcccttttaagctccaggcagactgatggaggggggaaaaataacacccaacttactgcaacctgaaatcctttgccttggatccacttcctaagttcctatagtccttattttataaactgataaaacaacttttctctctcaagtgatgatcatcttgtgttttacactaattaagcccatatacacctccctttggaattccttcttctgatctgcttggcctgtttgccagttagtcgccttactaggagaatcaaaatgtaaactcataatagacaggaacccaacatcatcagcacaggatgtggcagaatgatttttctttcccacctcttgctgagaaggcaatgagattggaaatggcaaacaccccagagttctgtaactctgagtgtggaagaggaggtggcagcccttgacctcagtagcggagccagatcatcgaacatccccgtccaggaatctggacatgcactggtcaagaattcagcacaatttcctttggtctggggattgggaagctctttttgtgagtgaggcatggagtgaaattgcagaagcctgcgtgacttgtagaaaccgaagccaggctcgtttactgccttgcacaagggagatatgataagacagaatttatttgtgagtgtcgtcgatgccaaggagcctgtccaacatttatagaggcttttgggctaaacgaaaaagggtttgatctgtctgtggagacagaaagtagatgagtggttgcctaggactggggctttaggcgggtaagaggttgtcactgctaaagggtacagggttaatggaaattcttgaaattgtgctgatggtggctgcacaactctgcaggtactaaaagttgttgagttgtactcgaaatgggtccactgtatggcatgtgttttatatctcaataaacctgtcaaaaaagggtgcaggaccactgtttttgtacatgtcctcaaaatacttcctgtaatctagtgtggtcacagctggttcatgtgcacggacatagtgtcagtgtcattgtggagatagcagtttcagattcactggttccagaaaatgtgtccctgcctgttatctccgtgttgccacaattaagaaccaagggtccataacaagcagtgaaaccatggttcatatcagaggaagtggggtggtgtcatctcttttgtatttttctcttttctctcccccactgcctttgcccacttccttctccaaaataaaacaaaagagagaaagcaagagataagtggctgagctgaatgtggtccagccctttagaagaggggagtacacatactggagggaagataagcgaaaatacagcctttctcaagggccagcacagacggagataaagagagagccacaggcacactggccaagcatcagctcctcaagcatccatctcactattcagggtggggaaatacttgatacctcaagtcctctttatcatcgcagatgaaaactgacataggtgatttcctttcggagcatttagggagaatgcaagggaaattgacaacacacttggtgcaattgggtaaccagtctttgtgttgccctccaatgactcttgcttggaaatgattggaagcccatcgttttaagtcattggaacgactgtccccttcataaagcatgatgtagcaaaatgaaaagcatacttctggttaaaagtgtttttcaaaaaaagcttaccacattgaggaggtcatttcatatttcctgatattcagcaattttgctgtgagctttgtagagttgttctggtgcttagttcaaataagaaaggaattactgaaattgcacattaagttaaaaaaaaaatcagggttttgggtcctgagacttgttacctaaacatctgtcttgctattttgttacagcacaaagtaggaattgtaaaacatcttcgttataaactgagtactatacagtctctgggagagcagaagaaacgtggtaggaaggaaccacccagggtgggtaatgacagagtagagatagtcagatagggccggagacaaggccaggaaaggcgagaggaagagcctgcaggaacgagtttcttgcacgtttgagagctggacctgccaagagggtaaggccaacatctgtgtgtgttctttgaggaaatccgagtagcctgccctgcctttgaccctctgctctttgaactgtggattccttcccatacacctgtgcattctcagtgccgtggtcagatccccaaacagacaccaaaccccgacctccgaggcccaggcaggagcataacccagccccaaggggagataaagacagaaagaatcagtattatagcagggacctttttcaggaatctgccttctgcagggcagtgccctaggtgcattcaagccagcatagcaaatccacatcactagaaagactctttccgttttataacttgggaaactaaggccaaggcagtgacaaatgccaggtccccaaactctgaactgcagatctgcaagctgaatggtggcaggtgggccagtgggattttaaagccgtgtgcttttcagggcaccctggtgcttctccaaatgccggaagggtttccttgaaaattcatagcactactcagtcaggattctgcaggacagtgccctggggagtgcatgagtggatggttctgtgggtagaagccacgagctgaagatagttttacatgtttaaagagtaaagagactgggagcggcggctcatgcctgtaatcccaacactttgggaggctgaagtgggaggattacttgagcccaaggagttcaagaccagcctaggcaacatagcaagaccttgtctctaaaaataaataaaataaaataaaagccaggcatggtggcagtgctcctgtagccccagctatgcgggaggattgtttgagcccaggagttcgaggctgcagtgagccatgttcatgccaatgcactccagcctgggcaacagagccagatcctctctcaaaaaaaaaaaaaaaaaagaaaagaaaaaaacagtaccttgttgatacatggaaatgatgtgacattcagataaagttttactggagctccgccatgcccattcatggacatattttctatggttgctttttcacaacaaggggtgttgcaaccatggcaacagacactgtctgtcttgcgaagcctaagatatttgctctctggtcctctgcagaactagcgtgtagttctgagtgcttgaaggcacgtaccatcttggtggtgtgacttggactttcacctctcctgatcccttcttcatttccaccctactctcatcttgccttgcttgcagaagcctggtattttcataattcgagagtcacttacttcatgtgaagtcttgtcccagttaaagtgccaatagtcctgggagaggtaatacattaaaccttatcagttatttatacctcaggattggaagggattgttgctggctttgtcctataacagctgcgaccagaggacagagcctaagggctgttgcatgaaatgagggaggtgtgggtcacctctgtgcagggcatgagaagagaggaggctgggtcatctgaaagatgacctttgttcatggcctttttctgtatcctcctcagtcacccagaaattgggattgttggtgacaatcttttgggaattggtgttagcttcggagagccacttagcctgaagaccctccttactccgttatcatagaaccagagtggtagccacacaggcagactgtccatgctgacgtgtaaggcagggccttacacctcctacccatgtaggaggtggtggagctgggattttacatggacagccttctgctcccctggtgcttagctacattctagtgccttctgtgcaatgccagcttaacatacatatgaagtgtgctgacccaatctcctgcctttgcgttcactattttagatggttgtgtcaccttgagcctggactagggagataacacgtgaaggagatgccgcgtggtttctgtcttgtccatggtacgtggaacacattcccctcagtaacattatggttgagacatggaatgccacaatgtacagttgccaccatatggtatacttcatatatatacacatatatatttatttagtttattttaatttttttagagacagagtcttgctctggtgcctaggctggagtacagtggtgcagtcgtagctcactgcagcctcgatctcctgggctcagtgatcctcccactgcattgtcccaaagcgcttggattataggtgtaagccactgggcccggcctacttgtatatttttcattgcaaatgtacatttcagttacgttgtgggctttaaaaagcctttctaggctagttgggaatttgaccctattttttacagcatagtttctaggagaaaaacatttctgaggaagtaacaaaagaagacttgggctgtatcccatttttaatttagagagcactgtcatttgaaaatttcttctctcaacatgttttctttttgagacatgaagtaggcaggcaggatcttttttacagtggcgctggtgtctttgggaagcggcttccttggtttgcctttgctcattttctttcttgacttctccaggcattcagctgcaggcatgtacctctgctgctgggagagtggcaaggagagggggttggaggaacggggataaaaattagctagaattcaaaaacggcagtgacagcccagatgatttttcatgctaacctactttaaaagctgccagaataattgtggagtgggaaatctctcatttctcctgtcctactctgacaagatctaaaaataactttgaggagatgggcatgtggccctttgatctccttggcctggagtatttcttggtaggagcagagcttacaagaaggtgttcttcaatgagtgttctggcagtcggagttgtgggtggggctgattactgtaatcttccttcgtcattgaacgatttcatctgcccctggtttccattacttgctgctctaaatattcctctccccgcaccttccttttatgtagccacaaactggaatatgtgcatggaaaacccaaaggaggcaaatcccacttacactgcagaactttggtgctggatttagcggctatttaccaagcacctcctcttccagaataagtagcacagatctttgaccgccccccgccccccaccgagggactgtggtctagttggaagacacaaggcagaggtgtaaaaagggaactctggagataggaattggaaatggggctgagagctgaagagatggcctggggctagagaccagggagatgggaggagggggagttccttggaagagtgtgcccctaagagatcctgaagagtgagcagagattgatgagaggcgagaggagacctagagttatcagggctgcagaggtgtccttggcacatagaggccatagtatccacgttggcttccagggtaggggcagtgcatctgcggctggctgaagatggaataaatgggatagtggctaaaaagatgggggtattgggggaacacctctccttggagtggtcctccttgcagataaggggagacgtagaacagcacttgacagggaagctggtgtgggggaaggatttttttacactaggggagacttgtggttgagttaaacaggttctagaggccaggcatggtggctcatgtctgtaatcccagcactttgggaggccaagttaggaggattgctcgagcccaggagttggagaccagcctgggtagcagcagcatagagagaccctgtttttacaaaaaatacaaaaattagctggacatagtagcatgcacctgtaatcccagctgctcgggaggctgaggtgggaggataacttgaccccaggagttggaggatgcagtgagctgcagttgtgccactgcgcaccggcctgggtgacagagggagaccttgtttctaaggggaacaaaaaaagaagttaaagagataagataaagaatggggggaggggacgtattttttgcaggagggaaattttgagggtttttagccttggaaaaggagcagaacagatgggaaggtcgtaaacgtggaacctttggaagcagaaaggaagatgatttctcttaaaaagttttgcctagagatgactaatgtgaaggtcttggtgttttaagggagcagggaaagccagaggtggtgggtccggtagatgcaggaactgacccaggctttcagattgtacactggggagcagagagtgcgtgcttgggggtggggaggctgctggccagggctgaccttcctcccatgacccctgcgtagaatcagagtagcctcatttagtgtacttgagtcaaggccttctgtttaagagcttatttgaactcattacagtcatcgcttggtatccttgggggattggttccaggacctcctgcggatacccaaatgattgcacactcaaatcctgtagtcctctcagcaaaacctgctgataggaaaagtcagccctctgtgtctatgggttttgcatccccagatactgtattttccatctgaatttggttgtgaatgcagaacctgcccataaggagggccaattgtatttattgaaaaaaatccgtgttgttcaagggtcagttatagtttgaactacaaaaagcaagcaaccaaacaaaacccccaaaaaccaaagctttaattggttaagtcagagcagactaaaaaggactacatgcccagtggaactttctgtgtagtctagtagccatatctggctatgaagcacctgaaatgtggctcatgcaacagaggaattgaattttaaattttattccttttaaatatttatttttgtctttcttcgtttcttttttttttttttttttccctgagatggggtctcgctttgtcacccaggctgaagtgcagggtcgcgatcactgctcactgcagccttgacctcttgggctcaagcgatcctcccacttcagcctcccaagtagctggggccacaggcatgagctactttgcccggctaattttttaacttttgtagagatgggggtctcgccatgttgcccaggctggtctcaaactcttggtctcaagcaatgcttccacctcggcctcccaaagtgctaggattacaggtgttgagccacaatgcccagcctaaatatgtatttcagtagctccatatggggaggtgtcttggacagagcaggttagcccgtgagactctctggtccttgagtgagagggaaggatgagggcttgcagatgatcccagtgggctggttctggaagcgaaacctgcaggccccatggcttggggaaggctgaccatagcaggtgggaggagctctctgaaggccgaggctgagcactggtggagaacagggcccgtgctcacgtatcccacaccccagaacttggtgtgctggattccagccttgtgtgtttctcattatgactatgtaaatgccaggagggttgggactgtgtgatttttcttcttgcttggatgctcgagagttcttcattaattagtgaaggaaagctggctctaaggagaagcagttgaagtggagttcattgcccccacttctctgcagcaggaatgccttgtccctcctgcctcggttgaactcactttctcaggctcccacctttgaatggaggcccttgtcaggctctccatccccagcgactctgttgacatttccccatgggaaaggaaaagaccatctgaaagtttccatctgtgtgcaaggttttctgaacatgttgacaacatgggtttaattttgtgaggtcagcaagagttcttgtggtttgggatttagtaaaaactgtaggctttgtatgggaagaaaatctctctcacctctgtcttctattcttcattctctacacagactctccacttgtctttagcactaaaaacacaaactaagcattatgttttaaaaaaaacccaaaccccaagtccagtagctgattgccctgctttagcttttctccctcgttgtcattcttcaaagaaagactccactcctttcagctgtcaccctttcaccctgatcaccgcatgcagtctggcctctgccccgcttgaaagaagcactcttcccagggcacccgggaactcggaactgtgaacccccagagtctgcccagcccctctgtccctgccttttgagcaacagcgactggtgccacaacctggggtgcccctttccctgggcagcattacccacactgggccaccgtgggccaagtcacccacactgggccaggtcacccacactggaccatatgaggccacgccactcacactgggtcatgtcacccaccccaggccacactgggccatgtcacccacacttggcagggtcctgtctttctccactctggtgtctcctttatcttgatgctcaagactctctcaaaacaccagtggttcagcacagtgtggggacagagacttcagcgaggcgcccccagccccacccttgacgggaaataagcgcaaactccttgtgcctgagactcaaagggtcgtgtgcctttattggcccccttgccttacaccagtgttcttaacctttctgtgtgtgtgcgtggctctctgtagtcatcgagtgaagccgcagaggtctcagaatcacattctaaaataaaagtagaatcataaaggaagcgattaaaagtgcaattgtcaaaatatcaaaaacatgatttgttgaatagtgcttttttcttttctttttattggtaaaatacatgtaatataaaatttagtcattttaaccttttttttttttttttttttttttttagacagagtctcactctgttgcccaggctggagtgcagtggcacgatcttcactcactgcaacctccacctcccaggttcaagcaattctcctgcctcagcctcctgagtagctgggattacaggcacacgccaccacacccagctaatttttgtatttttagtagagacagggtttcaccatgttggccaggctggtctcaaactcctgacctcaggtgatccacccaccttggcctcccgaagtgctgggattacaggcgtgagccagtgtgcccggcctattttaaccatttttaagtgtacagttcagtaacagcaagtacattcatactctgcacagccaacctccagaactccttttgtctcgtagtcctgaaactccatacataactacccactcatttccccattcccagccccagcacccacccaactttctgtttctgtgtgcttcacagctctgggacctcagatacgtggaatcctacactatgtgtctttttgtgactggcttatttcactcagcgtactgtcctccaggttcgtccacatggtagcatgtgtcagaatgtctttcctttttaaggctgagtgctgttccattgtatggataggtcactttattcctgtaactgtagatggatacctgggttgcttccaccttttgactgttgtgaataatgctgctacaaacttgcctgcacaaatatttccttaagatcctgctttcagttctttgatgtgtgctttctaaaccttttttattttttccttttgttttgagacagggtttcactctgtcccccaggctggagtgcagtggcacgatcgtgactcagtgtagccttgatctcctgggctcaagcgatcctcctgcctcagtctatcaagtagcttggactacaggcacatgccaccatgcccagctaatttttgtatttttggtggagatgaggtcttggtatgttgctcaggttggtcttgaactcctgggctccagcaatcacctgtccttggagggagttggcaatggaagtgggttggctgttggagcccattagaatattccagagggatgatggttccttggaccagggtgtggtcaaggagctggagagatgggagtcagttacagacaagacagtgggatttattgggattcttgatttctctcagtggtgagaaatttcgtctttccacacaccttccatggaaacccggaacaccatgggtcccccgtaggcagtcttaagaggatagctgtttttgttctccttccaaattcccattagacttgaggtcagagtcacactttacttgttttgaatatttaaagtagtatacctaatagctcaatagactgtatgcttttatttttattttttgagcctgccttcctaggtatttggacaaatttctccataagagaagtgaacacgtaactctaacttgtaatagcaaataccgcgggaacactgggagccacatattaagatgttattagaccttccctggagtatccaaatggtctataattgcttaataaggagaagtttttgctgagatttacatgatagagatttgctttttaaaaagaaattatccagatttgaatggaaaaattgcatagtctcctgagtgttgttttgcctttgactttgtactgtttaagaactgattatgagcaggaggaaataactcacttcagctgtaatataaatgtgcattggtatttaagcatatgtgacacataaaacaataccaacttggccagaatttaaatgtttatgtaaattacatttttggacaggcactttcctctattttgcagagaaaataattttttcccaaagagattttgtgtttaaaaaaaaaacccctaatactactattaggagtgttagatgccttcgatgtggttttctttcctctttttgcctgaaaggcttgagtgctgaagcatctagcgctattcttgtgtccgggaacgttcctgcctcatttttgtttctagtcttgtttctttctgtgtcagaaataagactaatgcgtgcagctgcacctatagttcaagatgaaggggtctgtgtgagagagagaacgtctgtgcatgtgtgtatgtgtgtgagtgtgtgtgtgagagagaggagagacgggcgggggaggggagagagagagaaaagagagagagagaaaaaaaaacacagcctctttgtaatacctggttgactcagtgaagtctggctctctgagctttactgaattcctccttacttattttggggccggaggtggagatgagttcaaaagtagataaaatttgcctgttacctaaatgagcagaatagattgcgcataatcttttctagatgaagcctgtgtttttggcattctgctctcaagtcctctgagctgatctgagagtgaactggagtgttaagttgagagagatgttgatgactctggtgtggtcttttcctttcggagaagtggaggtgaaacgacttgcccggggtccctgggaagcagagcttgtgccaagatgtaatttttcggttctaagccctgtggtttttcttctgcagcaaggtgggtaccctttttctgtaagggaccagagagtatggattttaggattttggggccagtcttggcaactattcacctctgcaactcagccacattgtgagaaggcagccctgcacattgcataaacaaacaaatgtggctgtattccaataaaactccatttatggccactgacttttgaatttcatagaatattctgtaagcatgtgtcagcagcttcccctgtgcaggtccatgctcagaggtagtcgcgttggggaaagttgctttctgccctcctggagttgatagacttgtggggaggcagatactggaaagcagccacagacacaccaaaggggggagtcagtcccctgtcatgggaattgtgatggggagcgccctcccctgtgcatttagaaaggccccgccacacggaaccactgggaagctgaggcttggagattgcgtgggatttgagatgagccaggcgtgggcagggagatcgcacaggggaaaggaggatcgccgtggatcacacaggacaaaggaggtcctgacctgtccacccccaaagccctttgcttccctagcccacgttggtgtagggtgggccgagagggggcgcagtgtgaggagtgactgtagctgcagctcagcagcgtctcaggagaagccagctgtctctactcaccacgggagtttatttccagtgtgggagagggactcttgagagagaaggacaagatgcccgtttgccctacagattcctttgaggaaaattcctataggggtctcgtctctgttgtatttattgtagtacgacctttttttaagtgattcaccataatctctctaggccgtatttaggcactgaccctaaatgtgcgttaaaaaaaaaggtttgggatattttggtttatttatttgtgtgtatgtatatagttgttaaattggtgtccttggggtgggggttgatcggtggaaccttatcttctctgctttcttgctccaccccatattttggtttgtttttgttagaggtcggcaaaccttttgttgtcaatggccagataataaatattttgtggtttttaaaccctgtagtctctgggtgttatatggcaaaagcagccattgacaacatgtgagtgactgagtgtgtttatttatgggcactgaggtgctgggatcccatattcacactgttccgccaccatcaccgccattcataactcccaaactttttctttttcttggtggaggagtggagcagggtcttgctctgttgctcaggctggagtgcatcacggctccctacagccttaacgatcctcccatgtcagcctcccgagtagctgggaccacaggtgcgcatcaccacgccaggctgattttttaacttttctgtagagacgtggtctccttaggttgcccaggctggcatcaaactcctggcctcaagcattccacccactcctgcctcccaaagtgttgggattacaggtgggagccaccgtgcccagcctcagaaatttttcattatcccaacccgaaacctggtccccatgaaacagtaactccccattctcccttcccccgcagcccctggcacccaccgttctattttctgtgtctgtggatttgactagtctgaggtgcctcatgtcagtggagtcatgctctgtttgtccttttgtgtctggcttttttcacttagcataatgtccttgaggttctcccatgttgtagcctgtgtcaggacatttgcagctcagttcatttccgaggaattgtcctatatgcagggggtcttaggaacacaggtaacttcacttcccatttgaagagcgaggagttctcccgaggccctgaacaggaatagagactgtgaggcattggcgtttggaaggaagtgtctctgaaatagaaacgactgtcagatgaagagggacagttcagtatggtacccgggcctgcctttccagacgtccccagcctctttgcctagttcccactctgggcccctgggcaggtgacccgcagctgcacatgggtttcctgggaagccacagtgctgaggatcttgggagagaggctcaggatcagagtctggggagtgcaggagcttgcggggggagggggtggggtcagtgggggcggggggtgctgctttggggattgggaggagtggactggggcggggtcacagagtctttagctgaacccatgggtgctctgggtctcggcttgtcctgactcaagtcaaggggcccaggcctttgtaaaggtccacattgcccattcactggggcctggctttgggtgagggtggcagctggagatggggggaagccctgaacgggaatcttggccacacactgctatatccgcgacaccaaattctatcccacctgttgttggctgttctggaaaccagcactgaaaaatacggagtggaaaagttttctgattttttttttcctgctttgtttgggttttttggaaaacaatttcaaaattagcatatggcttgttaaaattaaatcacaaaggaagtgcctatggtaacgttttgatcaggctctaggtctgtgtgaaccacggcccatatttgaaaatccagctttattgggacatagccatgcccattgctttctgtgtcctctgtggctgctttagtgtgccaccagggcagacttgggtgggttgcagcagagatggcatggccctcaaggtccaagatgtttactctcttgccggtcctctgttatctctggtctttgtggttgccacagttttcttggatccaggagttaaaggcagtcctgagggatgatggcctcatctccgcagttgcctggaatgctgaatttcagacgtgctaaaggaggggttgcagacattgtgtggaatgcattcagaccccagatgtgggtgcaggaaggcaggcatggcacagccaggtagagactggtttccaggcccaagcagccttcagcagctgtgcgccttgtttctgatgttgtttgggagtaagaataatgtagacatggggggtcatgaggctcagggtaaaaacttcaaggaaacctccatggcatggttgggcgcagtgactcatgcctgtaaccccagcactgtggaatgccaaggtggaaggatcgcttgaggccaagagttggagaccagcctgggcaacataaggagaccctgtctctaccaaaaaaaaaaaaaaaaaatgaccaggtatggtggcgcacacctgtggtcccagctactcaggaggctgaggcgggagcctgggaggttgaggctgcagtgagctgtgattgcaccatggcactccagcctggaccacagagcaagaccctgtctcaaagaaagaaagagagagatagaaagagagaaagaaacctccatggcagatgcatggaggaatgggttaatatctagaaatacgctgagtggtggagtaaagaaaacccacaatagaatacctgatgaatgtggggaaagcacttctgagctcctctagttttagaagacctaaaaagacgatttaaaaaaacaaacaggagagccctgttattgttgatgtcttccaaaacgaacgtgcatttataagccaggtggcattttaatgtcacgagggggtccattctcccatctgtctcctttgcttttgttagagtcagtagcttctaggtctgcttgacattggagaggatactgaatgcagaaaattttgtttaattataatgatttgattttttccttctgtattcaagtttgcctgcttctaatgaattggcagaaatgaagagcttgctcagattttgccaggaccatttaaaagcaattaaaatcaatttagttattaaatttgaaattattgtctggctaaatgatagtttaaaattcaatttatactggcacttactttttaatgaacagaccacatcacacatttttatgttctcaaattatctgtggctttaaagctgtaaaaaaaggtgctcttttaaaaaagccctgcatgtttcctttttcctctctacttccgctaaaatatttacatgtttcttttaaaataaggtgagaaaatccccttgacttctcaattttaagaaactatacttatcttttcatcacaaatgttcatttatctgtgttgaagtcaacccaagaaatcttaaaatataacggaaagaaaatgtttctggattttttcccgagaatacatatacttttaaatggcacgttttacccattgactttaattcctccctccctccattacatttttagatgtgttcaatgaaacgtagtcctccccctttaaaaaaatggaccgagcatcacgtgtgaggctgcaaagaggctccctgccaaagcatcttatctgccgctggtaaagccccgcccctccgtcagcagctaacccttgagcgggatgtgtgcttgtgccgggtgcattgcattaagagaatgcaactgaatagagaaggatcaggaccttttgtgcagaggtggggagtgttaaaaagggggaggcctgggtgggagggtggagttagtgggagatgggtatgcttagtgcttaaattccctgcattccctaacacgaatttaagaaactcacacagtaaatgagtcagggagagggagagacagggagagagggaggggagagggagagttcctttcattcatgacaggatgaactttgcatgcttcagaacaatttacatttttccttatttctaggtacttttttgaactaagaacctggagggtgtgtgtgtgtgtgtgtgtgtgtgtgtgtgtgtgtgtgtgtgtgtgttggtgtgtgttggtggtggggtttttttgccttatatttcataaatatttcttggttgattaaatgtcaataatcgctcatttctggtttgtaaagctgttacctgatccttgaataccacgaatattttgtacattctaaataattgagagaaaataacaacgacaacaaaaagacacaaataaaaagcatctccgcttatttaagaagagtagatctgtgcggggcgctgtggctcatgtctgtaataccagcactttgggaggccgaggcgggaggatcccttgagtccaggagttcgagaccagcctgggcaacataatgagaggctcttttttttttctttttgagacacggtctcattctgtcgcccagactggagtacagtggcactatctcagctcaccgcaacctccacctcctgggttcaagtgattctcctgcctcagtccccctagtagctgggattatgggcgcgcaccactaccacccggctaatttttgtatttttagtagaggtggggtttcgccatgttggccaggctggtctcgaattcctgaccttaaatgatccacaccctccttggcctcccaaagtgctgggattacaggtgtgagccaccacactggggcgcaagagcacgtcttttaaaatcagtgctgtctgtggggtgggaggggaggagaagtagatctggccatgctgaaaggttcgtgcagtggcctcctgagctgcgcacatgcttctggagctttgggtggacatttagtctgcatgtggatctctgtccaagcctgcactgggagcccctgccccaggaagcgaaggctgcatttcttttatgtcaattaacagatttctgccccaccctggacatctgagcgttaactgatttgtaagggaggggtgagggagggtaaaattacaattctatatcttaacattgggggtgaagcatttttaccctagaggaattctatccaaacacattaaacactcttaataagggacaaagggttgggacgtagcggttagggggcaagcccatgagcctcactccttgtgctctctctccaggaattggagagggaatccttttgcttagcattcccacgcctcccacgggcctggcactgggcccgcgggcttgccttagtctcctgggctgccctaacgcagcaccacgtgccgggcggctgtaacagcagcccgtaattctcccacagtcctggaggttctaagtcccagatcgaggggtcagcagggttggttcctccctaggcctctctcctgggcttgtagatactgtcttctccctgggtcctaacaaggtcatccctctgtgtgtgtctgtgtcccctcatctctagtcctgttggattagggcccgtcctaatgacctcattttaccttagttacctcttgaatggccctaactccaaatgaacagtcacattctgaggtcctggggcttaaggcttcagcatatgagttgggagtagggatgtaatatgcctaatgtccagaacaggaaaatccatagaggcagaaagtgggttcctgcttgccagggctggggacgggcagtgtggggtgactgctagccagcacagggtttcttctggaagtgatgaaagtgttctggaattagacagcggttgcaaaattctgaatgtattaaaaaccactgaattgtacattttgaaagagtgaatttcatggtatgtgaattatatctcagtaaagttgttataaacaaaaactgtgagggtaagaggtaaaaggaagggagttgaaagcagcatcaggtgtgaacagcccataattcagcccatagacgagcgcgaactcctagcacagctgtctgttgaagatgtgcgtgaatgcttgctttccgcacccttcggcctgcttttctctactctccaatttcatcatacattctcttccttcctccccctccccactttttcaaaacgtttcttctagtccttacttgtggctacacaaaattccataaacataatgctgcagttcaaagaagtgttctgatggtagggagataacttaggaaaatattttacctttggggaagttttggtttccttctgagtgaaaaccctccatgaaagagaaacttaaatgcagttttcaaatgctcctgagacattcccagccttttctttgtggagaagtgaaggcaggacaatttccaaggcaaagagggacctatcgcagacagcagaccccaagtaaagaaaggcacagtgatggtgggtattcgtgcagtgttttgaaaatgtggaggtcagggatgctagcttaccaggccagcatgatcaagttacgagaaatggagaccaggacactacctctgctgggtgtgctgctccgggctccttcgaaaggggaagcagctggtggacttccttgggctgtggttaaatggggctcccataggtgccatgaaggctctgcagagccagggatgcttgcaccctggagagaccttgctccaggagctcaggagctggtaggggtggtgacagtgaagcaccggcttgccgtgcccagtgcttgggcagtgctgagctccgagggaggaacccagaaccatgcgggagcaagggagggaggcaggcgaggagaagggttgcccaggagcctgcaggtcgggtcggtgttgtatcaaattgtcttttcctgctttgctgtctgatcccactaaagactagccagagagatgtggaggtgaaaaatggtggacagccatttttctccctttcactgtgtctacaatgtctgtttcatatcaacagcaacatctgtgcaggcatcctaatgagtataaataatgtcttcagaaaactgggtttgtgaggctcctgtcatctgaatttctttcatcatttaagtgatgattttttactcattgacatacagttgttatttagtggccacgtattattcgtatagggttctttatgtgctttctgtgtacatttgttttcgtgctcatcgtatttcagtgtggcttatatataataagatgcacctgttcttagctattgtggacttttttttaaaaaaaggtttatagagatatgattcacataccaaacacccatttaagtgcctaattcaacagttcttaataccctaatttaaaaaaaaaatacagtgttgagtattttccttttctcgtttttcactaaagtagactcaggattggggttatctgtcagtcccttggtttgattcttggctgccagtgtttactggggacggatgttggtacctcccttaataggatattgttacagcattttacaaattctggttaaaaaaagtcccacatgagatctcccctcttcccccctctctgagtgtaggcattgtcagctgcagttgtccagcatctccaggactcttttcatttgcgggatggaaacaatgtaccctctgaacaactcctccctgtttctcctccctccagctcctggcaaccactattccactccctgcttctttgaatttcacaacttgaggtagcttgtgtaagtggaattattttaaaagctggttcatgttaaagtgcttagaacagagcttggtgagcatccggtcaacagtaagtacttttattattctttttatattactctttttttttaaagaggccagacacatgggcttctgtcttttcacagcttgggatctgtgcagacccaggcttccagaagccatcccacttgaattcttactcccttttcccctaaaaagaagctctgaaatcctaattgtcaagaaggctttgcctgctgtgcatgcctgagtaatgttatttttgtcattatttgagagacagagaggaagcttccagtcccctgtaaggaaacgaaatcatcgtgcacagatgtggttctgtttatagagggaaggaaatggaggtgaagagtgtgtgtggcttgcagccaggcttgcgagtgtgcagaggaataaacttttttgcctccagagttttaactggaaatgtgtctgaattctacctcctgggcacactggcctgaggtctcccctgcatacctgatcgtgaaagtcttcgggtgtgtttgtaaacacgcagcccccctgatgtgagagtcagcacaaacttctaaagatgcgatgatgaattctatcagagaagtctttctggttttgtgaaaataaccttgcactctttaattatatccaaatgatcaaatctggctctgatgtcttgtcaaaattaatgttaaaggacagtgccctttatattttacttgtctgggtataaacatcctagtctttaaagttgagtctgtaggactacctctctacttgattactctgaaaagagtgtatagagtgagtttttaaaatggaattagtgtgcatacgaggaacagagtgacatttaacaaatccttcaatagatagtgctggtatgaggattggtgaaactagaggtagggaatgagcatttttggttctgtatcatattcccaagacattttcaaatgattcaccctttgccatcagaatggtttgaaatcgatcagcctgaatccactaatgtgggctgcggcacatgaattttaacactagaagcacacggttgtgctgtgtttcaaatgaactctggccatttgaagtgagcaggcataggcagtcttctgtcctgtgataacctcagtacatatcctttctgttttttaaagtaccttacaagctgctgcattacagtcgttattattgggccattacaaaaagctgtccaattttaagtgtcttggataattcttgtttgccccagcatcagaattgagcatttttttttttttttagatggagtcttgctctgtcaccaggctggaatgcagtggcgtgatctcggctcactgcaacctccacctcccgggttcaagcgattcttctgcgtcagcctccggagtagctgggactacaggcatgcaccacgatgcccagctaatttttgtattttttagtagagatgaggtttcaccatgtgggccagcatggtctcgatctcttgaccttgtgatctgcctgccttggcctccgaaagtgctgggattacaggagtgagccattgtgcctggccaaaattgagcacttttatcatgtagtattcatgtcttactggcaatgccctgtaaagttaaataagttacatttgtcttgcacaggtaataattatgaggtaatttccacagaatccaagggcctcattgactttgctataaaatcaaaacagtgaattctgataagactagacgcatgttactcttaaattgggctgtctcctggccactgttgtgcctttaacctcagcagaaggggagctgggctgcagagtgaaattacccggaggtcaaatattgctaatttgacttttatcatagagacattttctcctctcgcaccaaggcagtggctttaatccctctttcagtggtgagacaggtgcaaagcgtttacaaaaggctttctcttgttttgaatgcgccaagaaagatttccaggccgttaagttaccaatccttctttttaagtcttgaagcaattactgtaaggtcaatccactaatttcctttcagagttaccaaagacctctcatgtaatcatttggtacttgttgccatgtagccagtatcactgagtgcttttactgtgagcaaagcacaatgcatcgggcagggagggatccaaagggatcttggtttttacctttgagccatctgtggtcttgagtgatctacgtgcattagcaattaaaaggtcctgatattcttgtttgggcatattgaaaaatgtgctcttacagataggtttcctctctctactgccccccgccccccaattttttttattgtggtaaaatacataaaacagaatttaccatcataaccatttctaagtacactgttcaacagcattaaatattcattacattgtgcaatcctcaccacgatccatctgcagaactttttcatcataccaaacagaaaactgccccattaaacacaaactccctattcttccctccccacagccccagcaaccaacgttctactttctctctctatgattttgacactctagggaccttttatatgtgggatcatatggtatttgtccttttgcgtctggcttagcacaagtttcatccatgtcatagcatgcgtcagaatttccttcctttttaaggctgtataatattccagtgtatggatggactacactctgtttatccactcatctgtcagaggacacatgggtggctttcaccttttggctgttgtggataatgctgctatgagcattggcatatgtttacttctcattgatttaagtttacatagtcatgtgtggctagtggctgctgtattagacaggacaaccctaggcctgatagccctgaggacctagtttgggtgggaagacaggggtgacctgcagcgagttgtcggctgggggccttggtgagagccagatctgggttgtgaggccactcgaggcagggggaatggtgtggcgggaagtgaggcccaaaatgagaatttcagagttgaaagctttggaagtaacatgatgctctatgactgtgaccagactcaactgcaccaatgtgcatctgagatcaggtcattggcgttgaaatcgtgaaatgctcactgcttgggacgtttgcactgtgcttgatgtctggaggttccgttaatgttaaaatagcaattatgggactggagattaggtttaatgtctgggttttttccactgtcttcaaaagcccgggtcttagtagtaaccatgctgctccccattttagtaatttcagcctggtttatgttgctcaatagcagaaaagcggttcagatttcctttggatatcatggaccatatgtttgcccaggtatcctttcttattgggaactatcaaatagttaacacagatttctccaagggcaccgactgggaaattagtttaccaaagataaatttggtaaaaggaaagtttttatgtgcgctatccttaaactaagacacatctgtcgaaatattaggacgtgcccagtctcccatcctctgctgaaactttagactgtacgtccttcagatatcttctctttggtgctttgtttgggaacagattagcctcatacttcctcgcttgtaaaactgctatcccatctcttgctcaatgcttttcttgtaccgaagggtgagggggaggttccagctctgttttctgtatcagtttcctgggtgatgtttgtttgagggtgccttgtgtccagagccccagaaggtgtttccgttctctgatgagcctgaagtctgcatgcttcgcctttggtagggaaaggcagctggggaaaggttgcatggcccagtgccagggtgccagagtgcgtgtgcacctgctggggagaagcccgctggggcccctcctctcagcacaagatgaggcctcagggcagtgcagcagatggagggcttagctgtccttgccagcaaaagctgctgggaacgtggcactcagataacaggacggttgagaagcggtgagttagggttactctgatggggagatactgagaggaggggatgacaatcttgatttctgttccctttgtgaatcttttggtggccaaaatgaggaaaaggatacattgtgtttgaggacaacaaggaacatctaggcacattgcatacttgattaaatgcacaaagagcttcttgtgacctttatcacaagagtgtggttctatgaaggtcgtaggtacaatagaaattgtgttggtctgagagttactcagattagggtgcattgtgtcaccaccattttgcatagctgtggcaccttgtcaagttaaccttttcctgcttgcttttcctaatcagaagaatgaagttgaccgtatgtactctataaggtggttgtgtgaggtcaatgagattacataggcaaaatcttggtgcaggggcacttggtaaaggttagtttctgttataaatttggggtattctgtgatgattcctactcccctcttctcctcatggctaagttctacttattctttgacgtggctccgatatcactttcctcaggaagcccggtttcccacccagatggctttgggctactcatcagtgttctgtaaaatgctgagaatattgtttatagcacttctgggttgttttgtgatagtcttttgagatatctgtctcctcaccaaactgttctttgtgtcatgggcaggcccacgtcatcctcgtctttgtagtcctgcacctggcacagagcctggcacatagctcagtcaaacaggtgaagactgggttattacatcttcccactccacccccttcattatcaagtcgtggtcagggcatgccccaccaaatgcaaaccctactaggcagtacagctgagacttggaactagactaacccagtgactcagaaatgtgccacaggacttatttggctctagatggggtcttaaaagacattcatagttgcaggcagaacagaatatccagaacaggtgcagaataacctgtgtgtacacagtaggtggtagttataatgcaggaagaatttggcacaagaagtgttacagtttaaaatgaagtcatgggccctatccacactggggacagagataatagtaactaatcatcatcactgtcatcactagcccattgtcagaggtagcactgaacacttatgcgttagccaggatttgggttctagagggtttagtgtactagttgggttaccaagacaaagatgcaggcatggggtgcaagttaacaaaggttatacactaggtggcaactgactcacaggagcctggttattgcagcggttgtggccagagccatacaagtgttctgatgcccctcaactgtgttgaaatttgtttgaggccaaccaagtcagctggcgagggggaaggcaagccagagagaaattgtgaaccagaaaggccccacctctggcagtggctcttccattggagatgaagtcttcttgccctgtttttctctttaaaaaagtgagccatttcacaagggaagttaaattaaaaactgtgcttgttagcgcggagctgggacaaccgagggaagtgatgccaaaggcaattgttggtctttccttcaaatatgtgctgacttaggaagagcaaaatgttttatattaacaattaacaaaagactaagtctttcatcacaaacaagtctaaattcagtggttaggtcagtattatattttcctatagttttaaataagatgcttatgtattcactagtgctttggatgttctttggaaaaatctccaatttagtgacaagccccaggaaatattactcttagttggtccagcatcctatattgtttgtgaaatccctcttttattgtcttttaaaggttgtaaaatgctttttctgtcaataatcagagaaggatgccgcattcatattaccccagtttccaactcaacctctcctttccaattgaaaacaaaagtcagaattcactttttgttgtggggcattaagtagtaagcaaagagatttcactcgccagggaaaagaaggagcctgcaaatcagacaatatcaaaacataaccaaaccatataaaaacacaaaaatgttgcttggcagaatttaactataattaattgtactaatttaatattgtagacacaaatgatcataaagccatatggtacaatccttttgttcatgaatttcttattcatcaaatgttaggtacgtgatgtgggaaagccagtatgttgggcttcgtgctaccagggctagagttgaccagttcagctttgtttctccagtgaccaaaaaaaaaaaaaggtatctgccttgcacatgaaaacactggatggttagattggatttagccaacaacaaactgcaaaaatcggttctggctaactgaagctcacagggtttattagagttgttggagcccatgggaactgatggagggcaaggaggcttgtcgtgcaggagcagcaggaaccaaggaagctttgcagagatgagaaacaaaaaacagggaacacagcaacatttgctgtgtcaggaacgactgccactggtggcctggacaccatcacagccgcagaagatacttaagacacatttctgttctagtgttggtagttcaagattcaaagtatgtgtgaaagtgagtgtgtgtgcataggcagagtagctaattggttgagttggggtccatgtgcccacctccaggttggaccaggggacaagccatgcagcgttttggtcacccctcacttggcagtattcccaccaggaatgaccctcgctaggatttgaggggcctggagtcactacttactaattttcttaaagttgacaacgatcacaaacttcatggtctgggaaaatgtgaattaattgcctgatccaccttcatatcttttttcttttcttttttctttttttttttttttaacaaaaatctgtatattcatagattgtctcttcctctgctagtggttttgcagtagcattttcaggtgaggaaacaacaacagagtttagggtccagctctgtcattgccattgttgtagcgatttacaagttgttactgctagtatgaacttttgcctagttaaattttggaaacttgcctgtaattgcatttgatggatgataaaaattgataaatgacttgataagtgataaaaattctacggaagaattttccatggactggcttctggctttgatcctttccaactgtgcttctcctaccctcaggccgcccctatcatgctgtgcttgtctggccccactcaccctgtcctgacactggatgatttatttccaaatgaattgctcctggaagccattccaacaccattacaaccggcggcaacacagctgtcttggatactcctggaccatatagatagatgtaaccacagcattccggtagctcccacttccccagcattttcttttagaatgggggcatcagagttgaaggaggtaactgtgggtagtgtgtcttgtctttggaaattttcatcatgacctgagcttgtgaacactctgccttggccccgcctcgcactttggaagagactggagcaggagcgggcagcgttgccttcgcagcatggtaacttctctcagcgctgtttgtaaagcagaatgggagaggaaactccccagagggaaactgggaccctgttaggtagggctagcaagaggtggttaaaacgtaagcatccgctgcaccagactgtattctccacgactgtatattttttgttgttcataagagccccgaattgcaatgagtacgattttccctggacgctgcagtgtatggagaagctgtcacttgtcacatgacagctcagtcattcgatccctgggtgctgcagagagggaagaattggcctcgcagtggggagtgagtgccagcccgtggcctgtcccctgccacgtgtcaccatactgaacgtttgtgtgtgctctgtgtgttttcaaaacaccttcatgtcacctgccccggactcctccctgtgagcaaggcagggtgggcgttaccatccctctggaccaacaaggacagaacagcttgagacgcacagggtggcttccccatggctgcggaggcatagaaagtgagggcacgggacgtgaatccgtgtgctgggattctggccgcctgtgcctgccgatcaccctcagtgcctccctggatttgattttgtggctcttctgggtgtgcgtgtgagtgtgttgtgggtaagtctgttgtctaggggaaggaacgggaaatcatccggccaggaatctctgtggggtggtcggcttgagttggccatatccaagctctgcgtgtgtctcacttttcagagtagcaggaaggccgggtgactttgaaatcagatgggtattttcctgattcgaagagacttggcttcttcccccgcccctccttctccctcctcccccctcctccctcttgctggctcacaaactcaatggggcatcccagcccacccatgggaggccaggagaaagaggaggcagagctgtcagagtgtggcccttcgtcttgggggtgtgcaagtgaccgctcctgccccttgatggctctcctgtttcgggtataagggatgttgtccaaaccatgtgtgggactctctgttgacagttgtttttaaattgcctgtttaattgagcttctctaaagtcttctttgtgccaagtatcgggacaggtgatagaaatagaaaattcgacacaaatcgaaaattccagtatcaaaaatgacagcgatgtacccttgccccttaacgcagccaagaaacaggggtgaagggctactctccacatatggagcaggccaccacccttgagtgacagtagccgaacacagaacattctctgcagatgtcactgaggcttaaactcattatgttttaaagggataatctgctattcttaagaaaacaaaaaacaatcacaaatctccctgccctccccacccctgcccccacttagatcctggtagggtctggcagggggagttttgcaaggagttggggcaaattactccagcagatacttccaccccgtatcccaagaaatgtgtgtaaatgctgttatgaattaatttaaaggtattccaaactcctactaattattatgtgtttgctcaagtcaagatcaggagaagtacaggcattgctatcccatggggcctgtgaaactctggtgaggtgtcctagtggaagagcttggggccccatggtgtctggaaagcgggctccactggagattctggctgttttcagcttgatgcacacggggtcccctggagaatgccaggcctgcctgagtgtgcagaggtgagggatcctcacactgcccagcatgtacgtggctgggagactccagagagacatgcaaaagtgctgttaactagacggcgtggtacaaatgcaaagtgagtgggtttttttttttccttaaacgacagtgaacattcatttcaatatttattttgcttattttaatattttactcaatgtttatttatttttatgtttttgagacagagtttcactcttgttgcccaggctgaagtgcaatggtgcgatctctgctcactgcaacctacgcctcccgagttcaagcgattctcctgcctctgcctcccgagtagctgggattataggcatgcaccaccacgcccagctaatttttttgtaattttttgtacagacagggtttctccgtgttggtcaggctggtcttgaacccttgacctcaggtgatccacctgccttgacctcccaaagtgctggaattacaggcgtgagccactgcacccagcctcaatatttatttcaatacagaaacggacttaattgggtattttgttgaaggcaaatagtagcaaagtgggactggtgtgaggcagtggaataacttagtgaaatccaaggtttatgtagttattttccccccacttttttttttttttttttttttttgaaatggagtctcactctcttgcccaggctgcaatgcagtggcatgagatcagctcactgcaacctctgcctcctgggttcaagcaattctcctgcctcagcctcctgagtagctgggattacaggtacccgccaccacgcccagctaatttttgtatttttagtagagatggggtttcgccatgctggccaggctggtccccccatttttatggtttgaaaattttcaaaccctggctgggtgtggtggctcatgcctataatcccagcactttgcggggctgaggcagaaggatcatttgaagccaggagttcgagaccagtctggacaaatagcaaaatcccatctctgcaaaaaataaaaaaatgaaaaattagccaggtgtggtggtgcacatctgtagtcctactgcttgagaggctgaggtgggaggattgcttgagcccaggagttcaaggcttgtgagccttgattgcgccactgcactccatcctgggtgacaaagcaaaactccatctcaagaaaaaaaaaaaaattcaaaccctcagaaaagcttaaagaatagattcatggatcgttaaacatttttaccaaatgtatgttttctctcattactctaaggttgctccctttcccccctcactctcctcttctccttcccttcactccatggatgtgtaggacattctcctacaaaaccatagtacttacattcttgaggttgtcacacctcataattaaacatatgatggttttattaagtatgctgtcacatgtaaatttctccagttgtttgatccaagttgtactcatggatagtgtattgtattttacgtctctttagtcttctgtattgtagaggagtcccccaaccttcttctatgacataggagtttggggatttgtctgtttcccgatgtgattagagtgatgttgaacagttttggcaggaacgctgcacagctgatgattatatttcccattgcatcccctcaggaactcagaatctccttctccatccttggtgaaggtgtattcaccagatggctccctgttgaagctcccttctctctgttaccaatgagtaatctgtgctatgatacagtgagatggtgtgattattctgttcctcacagtggttttcctttggtggttttagcatccactgattaccataaattaattagtccagctttggcaaactatggcttgccgtggtgactcacgcctgtaataccaacactttgggaggccgaggcgggcggatcacaaggtcaggagatcgagacccatcctggctaacacagtgaaaccccatttctactaaaagtacaaaaaattagctgggcgtggtggcgggcgcctgtagtcccagctactggggaggctaaggcaggacagtagcctgaacccgggaggcggagcttgcagggagtcgagattgcaccactgcactccagcctgggtgacagagcaagactccgtctcagaaaaaacaaacaaacaaaaaaacccccaaaaaactccaccaagtctgtttacttatgtgttgtctgttaacagttgcttttgcactacaacagcagaattgagttgggacagagaccagatagccaaaaatattttctatttagctgaatcttgatctagtacatttttggtcaaaaaatgatgcatttctaattcttctattcatttttcatttagtagttggcattcttaaagaagagctttctgttttgacctttaaaaatcactatggattcatttattcttaatttttttttttttttttttttttttttttttttgagacggagtctcgctctgtcgcccaggctggagtgcagtggcgcgatctcggctcactgcaagctccgcctcctgggttcacaccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgggccaccgcgcccggccttattcttaatttttaaaagtgtgttatacgttgttgtcattacattattcttttagatacacaatgttgccctaaatttgcccagtgggaacccctccaggctgggcactgtgttcttctgtcacgcccccttcaggatggggcctgggttcttttgttatgctcctctaaggccctttaatctatgtcgtttcatttttttgttgttgtttttattttgagacagggtctcactctatcacctaggctggagtgcaatggcgcgatctcgactcactgcaacctccacctcctgggttcaagccattctcctgcctcagcctcccaagtagctgggactacagatgtgtgctaccacgcccagctaatttttgtatttttggtagagacagggtttcaccatgttggccaggctggtctcaaactcttgacctcaagttctccacccgccttggcctcccaaagtgctgggattactagcatgaaccactgcgcctagcctcgtatctgtgtcctttctttctgggaccggaagaggtttcaggttcccagtggaaattccctgcccctcaccttgaatcagcctttggccaaagagccttggagaatgatatttaatatttaaaaaccaggaactgagaactgagtgtgctcattgctatggggatatcattgctcctgggctccttgggtgcagagacccagggaaatagatgtttctgtgtatgctttcacactgtccctccctctcaagcccaactccacaggatgcttcctcaccttcctcttgccatctagtatcacgcttctgtagtgagaatctgctgcctacagcaacaacatattgacacatccattctcttctataggacacaaaaaaaggtttcagaaatttttacgttggtgctgccaccaccaccgctaccaaagcaatgaaataaagttcaagattccttgagattctcttgtcgttaggatgtatctcactgtgggtgtacagacaatatacaaaagttacttaatttttctccgatgtttatagtaccaatttgataatgtaagttaaattattcatctttattgaattttaagatatgcatattttatcctctttgagttaagtatttttcaaatatagaaaacgtttacgtggtccaaagtcaaaactctgttaataggtttgctcagagttctcagctcccatccttatcccaccaccccatttttactcacctcttcagttcattgccattactttttgccttatcttttttgtgtgtttctttttgcatctacttagtgcttttaagccccccatttaaaggcctaatgctaagtcttacatgtaaaccagcaaaaatgtcacctttttaagtagacttttgtgaccaaaaccttattatcaaagcgtgaaagttgagaccgtctagggagttttcatcatggtggttagacagtgtgtggaattgaaatgtacagcgtttgtacatgcaggtccgttattgagagaactgatccaaaaccgtgacgactgccaataaaatgtactttaccaaatatctgctcaaaatgcccatgtctccttaatgtcaatacccaacacatgggtacatccagttttagtctcaaatgttttaagatttattaagcttggtttgcaggagtttagtgttcttggaattagaaggatttctctagtgatgtggtgagaagagataaacctgggaccttttgtgttttcttgatacgcacatttatgttgtgtgcaacacaggaattgtcaggaacctgcaatgcaatctttcttgatttataatcttgcaaaatgtggaataaaaagtaaagtgcaaagtttaagtggtaagtgttacaattcatgtgaacaatatgatgctttttctcatgcttacttgaagacagcagctggcccttgagttcagtctcagtgcaaacagcctccaaagaaagtgcattgcactaaggaagcccttttcatctcacaaagggcaaagtctggattgcccccctttctctgttgtctttgcctgttgctccctggaccccagccagtctccccaggcctggagctgggtcagctaggtctgtggccaggaggtgggggtccacgtccactgtgctcctcagcggcaggttctgcaaactgcagcccgtggggcagactccacctccagcctgagtgaggccatccagctaagaatggctttgacatttttaaatggccagggtgaaaaaactaaaagaggattttgtcatgacacatgaaaatgatataaaatgaaagtgtcaactgtcatacattttgatttttgtcagtttcagagaaatttattttctctttttattaaatgtcactacataatatacttgattttgcctttctgctcactgaagctaaaatatttactctctggccctttccggaaagagtccgccgaccccctctctgtggaatgagagcttccaaaaagatgcagaagaccgtgcatcccaagcggttgtaaaagccacttactttcgtaggtttaatgactcaaaagaaagggcgcttgttccctcccttccttcctgggcaggcccctttttggaatggagtttcgttatacagaaagttgttctcgctgtacagaattctgcgatgccttcacttgatggctgtttcttcggggataggagggctgggggtcaggatctgatctcacacgaatggttcagagtctggacttagtagctcagagcagttcactgatttgggatctctggaagaaaagggtactgagtcactggcaccttctgctcagctcctgacagcagtgtaaaggatgctttcgtgacacccagccttcagcccaggaggatggtggcagatcagacagctctggaaatgcagggcacaatgcgcagagggttgcaccacaacagcagtcactcggtgcccgcctggagcactgctctcatttccagagtccctgtatttctgatcttggctgctttaaaaaggaggtgtgggcctgggatcccagaagtattcctctgtgattctgtaccacagctttaccttaattgggggtgtagggggtggggagaaagaggaagacagatgaaagcagggaaatccttcttggagtcatagttaaaaggataaaataagagctttagtgtagcctccgtttccagcaatccattttattctttgtccacaaactgaatgaaaataagcagtcattcaaaaatgatatttacgtaacctacaaaaatctcaatcaaccaaggaaaaggtggaatggggcttaatacaatacagggctgtctccggagttccctcccttgatttcaggcttttggtgtaaagctcccgaaagaaagcaactttgatttttattagactcttcaaaatcatctcggtagaatattgaccttttttgtgtgtggaaaaatgacttctacgaattctcttgtaggagtgtacattttggtcattttttggaatgtaggaaaaaaaatgtggggtaccctttattgcattttcaagaccttccaaagaagataattctgattgtaactcattataatctgggaaagtagattgttctggtttcaaggactgcgtgtgctttaaataatcacaggctgctctcagacttgggaacttttggtagaatacagcagtgattctcaaccagggcagttgtgttccttgggggacatttggcagcgtctggagacatttttggttgtcacgttttggggaaatgggtggtgctcctggcatctaatgggtagaggcccaggatgctgccaaacatcctacagtgtgcaggacagcccccccccaaccaagaatgatttagccccagatgttcatagcgccagaggtggaggaactgcctcgggggatgtgtaggagctttactttatgggttttttaatggaaaatatatgtatagacacgtacatatatatacgtgtacatacacatgtagatgactctgctcagcgcacccatgaagtatgcagtgcacctgtcccctgggatctggttatacgatgggtgtccagcctgtgcccaggggatcagtttcctttgtgctgctgcagtaccttgtcagcatggagagggggaggtcagttatgaggaggcccttttggggtagagtggaggaatggtgccgcctggtcaaggcctcgcatggggtagtgttctttgtacagttctaggtgaggcggcgaacacgttctcatgcattcttcatggtggtggtgatgctgatgttaagaccaacgggcctctgttgttctgctcaaggttccaagtagagtaggttttctattttcaaaatgtagttcacggtgtcccaatttttagtgcagcgtatttcaacaaaatgtccttttacacatataaatggcttatgttgcaaggtccccctcagcttcctggtgtggaatcagtgatggataaaggcagagaggctctcaggctgacatatactccctatgaagaggggggaagaactgtgttggcccatgggtgtttggggaaacacttgtattccaaggtatttgtggagaagatatgggatgtttttccatgttgggcttcggatatgaagtttaaggaaggagaatggagtcctggtgcacacctctcataagcacacgcacgctggccactctgctggctccagagtcatccagagcatcgagcatagtttctcccccggagaccctccaatctgatcagatagggaggctgtgagtctggtgacccccactgcagggggcagagctagtgcaggtggtgctgagctgactgggagaagaagggcctgcaggaccggctgcaaagcccttaggggagggaggaagtgaggaatttggtttcctaaacgggtggtccaagagaggccgggttcatcgctgtgcagtgaggtggcactggaaggagggagtcctcagatgggccaccctttggggctataagtctcgtggtttgtttctcttggcttcaagataacatatctagtttgggtgttttgggatgatgaggttggggtgtttgggaattgaggtggccgcgtaggcattgaggaagatactggtgttttgtgcggtcaaagggcaatggtgtggaactcagatcccagctctgaccctgtgtggtcttgggggatcatccaccatcagtctatttctctgtgacttggggataacagtacatgtgagcgtgaaataagagtataaattgcatcaatgtctgtgtgtcaaggttgcctgaggaggagttggctgggcttgcactgacgcttgattctttgtatcactccgacttaaaccacgacacttccaaggcagagtctaaagcctgtcctctcacaatcttctacaggtgagtaggaggccatagaccttgtgagtacagagtcctaaaagaaggcagaaatgtgtgaatctgccaaaagtaaagaaagggtgttactactggtcaaagtcgttgcaagaatgctggcttttacaactcctgtttctgctgctatcacctgctgcctgtgtcttgtttcctgggctccagatcattttcacatttctcaaaatggtccttggtagctgtggtagatggaataatggccctcaaggtgtatctccatcctaatcctggaacctgtgaataggtcattctacatagcaaagtggactttgtggacgtggtttaaggatctcaaggcctggtgccaggggctcatgcctgtaatcccagcacttgaggaggctgaggtggaagggttatttgagcccaggagttcaaggccagcctgggcaacagagagagaccctgtctctagaaaaaaactaaaaattagctgggcatggtggcacgtgcctgtagtcccagctactcaggatgctgaggtgggaggattactgaagtccaggaggtttaggctgtagtgagccatgttggcgccactgcactccagcctgggcaacagagcaagacactgtcccagaaaaaaaaacaaaaacaaaaggatatcgagatgaggttggggaggttgtctgggtgggcccagagcaatcacagaggtgcttctgagtggaatagggaagctgggggaacagaatcccagaggagataggaggatgggcgcagaggccccagtgatgtgggcccatgagccaagggatgctggcggcctctagaagctggacaaggcaaggaatcgaattctcccctgaagcctttaaaaaaggacacagccctgtgacccattttagacattgcacatcgagaacctaagagagtgtgtctgtgttgcttatggtagccgagctggagattctttgtgacagcagcaacaggaaacgcagacagtgggtgagcaccagatggtagagtcaagtttaatatgctggagcaaggagggtcagctaatcactggcaaaagatcagggcctgggacttttgctaactgtttctatggattcctccttcctcttgcaatgagaagcgacagcctcgtggtgaaatttgttagctgtttattattttcattgatctgattctactagtgtgatttatgctaagcataaatgaccaaagttgactgtggttttttgaagaacattggaaaataaacgtacaaaattatgtttttataataatggttcagtccaaaataaaggaatatattcatagaaattagctaaaattatagagggtaagttacatacatcttcttcttaaagatgctggtaccaacactggaagaagctgtacaagtgggcaggttgttttttgtttttgagactaggtgtcactgtcacctcaacctccccaagctcaggcgatcctcccacctcagcctcctgagtagccgtgactacaggtgtgcacctccacatctggctaatttttgtattttttgtagagatggactttcaccatgttgtccagactggtcttaaattcctgggttcaagtgatccagatgccttggcctcccaaagtgctgggattaggggcatgagctacggtgcccagtctcaatttttaaaaatatattttaccatcactttccaagctttttgtcctatgtgacaacagaaaattgaatttcttaatccacttacattgaatttaaaatccacttaggaaagtgagcttcaggtattagaattattaactccgaataagcagatactctagcatattttatcttccagattgtgttgtgattgtaacaagacacattttatgcattttagttttcatcacaaactggctgaaaatcatgttatgtacaaatatgacttgattcaatacaatttattgtttgggtataatttgaattagaaagccatttgtataccttttgctcacttacattatgctattatgcttttgacatcagaggaaatacacttacttaaaatcctcgcagatcccagagcaaatgaagagtttttgttcttttaaaaattggaagtagtctagttttctggttgtacagtaacaatgtgatatatattgtctttatcatatatacacacatacataaatcatctttccttcaaagatctcagatcacttttttaaaaaacagctttactgagatataatttacataccataaaattcccctattgtaaatgtacaggttcagtgaattttagtaaatttacagagttgtacagacatcgagacagcacaattttagaacattgtcatcactccaggaagcgtccctgtaaccattagcagtcacgtcctccccagcccctggcggccactgatctattttatgtctctggatttgcatattctggacattagatataaatccaatcatataacctgtggtcttttatgtctggcctcgttcatttagttttcaaggttcatccatgtcatagcatggattgatccttcactttttattttattttgtgttttttagaaacagggtcttgctctgttgcccgggctggaatgtagtggtaggatcatagctcggtgcagcctcaaacgtctgggctcaatcagtcctcccacctcagcctcccaaatagctgggactacaggcagacaacaccacgcctggctaatttgtttttagttttgtagagagagtgtcttgttatgttgcctaggctggtcttttgaattcctgggctcaagcgatcctcctgtttcagcctcccaaagccttgggattacaagtttaaaccaccacacctggcctgttttttattgttagataatattccattgttataaatatcccacatttttagattgattcatcagtttatggacatttggttgctcccatgttttttgctgttataaataaagctgctgtgagccctcgtgtacaggtgtttacatgcacatatgcttttattcctctggggtagatttctaggagtggagttgctgagtcatatggcaatgctatgtttaactttttgaggaactgccaagctgctttctatagtggctgcagcatttcacattcccacccaaatgtatgagggttccagtttctctatatcctcgccaacacttgttattctctctcagagaactttctgaatctctcttataatgcctagggggttccttgttgaagatgaaattagggactaccatgaactgctttaggaaacctgggagaaaggagtcaggcccctttttcatatctatgcagtgtaaccggcctctcagaaagattggttggagtggatgggagaataaagaaatgaatgggttgggtgcagtagcttacacttggaatcccagcactttgggaggctgaggtgggaggatcacttgatcccaggagtttgagatcagcctgggcaacatggcaaaacctcatctccacaaaaaaatacaaaaattagctgggcatggtggcacacacctgtggtcccagctacttgggaggctgaggtgggaggattatttgagcccaggagttagaggctgcagtgagctatgattgtgccactgtattccagcctaggtgccagtgagactgtgtctaaacaaaaaaaaaacaaaacaaaacaaaaaaaacagtacaaagtgttcagtgccgtcagatgttctgaatatagtatgatgagaatgcagtggtgggggagaaggtggattagtttctgtggctgctgtaacaaactaccacaaacctagatgcttaaaactacacacatttactatcttaacagttctgggctgggtatggtagctcatgcctgtcatctgaacactttgggaggctgaggtgcaagaattgcttcagctcaggagttcgagaccagcctgggcaacatggcaagaccctgtctctctctaaaaaaaaaaaagccaggcatggtggtccacacctgtagtcccagctacttggaggctgaggtgggaggatcacttgagtccaggaggtcaagactgcagtgagccatgcgagtgctccagcctggatgacagaacaaaatcttgtctctataaaaagaaactggaaaaaaaaaaaagtagttctagaggtcataagttccaaatgggtcttattctgctaaaatcgaggcatctacagggtggtggtatttgctgaaggctcgagggttaagtttctggttttttgttttgttttgtgttttttgtttttgtttttgttttttttttgctttctcagtttctagaggctgcccatattccttagctcatggccccttcctccatctttaaagccagcactgcttgttcgagtctttttcacattgcatttcccctttcacattgaaagcactcttctgatgaaccacttctgttaaaaccactcttatgatccaagataatttacttttttaaaagatgaactgattagcagcctgaattccacctgtagccttcattcctccctgccatgcaacttaagttgttcatggtttctgggaatcaggatgtggacaccttgggtggggatggaccttaactctggctgccaccaatggcgcctggtcaaagtatcctgtaggatttattcttggaaacggcgttaaccccaacgccctactttgctggctgtgtaagaaacacgaggtcagtcaggcagtaagaggagcatggacttgttttctgaaacagcgacacaatccattacatattttcgaatgacgagatgagatcagacttctgctttaggaagagtcacagggttttgtggatttgcaggggaaacaggcggtcagagggagttctgtgtcaccgtccagaggctggggtgccaaggagggcagtggcagtgggcttgaagagatgcaatggggctgctttggggctgaggcgactggactggcgtctgattgatggaataccaggagagggatgggagagggaaagagatgagtccaggatgacagttggaaagtcctggacttcggagtaaagggtagcgattgaggagttaaagggtagaatcaggctggggagagcaaatttacttttgaaatagtgacctttggatgctggacagggagatatgaagcaggcagaggaaatatgggcatgaaatagagcttcagcattttctacaaagaagccaccacattcggtgacatgacaagggagtgatgccagagggaagagaggtacaagggcagaatgctggggaaatgcctgtgtttaatgggcgtggagaacccgcttaataaataatgagaatatattgctggactgaaacaaaagtcctcattagctcattaaatgtttcctggaattcccagtcaaatctgtgaaacaattttaatgctagatgttttgtaagtatttctccggaaatctggaaatttgtccacagacccccagacattgtttataaactgaagtcagttgactcaagtattttgcaaatgtctatggaccctagtgtgattaatagaaacacaaattattttaaaggtgtcactcaatttacagtcattctgtatttttgccatttggtattttttcctgaaacattacataataagaatgcagcatgctttctttatgtaggtgatctgtgaaactttttgacaattaaaaattggtttttggccaggcacagtggctcacacctgtaatcccagcacttcgggaggccgaggagggcagatcacccaaggtcaggagttagagactagcctggccaacatggcgaaaccctgcctctactaaaaatacaaaattagccgggcgtagtggtgcacacctgtaatcccagctacttgggaaggtgaggcaggagaattgcttgaacctgggaggtgcaggctgcagtgagccgagatcttgccgttgcactccagcctgggcaacaagagcgaaactccatctcaaaaaaaaaaggaaggaaaaaaaaatatatatatatatgtatataaaaattggtttttgctgtttgttgcggcatcacttgcagttacaaagaagtgaacatagtggttacagattgggttgtaaggctggacctggccgtatgatgggttactaggcacctgttaaaaatagtactgtggaagtggtatatttattggcatgtccatgtgtttacaatatattacaatggtgttactgtaatccccaggagaccagcagcccagctgggactctgagagctctaagatacgtccttggagtaaaccaagctgcaaggaggtctgttcacttctgtattgtttatccactcataaatttgatttacatagctggactttggtgttgtacagttatctcataatgagggttattttaagaagtgtctcaaggaaatgtgtcgtgtgtttactgaggatagcgttgtatgtagtccacaatttcctctttctgggagaaattttgcacatgtatcagaagtctaggagctgtgtttctgatatttgcatcttctttattgtttagatactgtgaatccagcatctaactatagttccttctttgaggtctaggaaacttggaattggattgacaattcccttccaagtgatttcaggttgtatccgactgcgaactttggataccgccttcctgtctcagcttcgtctcctttgtcctaccatgatcttctcttggccccagtttacccagtgaattactttatttttgctattttgtatgtgtttttggaagccacccccagttttttctcttcttttcctgggtggggagttagaagtgttgcagtggatgatggtgctgtggctttttggaggttggtttgcagtagcttttgagttctggtgtgttagtgtcatcttattctaatctagctgcttcctgttgaagtacatcaagacgaagtatatttctaaatttattacgatgaatactctatcaaaagcagctggtgcttaggccctaggtagagctttaagataaagttctttaatatcaatttagaaaaagaaagattcataatgattaatggagctcctgcatcactgaattttactggaataaaaaaaattagtgggcttaaagttacattgaatgtagtggaaattctttttcttatctccattactgttggggaacaatttcatctaaaccccattgaaaactgggccttatagccttcagtatacttcataacatttgttggaaagcaggaaatgaaaacgaagtatttgaagtaaaagttcttaaatgtgtcccaagaaatgaggattactgcagaaagaatggatcagttatttctcgaattataagaaggaaatatctgcagccttttttgtcatcagtgcagcagccccggtttttctgttaatcatagctggtaataatgccctccggtttatagttttgatgagccgggagctaggctgcgtgttttacatataatatctctgttccatcagctgcataacctagatatccttcaccccatttttatgagactcatgggttcttgtctgggaccatgcacctagtaactgacaagattgcaaactagttatgtcacctgtggagttccacgacaaaggcaattctaggcgatgtttatgtagtgttccttgcatgccagggggattctgtgctctttccatgtgtgaatgatagcatccacctgctaactttgttgggagggttcagttatcctctctgtacaggtgagaacaggaggtactgaggacatctggcccaaggatactaccgctggcacggggtggatggtgattcgccctcagtccctctggcgcagcatctgtgctgtttgctgccaggccagctgcatcccagatagagtgacaggatctgttcgcgtcacatccagaaaaggctctgaggccaagctccctgcgttgcttctcactttcactctggaatcagaggtgcgtgcctggaggacttagctctgcatggacagctggtaaggtgtcacagagggtgaggtgggccattgtagcagagagttgttaagagttggttacgtgggttttctcacagggtacaaggctgaggaatgggaaaccagttaggagaccttgctaatagcgtggaccaaagatggggagtaggtccagacagattccgcagtgttcatgcagtgttcatgaagcaggtgtagacagattgcggggccattcatgaaggtgatttgccggggctttttacggatggaaaaccccttttctgtgttcatcccacctcctgttgtcgacagatgacacctgcacaatcaggtcctcccaactccttccaccacccaaagtgaaatacgcaagtcccagagaactgtgtcattcttaccgaagtggctgatgtaggatgttagaaacatctcccaccccaagttgtgacaacctgaaacatccccagacattgctaactgcctcttggagggggcacagtcacccgctgttgggaacacaggcctaaaagcttggagccagggctgactgtctgtgtaggctagaacagaattcccaatgacccatcaccatgacatctgacactcaaaccgcaccccaccccgaccccccacaaccaccaccttttaaaaatttccatttttggaaaaggctggggcttagaagtcattatgaaggcacccatttccagaagggtaagaatcagaaagttggctaattcgggtctctgctttacaggagttccgcagcgtctttcagtagagtgaagctccagtatttgtatgagtgttggggttgtttggtggtgtggggtaatgcaggaggagagaattggggaactgttaaccaccacccaaacaggctatagagaagaatgccaggggactttactgtgatggagacaggagcgttgaagtctgaagagtgacatctgggttctctgtacgttctgatttcttctgctaggatgagtatagaaacatgttctctggggtgaaagtgaagccttgtgaaattcatacaggtgaagctgctgatagcagctcttcccgatggcatgaatatggaggtggcggttgaagcaagtttggtttgtgaatagaaatatacgtgttcatatgtatgtgtgcacgtatgtgtttgtgcatgtgtatgctttaggacccagttcttggattagctgattatttttttccctctctatagacattggtgacctaggttttcagatacttatgtaagtgaatagttgaatttgtttgagcatatttaattgctttcctgaagggatttgctggctgttttgttaaatgaaattgaagacagtactgttgacctttccaggtgaggagggagtcagaagtgttttgcaaatgatggaaactgaaacgtgagtaccaggaccatatgatgttcagaaacttttatcataactacagtgaataaataaagtgcttgacaattagatttaaaattaagcttcatcctcattgcaaaatgtggagacagtgctttgggacatgaggaagagattaattaggattcttttctacctcaagatgcgctatgtcatctctgaacaaaaaactgattggtattacgtgaggattatcttcataaagttcagagttgtatctacggggacagatttgaattgctgttaattgacaatttgctgaattggaaagatcatattaccttaatactttaatgtatcatctttaaatgtgattctttttctttctctcactaaagattagtttcatgccactaaataaaatttaatcttttgctgtaatttaaataataataagtgcttacaaacatattatgcagctgatagcttgttaaaatttcctgtgggcttgttttttgtttagaagtactgattttgccagttgtacaagcatgaaatattgtttatcaagcctcataagacattaaagaggaaatcaagtttgtgtgactttaatgtctctttttctccttatttcagtggctcatacttttaccctgaacttgtaaaatctacaagcttaataagattccatattttataggaactaatggatattcaatgacttgcctgaagagtagactaagaaaatgtatttctccatgaatctttacatagaaaaatgaaagatttttcctgaatatttatttctcaatatatacagcattaatatgtctgtttttcttcaaagcagaaaaaaaaaaaatcagtgattgcctttgggttttgatcttgctctgtatttgttttaagtacacacctattacatgcccactgtattctaggcactaagctctaatgaaaagtggtttccagtcattcgaatggaacaggaggctcatgtactttgaagtgggtatacagaacttttgcactttggttttattctactttctgtctatgtccttggcactagaatgcttggacgacagtttgctatatctgtggtatttatggaatgagtgaaacatgcaaggagaatgccctggctgccgttctggcttctgccctacccagagcatccagtatacagaagcagcgtttcttaccacagcttgcggaaagacacggggagtagtcggcttgccatataaggaagttgccttcagtggccttgttcattttaggtgttttttaatacttgcttctcttataatacatgttactgttccgtgaggaacctcagcagctcccctaaggggaaaaaaggaggagtacttgaaggagtactgtttatacttcaggggcaataaaatccatgtttatgcacaaagggacctttccacttgtgtgataaccattctacaaggcccttgagttcctgtgaggaaggaaggacgccataaggaatgaaatcacagaaccttattatgaaaatagtaatggtgggatttggaaattatactcaattttttcttctgaaaacaaattgaataccacctgagagttggtgctaaaggccctgattttcgtattttaaaaaatttttggcatagtctttggatttgtgctgtcctaatatggtagccaccagctgtacatgagtatttaagcttaactaagattaagtaaaatgtaaaattcagtttgtctcacactagccacattttgagtgctcagtagccacatgtggccagtggataccttattagacaaggaagatgtagtgcagaaagttttattggacagaagaacaatggttattcagatatttccctattgggaattccagggaagaaagggaaaacttaaatctgaagaagaaaaattttataccaagggactagggggcaatgcagaaaaattaaccacatcaaaacaatttactacatcaaagttcattgtcatgacatattagaacattagcataaaggaagtatctatgcacttcccggatttaaaaaagagtcacacgaaggatcttggaatcagaatgacattgtatttcttaacagcaacacgtgaagttagaaaacagactgaacatagacttctttgaaaataattttccctcagaattttgaaggtgttcctccactaattattaattaaggatagaataaagatgtttgggccgggcgtggtggctcatgcctgtaatcccagcactttgggagtctaaggcaggtggatcacttgaggtcaggagttcaagaccagcctggccaacacggtgaaacctcgtctctactgaaaatactttcacatgtcacttctaggaaacttatggagaatatgtcccaccaaagtgagggagtaaaccaagaaagggggaggtttgggatcttggaaacagaaagaggcagaaggaattctcaaacaaaggtgttttcagggcagtggctcttgtagtacagactagagcaggagacaaattttaggaggaggccaggcgagatggctcactcctgtaatcccagcactttgggggggcccaggtggacagatcacaaggtcaagagattgagaccatcctggccaacatggtgaaacctcgtctctactaaaaatacaaaaattagctgggcgtggtggcgcgtgcctgttgtcccagctacttgggaggctgaggcaggagaatcgcttgaacccaggaggtggagcttgccgtgagccaagatcgcgccactgcactccagcctggtgacagagcaagactctgtctcaaaaaaaaaaaaagaaattttaggagaaagtttggtgttagtgtattggtcgaaggtgggagggatgtgggtgggtgttgcgggaggaagggcatggaactgacaaattatccaagagttttgatcatgtaaaaaatgtaatagattgttggagagtgtgggaaggattatcaaagagtacaaagaaaactgaaatgaaaacagaggcaaataataattctaggagaacacaaaaagtatactaaaaaaaaatcataggctgggtgcggtggctcacgcctgtaatcccagcactttgggaggccgaggcgggcgggtcacgaggtcaggagatcgagaccatcctggctaacacggtgaaaccccgtctctactaaaaatacaaaaaaaattagccgggcgtggtgttgggcacctgtagtcccagctactcgggaggctgaagcaggagaatggcgtgaacccgggaggtggagcttgcagtgagccaagatggcgccactgcactccagcctgggtggcagagcgagactccgtctcaaaaaaaaaaaaaaaaaaaaaatcataatcatactatattgcccactcagcagtgcccattccattgtcaaagtaatatatgtgaaatattgatttagctgaaaaaaaaagttatatgagctatcgaaaacgtggaagggtcagtgtaagattggtggtgggaatgtaaaaaaccaacaatccttacctatgtgtgtgaaaatcagtaagtgatatctaaacttgatgtattgattagagtatcacaaacagactatttagaaacatggaagtctggccaggcatggtggcttatgcctgtaattacaacacttcgggaggccgaagcgggaacgtcactagagccccggtgtttgagaccagcctgggcagcatagcgtgaccctttctctaccaaaaaatttaaagcattagccaggcatggtggtgtgctcctgtggtcccagccactggagaggctgagacaggaggatcacttgagtcctggaggtcaaggctgcagtgagtcgtgatggtgccactgcactccagcctgggtgacagtgagaccctgtcccaaaaacaaaaaacaaaaacaacaacaaaaaaacaaacttggaagtcactatgcagggaacagcaccaataacagaaacagctccaagaaagtggttgctttgggaagtggaattggtgatagatggtgctaaaaggcatgtaattaataaaaggagccttttgcctcacctgcattttaaaaaaaattttgtacatgtattactttgtaaagactaaaagtggtttggaaagtgaaagtataggatatactatctgtataattacagacattttggcatagttaaaagcagggtttcacaaccttggcattgattgacgtttgtgtcaaataattctctttgttaagaggacctgtcctgtgtgttgtgggatgttccgcagcatctctggcctccacccactggatgccagtggcattcctccgccagtcctgacaaataacagtatctctagacattgcccaatgtttcctgggggtcaaaattacctgtaagaaccacttgttttgaaggatttttaaatatgtcattgaataaacctcaatatataaccctgctgtttgatattggtaatacaggaaacaccagcttccttacacagaccttgaaccctggagcaaatgaagcggtttggaatcctctggcactggaacacccgcaatgctcatgctggtgcatgtattagtcagcgtctggctcttggcccggttaattcagagctcactaaaaacagaaaagggatcaggaggaaactgcagcttctctgtcatgcttagtggcttctgaaaacatattttagatttttcatgttgctttcatgatggtacaacttgaatttctctggagttgaaatgttaatcattatggcaaaaatattgcaccctttggatgcattccagtgctcaggtggctgcggacagatcctctctgtctctctgcttccctccacaattcttttgcaagttcttagttaagttattgtcaagtgtttttccctagaattgacacaggaagtcaacaggaaaatggtatctcagattttttgatgtggatgaaacctcataaatagtttaaaaccctcatttcacagctgaggaaactctggtgcagagagggttttttacaattaattgggagcacaatggggcctggaactctgttcttctgttttactctttccttttaaaatacaacatgtgtgcccagtaatgctggaggaggatgatagaacgggctggggaagggctagggcatctggcgggtcatgggagtttgtcaggattttcgcactgttagaagttctcagcatcctctgccaggggcgtgtacccttagtaagcttagagaaaatggcacagagaggcaggaagtgtagtttccatgatctttccaggaggtgctcctgtacctcagttcctgatggcccagaactgggtggagagtgtaggctggtgcattggcgtgtctgacagggaagaccctggcctccttatcttgcagctcttgctaccagggcactcatggagccagcgtgcaccgccactgcagctgttcttgaagaagtggccagaagagtgaaattggcccgttgaggaagggtgtggagctgcttctctgtgggtccctgcatgacttccctgttccttcccctgggatcaaccttcctcaccccacatggttcagcagatgagggttaagtctgccccagcttgggggacgctggtgtcccactcaaaccggttgtccagtattttggtgctgcaccaggagagtgccatctgcagtctgcagggctgtcttgcccaggtggccccttcttccctcggatggatggggcatactgttctgaccaccatgtctccttccaggccacatcctctttcgtgagcactgtgagggcatcaccccacatttttagaaacctcagcgccccatcttgcccccatcccttgcctttggcaccacttaaactacagcctcattctcttcctcctcgcctgagttctccagccaactcaagtgccacctcctccatgaagcccctgtaggtttcctccactgggacaaggacgcgcagagatgaaaggcagagaagtccagccctgggacttccaggccgtcagttcaatcctttgagcctctgtctcctcctctgtgcagtggggcagttcagtgctcccccttagtgctgtggcacgctgcgttgattggcctgggtgctgttgcggatgcccagcgagttctctgtctccctcctggttcttgtcccactccctgctccctgttacagcctggaagtggttggacggtttcccctgggagtcttgagaacccccaaagacgccatgcatcttcttgtcctcttttcgtggcatgttctgtgttgtgtgtgtgtgtctgtgcaacgtgctgtggcattatgtgtgtctgtgtttgtggcgtgttgtgttgcatgtgtctgtctgtactgtgtgtgttgtgtgtgttgtgtgtctctggcgggctgtgtatgttgtgtgtgtctgtgcacgtgctgtgcggcatgctgtgtatgttgtatatgtctctggtgggctgtgtatgttgtgtgtggctgtgtattttgtgtgtctgtgtggctatatgcggcgtgctgtgcatgtcgtgtctatctgcaccgtggtttgtgtgttgtgtctatctgcgtggtgtactgtgtgtgttgtgtctatctgtgcagtgtgtctgtgtggtgtgctctgtgtatgttgtgtctatctgtgcagtgtgctgtgtgtgtgtgtgtgtggtgtgctgtatgtctgtctgtgcaaggtgctatgtgtatgtcgtgtctgtgcagtgtgctgtgtgtgtgtctgatgtgctgtgtgtgttgtgtctatctgcagtgtgctgtgtgtgtgtctgtgttgtgtgctgtttgtgttgtctctatctgtgcagtgtgctgtgtgtatgtctgtctggtgtgctctctgtatgttgtgtctatctgtgcagtgtgctgtgcgtggctgtgtggtgtgctatgtgtgttgtgtccgtctgtgcaccttgctgtgcatgttgtctatctgtgcaccttgctgtttgtgttgtgtctctctgcacggtgcactgtgtgtgttgtgtctatctgtgcagtgtgctctgtgcggtgtgctgtgtgtgtgtctgtgcagtgtgctctttgtgtgtgtgtggtgtgctgtatgtgtgtgtctatctgtgctgtgtgtgtctggtgtgctgtgtgtgtgtctctgcagtgtactgtgtgtgtgtggagtgctgtgtgcgttgtgtctatctgcagtgtgctgtgtgtgtggtatgctatgtgtgttgtgtctatctgtgcagtgtactgtgtgtgtgtgatgtgctgtctttgtggtgtctgcagtgtgctgtgtgtgtgtggtgtgctgtgtgtgtgtctatctgtgcagtatctgtgcaatgtgttgtgtgtgtgtggtgtgctgtgtgtgttgtgtctatctgtgcagtgtgctgtgtgtgtgtgtgtggtgtgctgtgtgtgcacgtgtgtggtgtgctgtgtgtctgtgtggtgtactgtgtgtgtgtctatttgtgtaccgtgctgtgtgtgtgttacatgtcctgagctcacgccttctgttttcacatttgactgtgattactgtcctttttgagatctgagtaacagggacagggctgggcccgatgacttaggcctgtagtcccagcacttgaggatcatttgagcccaggagttggaggctgcagtgagctgtgatcgcgccactgcactccagcctaggtgacagagtgagaccctggctcaagaaacaagaccaaacgaaacaggaatgggtggccagttctgccacttcctttttatttgtgaaatctaagcacatacataatccaggtagttgtcacggaaaggggccataactcaagagaagtggtgccctggagcctaaaggctttcccattaggataaattagaactggaaattgtcataaagacaatgcagggtttgtggatttcagctggatgagtaaagaccagcctgggcgtgaaggattttcatagtcagttgctaaaggtggtgccccaggaaggctatttggcaggcgtggggcgcagtcctggcatggggtgggatggggctggaggtgctgctaatctatcttattaaaacccaggaagtttcacaggcgccttccaaaccacagctcgttgatttaaagatgtgaattccacgtgtgtaagccaacagaacaattgcgttttgtggtctctggctgatgaaaagtccctgatgaagtgctgtttggtaaaacgattcctctccattttcctcccttccaatctgtggttcacatttattcaacgttcttttctttcaaacagcatttgtgtgtagccaacacacatgcatatggagtgctgcgaagtctctgtgcattatctggaaacctgctttctccagaaaagctgactatccacttcccgtgctctcaagcccaagagacaggaatgggacgtggggagcgcgtaccctcttctcaacaagcaggttgaaaatccagtgaatttctttatgatggaatttgaatcacgtggacattcattagaatatttgggcaggattaagcccttaaaactggctctagattatggttataaaatggcctcaaaggaccctgaaactaatgaaagaattcttccatttctgacatgcttcactccctctggctctggctcttatcccaaatcaaagaatgttggtttttttagtgtttcctttataaacaaggatggtttccagattttttttttctttttgtttttttttttttttttgagatggagtcttgctctgtcacccaggctggagtgcagtggcgccatctcggctcactgcaagctctgccttctgggttcacaccattctcctgcctcagcctcccaagtagctgggactacaggcccccgccaccatgcccagctaattttttgtagttttagtagagacggggtttcaccatgtcagccaggatggtctagatctcctgacctcgtgatctgcccgcctcggcctcccaaagtgctcggattacaggcgtgagccaccgcgcccggcccaaagtgactcttatactccattataattatgaatttggaaaacaataaggatattatatgagtctgctcaggctgctgtaaccaaagaccacaggctgtgtggcttaaacaatagaaatttcttttctcacaattctggaggctggaagtccaagatcaaggtgccaggaaactcagtttctggggaggcctctcctcctggcttgcagatggccgccttcttgctgtgtcctcacacggcctttcctcggagcgtctgtgtatgggtggggtggaggggcaagcagagagcttgcacacttcgacaatatgaccatctatcataggcatcaatttagtttaacttcatttcatttacagggtgttaaaaaggaaaatcatctgcataatttgagctttttcatagtgagttctgaatctaatttattttgagttattacagaagtctgcggatatcccaccttaagatagccatatgcacaattagtcatttcttaagggatcccccaatgtgaaaagaattccccgagaaaagacgacctgaaagatcttggcctttacataagtgtacacagaattatttttattgtgataaaatatacataacataaaacttactatcttacacagtttaactgtacagtttagtggcattaagtacactcacgttactgtgcaggcatcatcaccatccttctctaggactttcccagctttccaagctgaaactctgtcctcattaaacatgagctttccattccttctctccccaccaaccacctggcacccactgttctactttctgtctctgtgaacttgatgactctggatacctcccgtaagtggaatcctacaggatttgtcccttttgtaactggcttatttcacttggtagaatgtcctcaagattcatctgtattgtagcatgtgacataatttccttcctttttaaagctgaataatattcccttgtgtgtatagaccacattttgtttatccattcatgcatcgatggacagttgggttgtttacaaggaattattttaaagccgaatccagggtggctggcttgtgactactatttagatgcagacagtgattccaggtggtgcgtggtgaaatcatgtcacacccccgcggaaaactccacagctttcctcatgtgccctttccatcacttctctgctgctttaggaactacttttcttctgaggtgacctctttctgttcctttcagtttttaaaggaaagaatagtagaagtattaaaagcagcagcagaagtccacatgttaaccctgtgccagcccacatccccttgtgatctctggcagtggggtctcttctgctagcttctcccgagcttcctgccaaaaccctgtagccggccttcgccatgtccctgaatttgcttttctttttccaccctctacaaccttcctttcctgcagaagtataaactttcaatccgtgtgtataaactttggggacacttcgcaatcagcatgatgaagttttatttttatgtgaaaactcttgatgattctgaaattgtggtgtctgtaacttaaacatcatctacaaaatcactgctctatctttggatgtgagtttgttctagcatgttatcacagtaccgaattccaaagaaactgctgtttacttaccaagggtaggctttcaactcagatgagtttatgactttatttacatggaatagtcaaaatggacttctgacatttgctgcaaagtaggacaacttaattgatattgatggatctactcatttattcagcagataacaaagcccttccgattgcaggtgttgtggagagagcaggatattcatttgctagggttgccataacaaagtttgatttgatttttggttggggatggaaactgtgtaggaggcaagcgtggagcttgatgtgagctccttgaaataatgaaaaaccagttacaaaatctgtattacctgtagcagtacacattctcccaaagcattctgttggcattttaaagtcctttaaaacacacagctgctttctgttgcttcaaactaaataaggcattatcttcacttttccttttgttaacctaaagaaaaaccttcatttgtaaagcaaatcatcacagcaggaggattttctggtttatgcactagggtgcatttaatctttattttacactgctgattaactttatgattcaaattttaacttatagtttctttttaaattaattacattattgggtgctttcatgtttttgctaaaagccttcctattagaagcactacaattgacagtgatggactgacctttaatatttttttgttatgtgaccagtgtttggtttataaaaatttttctctaaaacaccaacttttggctgcaaataccaccttttcacttgggttcttttcatagtgtttatttacatgggatattgtcactttgcacgctgtagctatttgtctttgtcagcaaatgtaggtaaaatattaatcttgtatgaaattcagataagcagggaacagatggatttatggtgcttgaaacctctgaactctgcagctgtggcaagttgttgaactgtaaataaattctggacggtggctagcaggggctggcgtgacctcatttgccccacaatacctcaccgtgccagggatgcatttcctgccctgtgccacctgtggtttggtcctagtgctttggggccgcagagtggagctgggctccctttgaggaagtcatcagtgctgagagccctcctcacgggtgagagtccagtgggatgtgtctgagcagcctacgctgggcatgggccggggcacgctgtgtcccaagcatgctttaggggtcccagtggcaaaagcacatttgtggttgtttaatctctggaggtggaggatagccccagctcctgggtcagtcagctggcggaacagggtaggccaggggagacagcactccaccctgctgggcatcttattaaatgcagcccagtatattcaatgccggcatcactacttcatgggaaaggatgcagcgcttacagcaggtagtggggtagagtggctgtgtggggattttcaaaatggaggctaaagtgatgcactttggactcgctggaaagtgcctggacctctggtgagttcagcctgggaggtcagagcaccacaaaatttgcttgctgtggctgggtgcagtggctcacatctgtagtcctagcaggagctcagtagtccaagctcaggagtccgagaccagcctgggcaacatcctgtctccaccaaaacaaaaccaaaaacaaaaccaaactggcttggtgtggtagtgtgtgcctgtagtcccagctactcaggaggctgaggcaggaggattgcttgagcctaagagttcgaggctacaagtgagccatgatcataccactgcacttgagcctgggtgacagagtgagaccctgtctcaaatgaaaaaaaaaaaaaaaaaaaaaaaaagtacttgttgcctggccacaggaaggtctgtgtgttggtttgtttaccttcccgaacctttgctggggagactttttatgcccccatatgccccagattcactaacaagaaggaagtgttctgttctgtgtaggatgtgcagaaacagccttgaaaatgttaccaatcaccgaccttctgaaacgagcttctgtggatactgggaaagcactgggacaccattcccctcactcctgcctctgcttccccagggtggaactggcctgtgcttgatggtgccagctgtcataaagaagtcattgagcatccctgcatttgcactgtgtacccagcaccatggagggatagccactttagccaaagcagtttttcagctttactgagatgtaatttacataccttcagactccctccgagggtgtttttttgtgtattcgcagagttgtgcaatcatcactatctgagtttagaacatgttcagtaccccatgcccactgtattagtctgttttcacgctgctataaggaactacctgagactgggtaatttataaagaaaagaggttgaattgactcccagttctgcatggctggggaggcctcaggaaacttgcagtcatggcagaaggcgaagaggaggcaagacacatcttaccacagcaaggcaggagagagagtgagaggggaagcgccatacttctaaaccattagatctcgtgagaactcactcgccatcacaagaacagcatgggggaaacccgcccccatgacccaatcacctccaccaggtccctcccctgacgtgtggggattacagttcgacatgagatttgggtggggattcagagccaaaccatatcacccatcagcagtcacttcccattcttccctccctgtcccaaccggtgcaaccagcaatttactttctgcccctatgcatttccctattctgacatttcaggtaaatactcacaacatagggacttttgtgttctcatttcactgagcattgtgttttcagggttcactcatgttgtcccctgtgtcggtgcttcgttccttttcatagccagattatactatctgttcatcagttggcgggcgtttgggctgcctccactgtttggcgattgtgaatagtgttgttgtgaacatttaagcacacgtttttgtgtggatgtatgcaaagtcattttttttgaaagccacttactacacgattggctaacttccatcagagaaatgttgtttggtggagttaaaaacagattatctgtgtactatattaagttgggtgaggaatgatgaagtgtaaattatacttacataaatattataatgctgtgcagaaactcttaagctatcattcttttagaaaatgaattttatgagcttgggacctttttgttaaccaatctgagaaaagtctgttgtcagtgtggacatattttacctttaaatggaggaggggagagaatctttcaaaaacattaatatcagtgagattaatactaatctgtcaagatgacccagtgaacagttggctatcaaagtattataagaaggtttttaaaaggaaagtgtctattttgtaaagatcttgagtaaattatgcttttaagtatgttttgatattcccccccctcctcccaaagtgtagcatgcctgagcgctgtcatgtttaggaggtgatgggttggggttagagggtgattgactgttagcgaagtgggttgggatgaacaagtgcacttgagtacgcgctgcacagtgtaggcatcaggccacgtcagtgtgtctctgcatttgggcagatgccaggcctattgcaggcagcataacatctaggaacgggtttatggatgaacctgggtaactctgggagcacaaacccagaccacacccatcgggagagattgacctgagtgatgcgctaacgcatatcattgagatggggccagatatcttgcttagatgaataattggagttcatgtcaaccatctgtcctttcccataatttaaagccaacttctatattttccaggttcatactttttttttcattaattgcatgtaaagttgcggtgaacaccttctttcttgacttcctgtttaaaaaaattacagttcttaaaattataagcttattcaggatggagtggtcagtttgtagaaaaactagctctttagatcttttaaaagcactacattaaaaaaaaaaaaaaaaaaaaacatcggacgtggtgggtcacacctgtaatcccagcactttgggagtccaaggtgggaggatcgcttgagcccaggagtttgagaccagcctgggcaacatggtgaggccccatttctacataaaattttaaaaattagccgggagtggtggagtgcacctgtagtcttagctacttgggaggctgaggtgggagggttgcttgagcctgggagttcaaggttgcagtaagccgtaattgcaccattgcactccatcctggatgacagagcgagactctgcctcaaaaaacaaacaaacaaaaacaaacccagagaaactcaaaaaccaaaaaagaggtatccttattttcccaggcctcaatgatgaaatgtgcccagtgttcatttgaatctgcccatcaattagtcttttcctgatgtctcagagaagcatgcatgatgtacggaatgtcttgggtgacctagagcggcatccccaataggactgccctgtgaacatggccccacattcggctcttgggcacttaaaagatgtggccattgtgactgagaaactgaattgtgaatgttatttaattttcacgtgtttaagatgtggccagagcagacagatgaacagtctggcttgatggataactgcagggagtttcacgatgctggtaggaggcacagtgagcttctggaagagccggccccacctaggcctgattttggtggctgctcaaaaccgctggtactgaattcctttagaatagtgcttctcaaagcgggtgactttgtatcctccccaccctccaggggccatctcacaatgtctggagacatttttggtggtgacagtgggtgcttctggcatctggtgagtagaggccagggacactgctcaacatcccacagtgcacaggacggcctcataacaaggaatcatctagccccatatgcgccacgatggaggagccctgctttctattccgaagaccagcagtcctaagatacgatgtggacagcacagacccagttttctaagtgaagagataaggcttgagcaggcagcagcctggtaatgccaaggccaggacagttagccaagtgtctgagtccatggagcttctcgggcagtgttctcttttctcttcagctattccagtttgtattaagtgtaagaatatgaagttgatgtttgtcgtgagtcaagacggtgacacagaagcagtctttcgtgctttggtctaatagctttattgttaaaggagagaaacagaaaactcctctttgcctctgcagttttctctgaaattgaatttagggaaagctgaccctagaccatgcgtgccctttccaccagcatcgctgtgggttccactcgtgggagatcgataaggaagtggggatgaccacgctgcacagaagtgttctcatcacttttgcgcttgcttatttaacccatgattgttagaaagcgtttagaaagttggtctttgcaaaccagccctgttaagtgctgagatgaaattcttaactttttttttccttcttagagataaggcctcactctgtctcccacgctggagtgcagtggcgcaatcaaagctgactgcagcctccacctcctggactcaagcagtccccccacctcagcctcccaaattcttaaaaatgctaacagtaaccctcacacacaaaaagtgctgccgttagagatggcactggtattgagaagcacgtgctgtcagtgttgcaattggtaatgcacaccacacttgggcatagaaattggaaatccaactgcgccaagctggagcctgcagaaaggagcacgaggagacgggacagcaatagagctctgtcgacggcgctaagtagaaccagacgctgcaataagacaagcgtccccctgtgctcagtacaaatgggttgcctgtggcagatgcaggggtggctttggcagagagacggctcctggcatcgtggaattgaattggctgtttcttttaaagatactgcaaattgcggcagcatttatcatcctaaggaagcccgcacagcttgccaaacagataatattgatgatgataacaacaatgataaaaggaaaccatgatgcctctactcaatgaaaatcacttttatcttatttgcaaaagtcagaggtaggacagatgtgtcagcgtcttaataagacagttattcaaggagttaaattgaaattattcacatacccaaaataagctatttggcaaacctggagacccaggggcctttggatctatcttagtgtaaaatttcttgaagcagagacctagtaggtactctgttgcttatggttccaggcaatgtattgttttttcttccccctaaatatctgtgaatgtgtgaagtaccctgtgtgccagagatggaaagtaaaaccacagaagcggggtgcggggagatggcagctaaattccttttcagcagagttgaagcatcttgttgtaagagtctagctccacaacagtgggatgcaggaaactgtaacagctgaaatacccaacagatgtattcaccatcagtgcattgggaaaccctctcaaaagtgtcatcacaaatgatgatcttaacttttgtatgacaggatctttaggtcacccaacagtaggtgcacagtttctatgatttcaatttttaccacttctggagacttgtcttcccatttcttgtatcagtgccttactgatagagttggaaattggaaccaaagtaattagattggctctccagatctcttacatgagccaagaaaggattcaaaagcatgccctgtttccttcttgacaggctgggagaggaagtgaccgggaagtgaattgctaagatgtggtcgtcattttcctttacaccacagagcctctgcgtttgggaactgcaggttcatccgagtcaatgtcagaagtgccttgtgtctactgtagtgaacatcctttgtttccatcgggtcctgtgggaagcagcactgcttattgggtggtttgagggtgaatgctattttacaacttgtgacccccttgacacactaccttttcattttagcatggagcacagagccatttctcccctgtgctggattttgaatgttctttcaaccaccgtgatagaatgtccaagaaaggaacaaaggaagaggcaactaagggaatctttcagtgggttcataagccatgctgctcctggctttgacaggagttaaaatcatgggtatccctaaaccactatcattattggagttgctgttactgtcgacgtaaagagtcaaactctgtaaaatatttgaagagatttattctgagccaactctgagtggccatggcctgtgacacagccctcaggagatcctgagtacatgtgcccaaggtggtgggggcacaacttggttttatacattttagggagaacacagcttggttttatatgtgaacccccaaaatctgagacgggtctcaatcaatttaggaagtttattttgccaaagttaaggatgcgcacccatgacacaacctcaggaggtcctgacgatgtgcccaaggtggtccaagcacagcttggttttatacattttagggagacatgaaacatcaatcagtatatgtaggatgaacattggtttggtctggaaaggcgggacaactcaaagtggggagggggctcccaggtcataggtagacaagggacaaatagttgtattcttacgagtttctgattagcgtctccaaaggaggccatcagatatgcatctatatcagtgagcagaggcctgtcgttgaatagaaggggaggcaggtttgctctgagcagttcccagctggattttccctttaacttagtgatttgggagccccaagatttattttcctttcacatacacatttgagggagacatgaggcattgatcagacacatttaaggtagacattggttcagtccagaaaggtgggacaacttgaagcaagggtgcagggggaagggggggtgctttcaggttataggtagatttaaaatttttttgataggccattggttgaaagagtcattaccaatagaaaggaatgtctgggctaccttaagaggttgtggtgaccagtgttttatcctgcagatgtagcctccaggtagcaggcttcagagggaacagattgtaaatgtttcttatcagacttgaggtctgtgatgatgttcgtgctggaggggcttaatgaggcatgcttgacccccacttcccggcagtcatggcctggtccgtctttcaggataaatttagttggccttggcccagaggaggaagtccattcaggtgcttggggggctttcgaatgttattgttggtttacattatgattgtcattgttattaaaaaactaagggctgtagagaaatggttgcagcatccatcatgtgtccctaggaattgcacatagctaagtgagaacctcacagaaccctttcacgtgcagcccgatgctgtcactgttcataaacaattgtattttgccttcctgaaaggccatctgagttcattaaacttgcatgcttccatatctatacattcttttctcatggcctctttgtggatggtttgttttaccatttgttgtccatcagcttgaatggtagggggaagagttcacaccgtgccccctgtgtagcagaatagcccacagttcaggcatggctctccagcaaggagctttctagggctctgatgctcaccagtggggggattgggcacccctccgcaactgccaggggacattgacaatgtctggagacattttgggttgtctcagtagctgtgtgggggatgctgttggctagtgggtggagccctgggatgctgctaacatcccaccatgcacagtacagccccaacagccaagagtgatggctcacaaatgccaacataagaaacccattctagggtacctttcatttgcttagtgctgcgagaaggtttatctgccaaagatcatcatcttggagagggccaagatcctgtatcctgtactggacagatatgcaggcattcaaattctgaaacgccgttggaaacatgaggctcggatcacagaagcctcctgtacatagagcaaatgagagctggaggcctgctgcccagcccagctgagtcctgtttcttatttcggttttcctttagattccaccgaagtttctctgaagaatgctgactcaggctgccccttttattccatttctttgcagggcagtttaggtgaagctggaacacagtgttccctgaggaagcattaggacaattagaccctgcctttgctaaatgaatgtatcaagaaccttcaacgtctttacaagaagcaggataaccattttgcagagtactgtgcttagtagcagagcatggcttctgttacacagtttcagtattgcaaaggtccccagccagtacagtcccacccttaattactgcttcagagctgcaagttaacgtttaaagtgttttcacagtagcttgaagtgtgatctcccatattacggtcatatccttggacttagcccatgttacataaattagatctttataagcagcacacttctttgcaagcaatttgcttccctttgggaatctgattccatagaaaacagtagtattttaaacatgttgattctagtacttacagttctattcacgtgctcctggtatagtacatctaataagaaagaatcccttatttttacttttatccaaatgcatgtatgttctttcagcatgagatataatttgtctgatcaagtatatagggagatgagattaagaattaagatttgtttcaagatatgagattaagaattaagatttatttcaagaaactcaattgcatggttgctcgcataagccactatgcagtggcagctttaatgaatggggttccaatgttttccttactgttttcaagaaggtagtgaataaaattagatgttaaagcgaattgcattgtgtgaagattgggacagatgccacatatatagttcagatgcttgcctgccagtccctgagatatactcttagcttgttaatatggaaattgtcaaacatattcagaagtatacagaatatcttggtatattcctgtgtattcttcactcatctccagccactgttagcgtgtcacgagcttgtctcatcgtcccctcactgttttctctttagagtaatttaaagcagatctcagacatcatgtgatttttacctataaacatttcaagttgtatccctaatatagaaggatttttttatgatactattattctgtaattgtttcctgtttgccttaacgaaaagaccacagactaggtggcttaaaatagcagagatgtattgtgtcattgttgaggaggtcagcagggtggtcaggcggcagcagggtggcttccttttggaggctccaagggagagccccttctgtgtctgtcctccaggttctggtgcctgcaggtgccccttggcctgtggctgcataacgccaatctctgtctgttaggaggacactgtgtttagagcccatgcaataacccagaatacctcatctcaggattcttaatttaattacatctgcagtgacccttttttcccaaatgaggtcacattcagtcttttactatataaggtcatattcacagagtccagggatcaggttgtgtacttaatcctgtttctttcgtgctcatgggaatgtatgagttaggggaatacagattatctttgtgttgtagggttttcttaagattatgatttattgaaaaagaaggtcaatggcatataaaggaaaatgtcattgataaatataaaaagaaatgcaagttttttaggccaagcagaatgcttataggagccagtgtcttggattaaaattatatgtgaacctcaagtgttatcatctataaagtgaaggtagccgtgaattacctcttagattgttgtgaagataaaaatgaatacagcattaacacagtatataaatgctaagcatttagtaattatagttcgcctctttttttctggaggctcaaagttgattgtaaatgtcaaaccaagaaataatactaggtactagcaacacataatgcaaaggaatgattcctgtgatacatgaagaactcctataaagtactaaggaggatgaccagcagcaggccatgagaaaaatgaaaaaagacatgaacagttttcttaaagggaaataatgaatagctctaaaatgtatggaatgaagctcaatctccctcatgacatggggaatgcagatgaaaagtgtaaggtaccatttcacctttcccattagtagaggtcagaggtgtgactgtgttccgctggcaggagctcaaataaaagcgggtgttgttgctggcaggcattgcaagaggtccagcctctttggggagcagattggcaaaagatatctgacctagaattgtcacttcttgggatttagctcatggacatagtgtaaatatatgcaaagaagtactcacatgatattcaccaaaggcattgtaaaagcagaaggatgaaagcaaccacccacagtgaacgtgttagattataataaaggcatagaatctatcaaacaataggaaaaaaagcataattctgtatatggaatgaactccacatgacgctcttgcatgtaaaaagcaagacagatacctgattgtgagtagagtttaatacaagttctatgtcaaagtgggaggagctatatgggctggtctaggtagaatatttctggaaggaaataccaaaaattggacttccctgttggggagaggtggattttagagatggggtagtagcagcttctcaaaaaccaagagaaagcttcgcatttacaatgggattattggaagcaataggaaacacccatttttgtaaaatctgtgagaatgtgtatacttggtaaaagtatagatattcagccattaaaaggaatgaagtattcatatatgctacattgtgagaattgaggatatgctacattgaaagaaaccagccacaaaagactgtataaggttccatttgtggaaaatactcagaaaaccttgggggaggaggggacaggaagtgtctgtttagtgggtattagatctcctttggaggagaggaaaatgttttggaattagatacagaggtggcggtgattgtataacattgtgaatgcccccaaatgccactaaattgtacacttgaaaatggttaattttatgtcgtgaatgttacttcaatttttaaaaaaatccaactgcaaggagagaagattctctagggaatggcttgtcaaagcatccatgtcaaagggaccatttaaaaatttccagtctgaggtgggtgcctttgtgaaaagcaattaaaatgtataactagaagagcaatcatgtctcagacaccaacgcaagcacaacttgccctaagttttctaagcacttcttacctcattcattcatcaccagagacagacagttcccaggccagaatccgcacctggatgcaacttttaatacatggatctagagttgtgttcttccagctctagaagagctccatgccacccccctcccctcccccccccgccacagcttgtcagaaatgcagatcacaggccgtctctaggtctgctgaatgagaatttgcattttagtaagctgcctaggcagctcagaagcacattaaagtttgagagggtaatttggggacagtaaagtgcagtcggaggaggatggttttgtggccctttggactggtcacttaatgactgtgaccctgggcaagggactgggttcgttccctaggctcctgtaacagagtgccacagactggtggcttaccgtatagaaacaaatgctctgcagctccagaggccacaggtctgaaactgtggtgttgtggggttggcacctgttccaggcctctcttcttggcttgtagaaggctgtcttcatgttcacatgaccttctgcctatgtgcagttctgtatccaaattccccaccttaatgacatcatcttcactaattacatgtacggcgaccttatgtccaagtcaggtcacattctgaggtactgggcgctaggactttaacatgtgaattttaggggaacacagttgaacccgtagcagtacttaacctttctaatcctcaatttcgtcatcttaaaaatgagtaaactacacattaatgtgggtaccatcaaaaaaacaaaaaaaccaacccaaaaaatagtaagtgttggcagggatgtggagaaattggaactcttatgcactattggaaggatcataaacaggtaaacactatagactatagttcagcagtttcttaaaactagaattatcagatgatccagcaaatccacttttgggtatacatccaaaagaattgaaatcagaatctcaaagagacacttacacactcaggtttagagcagcgttatttatattaaccaagaggtggaaacagcccacatgtccctcagcagatgactggataaacaaaatgtggcctgtccacacaatggaatagtattcggccttgaaaaggaaggaaatcctatcacatgccgcaattttgtatgaaacttgtggacattatgttaagtgaaataagccagtcacagaagagaaatactgtataatcccactttcatgaggtatctaaagtacacaaattcgtagagacagaaagtagaatggcagttgccaggggctgggggaggtgaaatggggaattgttgaatgggcatagagttggagttttgcaagataaagagagttctggagattggttgcacagcattgtgaatttaacactgttgaactgtgtacttaaaaatggttaagaggctggatgttttgggtcacacctgtagttccagggctatgggaggctcaggtgggaggatggcttgaggccaggaattcaagaccagcctgggcaacatagtgagaccccatcttttacaaaaaattaaaattagccaggcatggtactgcatgcctttagtcccagctacttgagaggctaaggcaggaggatcgtttgagcccaggaggtcaaggctgcagtgagctatgatcacacagttgcactccagcctgggtgacagagcaagattctatctcaaaaaaataaataaataaaagatggagaggagcgttacttttttgtgtgcaggaacgattgctgactgcagagcctggctggctaaaattagatttgccttgtcagtataataattgtaggtatttttggagggaaggatgcctggagcccggctgggttatttccgcccttggagtgagccagggcagcttagagggctacccgcgtgcagccctggaaggtaccgaaggagccctggaggcaccgagcgctggaggcctcatccctgagcaggttgccctccttctggtcggatggcagggcggaaacccatctgtgtcgggagtgagagctgtctgctgtccgcggcttgcgcttggagcttttcctgcagtccagggagagcagaggaggccagtgacttccatgaaaacacccccagtggtggggagggaggcggcatcccttggaggtagggatggggcccctgctgtgacccattagaggcaaagaagggcttggaagtttcattttgtcttacatgagtgtgtgtgccgagttcacattatttgcacatctgtgtttgtttttatataatgataaggacatcagtttccattgataaactataaggaagatgtgccatgtttaccagggccagagtgaagagactgaggtgcttgctttgggagaaaaatttgagggggtgacaaacaccacagacatcaagataaattatctgtgtgtattttaatagctttattgagatgctgtgcacagccatacaattcacgcatttgcagtgcacagttcagaggtttttactatatccacagaggcgtgcacccgtcaccacagcccagtttagaacattttcatcacctggggaagaaacacccacccagtggcagtcacttcccaccccacccccacccctgccaccgtgcattctgctttctgtagatgaatgcgtttgtctactctaggaacctcatacaagcagagtcatacagtgtctgtccttctgtgtctgacttctttcactctgcgtgtgttcctggttcattcatgtggtagcacgtgccagacattcctttctgttacacagtactgtatgtattatatatgtacacagccggctgttcatatccacgagttctgcttctatgaattcaaccaaccgtggattgaaagtatttgggaaaaataataatgcaacaataaaaaaatacaagtttaaaaacaaatagagcataacagatatttacatgacattgacattgtattgggtatgatacataatccagaggtgatttaaagtgtaagggaggatgagcggttatatgcagatgctactcccttttatctaagggactggaggatactcggattttggtatctgcaggggtcctggacccatcccctgtggatgctcaggggcggctgcaccacatttgatctatgtgttcatctgtcagtagatgtttgggttgtttccattcattttttggctaagtgaataatattttaatgtgatatttaaaaaattaaaatgaatgcaagaaattccatgaggaacaaaatattaattttaagtaaagaccacaggatcagtatttctgaagtttccttttgcctcaggatccagtatggctccatacattactgatcctgtctctctctctaacattttgatattttgtcatgtactttttgcattcattttgattttttttttttctttttgagacagagtctctgttgcccaggctggagtgcagtgatgcgatctcggctcactgcaaccaccgctttccaggttcaagcattctcctgcctcagtctcctgagtagctgggattacaggcacacaccaccacgcccggctaatttttgtatttttagtagagactgggttttaccatgttggccaggctggtcccaaactcctgacttcaggtgatccacctgcctcgacctcccaaagtgctgggattacaggtgtgagccactgcgcccgtcctcattttgatttttaaagataatgtattacactattgtttcttttgatggttgaattttctggcatccccttcaattttgcaccagaggtaagtgatcctaatccctgccctgacattttacactgtgctgtgaataccccagggcatcatgaggaataaaatttgaaagtgtatttcagtgagctaacttggctggacagaatacccatgggttatccttaccagtggtgccatatttatgcctttcagcagtgttgtgattaaactcaggtccagtaaaattatcattatactatattagttttgtagaacttctgtaacaaatttccacaaactgaatggcttggcttaaaacaccagaagtatatcctctcacggttctggagtccagaagtccaaagtcaagatgggggcagggttgtttgcgtctggagcctctacaggaggatccttcctgcctcctccagctcttggtggcgccaggctccagttcccttgtagatgctacaagggaactcttgtttatagtcgggatagaaattacacaaaacccggtcttgattggggataccttttggagtactggcaagttgccgcatggactgagccttccgatcggagtttgctgtcttgctggtgatctgcctggatgccggtgcacacactaatccctgaacacactaagcattgcgcttgctgttgtttaacttttcatccatgattgaattcaggagttctttttttaaaatggccatttttaaagatttctaattgggagtttttcttctgaaaagaatacccgtaaagcaaactatttaaattatacactgagagacgtatgttcattcttgtatccataacagttaagaatcattacctattactagcataggcacaaagcgtctcctctaagacatttgttaattacaaaagggacaaaagtagtgacatgtggggaagaaacccagcagataccacctaggtggtcaaggtcatcatcatcatcacgatgagggcatgttgacaccctgtgataatctgagaaggactcagcatcactcctgtggtgttcctgccaaaaatgcgtaagagtctaatcacgagaaaaattagacaaacccaaactgagaggcattctgcaaaacacctctcctgctcctccaaagcattaagagtgacaagggaagaacggggaaccatcacaggtcaaaggggatgtgctgactataggaatgtgggctcctgggagagagaaagggcggaaggagaaaccggtgaaattgggtaagtctgtagttcacttacttgtgctgtgccgggtcttaactttcttatattttgctaattgctatgtttgtgtaagatgtcaacataagtggaagctgggtggcagttatatgcaactctgtgctatttctgcagcttattgtaagtctaaaaattatttcaagattaaaagtttttttttttaaaaaagtcagatgaaaacacgaataagtaaaaaaaacataaaaagagagaaaaaaggagccatttatatgattaactttttggttggtgtcgccataagttttttcagttcggattcttagtaaaggatgtggatcaaaacaaatcttcatactaaaacatcagcagagaccttatttcatttgaacaaaatatcatgaagtcaggattcgttttgcatttgaatcttgaacatttaagttttttaggaaatttgtggtgctcctgtccttgaaaggaagcccacatatgttcaaaatgcagtatcttttaaatgcatttgaattttttaaagttttggtgtttgttgtttttggttgtttattgctttgatttttcatgagcagtgctgttcaggggtactattattgtcagttttaaatcactgctgcagcatacttcatttgatcttgagacttgccatgagtcttactgtgggggtggggaggatggggaaagaaaccattgagtatgagttggcatgtcccacagaacagcgggcggacacttcagggggctgtgcctttctcagagactcgagggctatgcccaaatcgttatgcagtgtgtatgtgtgggggggatagttggggggacgggtatggggaaaggagtaatctaccagggacgacccaggacagatcccagagccaggaatgagggttggatcttgggcaaggccatctctgccatgactgcttgtgggaactcctgcttactccccgtgaccctgagcaaaacttccaagtttgaagcctcaattttatgctctgtcaaagaaactagtttttcaccctccaccagaggatgaagtatcattctccacgtgaagcactcagcacagtgcctgtcccctctgcagacatgatgccaatctgtgatgatgttctcttctgtcagcattttacaaagcagatgagagcgttcacttgcacagcctcctgttgacctttcttctctcagacgccttgctgtagatcccaatcgactgcttttccttggccagccgattcatgcagtctcttgcttacttaatactgttgatatatttaaattattgtttaataaatacttgttattctggagtatatttgttcatccaaggatggtttactactgcttgctttgtgcaggttataacaggtaagggggtggaggtgtgtgcagagcatcagctggtcatcagccatcttgcgggagtgcccagaggggggaagagcaaagcctaccccttctacggagtgtgagggaggcaggcttgggtggaggcaggactgcaccagccttccagagctcagagaggtgacacctgagccaagtgacacacacatgataaagaggaggtttctggagtccagaggaggaaggcatccttggctaagaggacagcatgaactcatagggtacctccaggaatttttcccctgggcagtaggggcagagaaaggtacccaggggggcaggggataaggactggcatggagcatgggctcgatatcagcctgctgattttaatgaaagccgtttggtcacctgaagaacagctttgattttacttctgtaatctaaactcttttgagttggaatataaaactcagtgttccatgtgacaaaggggtttttaaattggtcattcccttaaacatctttacattttcgtatctgttgatgtcatttttttccccattgctgactcctgttcctgtcttctatttctgctcttgacttaataattcttggcttcttgacgtttatcattgccgactgctctgaatcctcatcttcccttcatttatttccatttgtccgctctgtttactgcctgagatgttgaccttttttccaagcatgcactaagcggcattttaaagaagcagcatcatgtcatagctcctggtagtggggctgggcctattcatcttggggcttctttatctaccttggttgtaggtagttaagaaaatcttaacccttgggtcattatttctatagtgggtcaaagagatgaccacgttactaaaactttcatgtctagttgcatattctgttttttttattgtggtaagatatacattacgtaatacatttgtaagtgtacaattcagtggtatgaaaacattcacaatgttgtgtagccatcaccctcttacacctaaacatttttccattatccttctccaaaactctctgctcattatacaataactggcccttccacactcccctccccacactcagtccctggtgacttctcttttttctctttatttgcctattctaggtaccccatagaagaggaatcatataacatttatccttctgcgtctggcttatttccctaagcataatgttttcaaagtccatccgtgttatagcatatatcaaaatgtcatcgtatttttgtggccgaatactaatccgttgtagggtcactcacacgcacacacgtagagtagctgtgagtacagtgcccagattggtacagaaaggccacagtgcccatgggtctgtccattttacatgctgtaccgtgtgcttcatgggaaatatatttcttctgtgagttttcttgtacattgcttgtttccagacttctaaaggggtggttgtggggatgtggtgctgtgtctcaggtatactctgcttatgaaatagcgggtgtgatggaagggtggagaaagggagttgagtaataatgttcacctggggtcgggcgcggtggctcaggcctgtaatcccagcactttgggaggccgaggcaggcggatcacctgaggtcaggagttcaagaccagcctggccaatgtgttgaaactccgtctctactaaaaatacaaaaattagccaggtgtgacggtgggcgcctataatcccagccactcaggaggctgaggcaggagaatcgcttgaacccgggaggcagaggttgcagtgagctgatatcgcaccactgcactccagcctgtgcaacaagagcgagactccatcttaaaaataataataataataataataaggttcacctgattgaaatagcctctgtattgaagaacaccagcaggtgaagttcgcttagcagatctgagcttcctgttaccctaaacactgccaaccttgacctacctctgaaagccagtgggatgaggtctagggccaggtgggaaccttgggaaaggcatgccctactgtttgaccaaggggatgaggaggctgggtactccagtgatggagaccctttccccaccttttctctcacctctcctccacccagtgccctttcacctttcctttccaaccccacacccatccttccgccccacttccccatttatttctctctgctctttcatttccgtggccagccgcctcccaagccctgccctcaagcttcccctcccttttctttcatgcccatagcctacctggatctcctctccctcgtcgggcccacctccctccacccttgggatcctggtcaccccctccactgcaagggggagaagggctgcactgtgtggagggttctccctaccttggctgtgttctggggatttcccaccagcccttgcgctgcactggtgatgcccgatgtagctgaaactctgccccgctcggggttactggcctgggatcagcataggagatgggtttaaaacaggatgcagggaggctgctggcagacagttatttgaggaaatgcatttcttaggatatagctttcaagaaggtgctgttattgtgcgtcacacatagagtggctgtaatgcgccagggcaaatgaaaattatgtttataaaatagggcaccttgtcaagattaacttgtgtgaaattcccaagaatatacctcaaacagttttttatgtcagtgcatgatattgtagtaactctcccagttctagatatctttattttaaaaggaatgcttgtgtgcagacacatttttaggtggaggttagtatgttttagttctcaggatttctaggagaataaatagccataacttgataggattggtatgaatagtacttggtcttgggaagttttctccatgaaaatgtttcatgttgacgttttgctccctcccgtcttggttttacactcattcttcacagaactgtcatttataggaacttatcccctggccatctctataggtgtctttcttgcccagataaggtgagaatcattttggaaaccaacttcttgagaatccacaagaaatgggttttagccacaagggatcattgcattgcattctataagatgagagcttctacaagaaaaaattctggagccagatattttagggaagacagggggctgataagtgaattgttattttaaatggttttcatttcccctcatcctgatttagaagaggagagaaaactctccttagaatcagtgggtagtcctgacttgaatgggtttattttctttttctctcttgaattgtcggtgtatacccgtgtctttcttggtttatccttcatccccattcctccggatacccctatttgcatttaatctgtttggtcacataacctctcaagtagcgatcttggaggtttcaaaacttaacatttcattttccccgctgggtcaactaccagtctggaagcaccagggtttccaaggttaggttacagtgaaggcacaggggacatcttcctgtctcctctgcagagccagcgccactgtgcagtggggtgtggaccccggctcctccccaggctcccaggcctgcagctggcacaggggtccccagaacctgtgagggggtccttccctctgcctccctgagggacttggtgattcttagccctctctaacagagggagaagacgctgtcaaaaatgtggtttgcccaaacccacatagagctgggaaaggggccagggactcaaatagcagagatttcctggccatccatcagtcaggttacatcagtatactccatgtggattccactgggtgccggcctggtggctgaccctgcctttagagggaactcattattgtgtatttgaagtgtaaatacctcttttcccagatgttaatcttgtttcagatattcgatggagagggttcacataataaataattccctcctgagtcggcttgcgtggctcctgagagcagctggtcagggcccttcttgtcggtgtctcactggcttttagcaaaatggagacgaagatgaaagggaaaccttaactatagcttgaatccttagggtggactaagcactcaaagccttccatgcaaagcagtgtggcttataaattggaggcatttttcttattattaggacaaaccagcacccgaattggtttgtcaccagtaaaagaatttaaaacagtgcccgatttgcacagctgagattttggcaacagtatcttacacatctgaatgggtggagtaagatggagcatcattctgtgatatgtttaaaataatataccatgaaatgatgcagtaagtgttggagatatcttccagaagtcttaggtcatttgttttcatgtttaaattgtttccgcaaaggcattctcttcaacataaggagagctaaaaatcaaatacacagaaattttgtaagtgtgttgtttttttcttttcctgtttagactttataacattacactatttacctgggctaaacaaaataaattattttgtacataaaaccacaaggagatggtttagcctacttatgggaccaaactgttgtattagccagtgtgggagaatattgcagagatgtgtggcttcatcaatgaagattagatgtaaagtctttttaaaatatatgagaatgttgaactaaagatggttcagatgggactttgctcgagttgcttgagtctagaaggcaaaataaatgtttgtaattgttacataggccagccttccaaaatcccagctatccatagaaaacaaggggtcagcaaaattggccatctgcctagactggtaggttgtatgggtctgaactagaggcagtctttccccaggggacatttggcaatatctagagacatttttggtgtcaccttgggggaggggtagtactggcatctggtgggtggagaccagggatgccgctcaacatcctacaatgcagcggtcaccgatagcccaccctgccccaccacagccaagaatgatgcacccagtagaagcaccatccctcttccactggtgacatccgaacatgtctacagacactgcctaatgcctcttggggggcataatcacccctagttgaaaaccactgccctaaactgagactctgaaatcaaccacttaatctcctttcctctgagctcaggggagggacgtgactcctgcgagctgccttggctttttgtaggggcacagatagaagccatcccccaacacggtgccctgggttctgtggtggtctctgagaacccatgaataaggatcccagggaagcctttctaggtcgtgctgctttaatattattctagatgccgatttaaagtcataaaggaagaagagctaggactgtgctggaggaccctaaagcccatggcccatggtttcctataatgctaaccatgcccggagtatctagttataaataattgtgctgaggtcatgaatatttgactttggttctcaaatattcctaagaaaaaagtcatgaaagcccctgatggtaaaaggaggagagctgagacctaagtggataggagactcaggaaaaagcaagttagaaataaagttcaacaaccacaggagaggagaaaatgggtccaaaagacttgggctttaggcacatcttacctaaggacaaaaaagtagagaaaagatcaaatgttgagaaaagattgagccatgcggagaacgggcagggtgttgaagtacctgctgctctccttaaacccagcatgctgttcactgctttattttagagagtgggtgtagtggtctgtttcagaagactcaagtctacactgcctctgccactgaggttccttttgactctgcagaagtctttacctttcatctcctttctgaaatgctgtgagcatttttcctcccagagacattaattgggaacagcagtgaatgcctagttccttgcagtcctttggcccacacgcatttccagctgcccactggccagactggattctaaatgccaaaagctacaggcgctgacagagtgcttttgaaaagaaagaaatgcatgaaatgccccgaatttatgggaaatatttatacccagcagtccttgagccatgcgtgtcctttaggaacggtgctaccagacagccgtcggcatggccttgctcctggtggtgcaggctctgatgttccactgatgtgagcccaagagaggaatgaccagtcagcctgtaaccccagctccagtgttgttaatgagtgtcaccgatcaggtttcagacgttagtcagtgtcccggctccagtgttgttaatgatggccacggattgggcttcatgcgttagtcagtgtctctgttaggagctgaattgtgtccctgcaaaagggatgtatttaagttccaaccccttgcatctcagaatgtgagcttatttggaggtgggatcttaaccgagtgtgactggcttccttagaaaaagaggaaatttggacacactcgtacagggaaaaggccatgtgaacagccacctccaagccaaggagacaggctcagaacagattctccctcacagccctcagaagaaaccaaccctactgacgccttgatgtctctgaattctgcactccagaaccgtgagagagtcagtttctgtgaagccaatcagcttgtggtactttgttatgttgggcctatgaaattcatctactgttactagcctttcccaaatatttcagtccatgaaatgcacccagcatggcaactcttcaacttacagaaatggaaaagagaaagaatactgtgcttcagctagttttctcattacccagaaatgaaaaggcctgacctctgaaaccttgaggaatctctttttaagatgccagagcctgtacttctgcctgatccaagcagagtttgctcgctaccccgggcatcacttctcactgcccaggtggcactggatgatgtccaagactggccagatctggatggattccataaatagctcgtgctgtttctggtcagtgaagaaagaggaaggcaaagccacgtgcataagtttgttgtggatgccataacaaagcgctgctggagtggctaaaacgacagacgtttattgtatcccagttctggaggccagaagtccaaaatcaagatgtcagcagggctcttcctcctgagggcttgaggcaggatctgtcctgtgcccatcttccagcttctggtggctgctggcagtctttggtgtcccttggcttgtagctacatcacccagatctctgccttcatttgcacatggccttttccctgtgtccaaatttccatccccctaccttttttttttgttttgttttgttttgttttgttttgttttttgtttttttttttagacggagtctccctctgtcgcccaggctggagtgcagtggcgcgatcccggctcactgcaacccccgcctcctgggttcaagcgattcttctgcctcagcctcccgagtagctgggattacaagcatgagccgccacacccggctaatttttgtatttttagtagagacggggtttcaccgtgttggccaggctggtctcgaactcctgacctcaggtgatccgcccacctcagactcccaaagtgttaggattacaagcatgagccactgcaactggccaaatttcccctttttataaggactccagtcacattggcttagagctctctcctaatgagtttacatctgcaaagaccctatttcccaataagaagttactcccaggtactaggtgttagggcttcaacatacgccttgggatgggcagtcttgaatccataacaccgtcaattaaaaggttctgctttcattgccgccaggttgggaaaagttgccagggtgggcttggtggaggagggtctctcagcagggcagggtcattgcagggaaaaggagagagaaacagagacacacaaaagcagatagattgccttggcagaggtggccagactagagtctttgagttttgtagagagatcaattgattacttctagaaatgtcctcttcaaagtctctagttttctctcccatttccttatacaaggctctggccatattactacttctggcacagttgattcagtgacttttgcatataggtttccccaaagctaaagctaaaaacgaacaaacaaaaaaagattattcatgaatatgccacaaactttgcccatagataagactttgtgattacaagcaaaatctgattggaaaataaaatacattatatgttagaataccaggaaacttctttttggggagcgtctttatgaaatgaagccatgctaacctccctgggactgctgatcagaatgtgctccaccccaaagcctcggagagggcaggacagccagtgactctctcctgtcagtagacacactaaacctgaatccaggatgggaaatcaatgtttgacacagctgtatctctttcagttggatcagtaacactcgctcactcactaggacttccatttgcttttagctgcctgcaatgaaaacctggcaagacgtcttagtctgatccggctgctgtaacaaaataccgtagactgagtggcttataaaaaatagaaatgtattgctcatagctctggagactgggaagtccaggatcaaggcactggcagttttggtgtctggtgagggctgctttctcacagacagcatctttttgctgtgttctcacatggtggaaggggtgagagcgctctctggggtccctttgataaggcactaatcccattcatgaggccccaccctcatgaccgcattacctcccagaggctttacctcccaacaccatcatattgtaggttaggtttcaacataggaatttggtgggcgggggggggggtacacaaatgtccggaccatagaataggacattacagcttgaaaaagcactagagagaatgacgttgttcctttgtaacacagaaaagcattcacctctcaatttagatgagccattttgaccccagttggttctgaaaatccttgttgacaaacaaaattggagaggaccatagcctgcctgcttttcccgaggcccggggaaagctttttcatatgatgttattataatgttaggtgtaacaataaatgaaagttttgtatggtctgattgggtaggacaggcctgaacacaggcaaacccatctgcacagcatgctcaattcagtcagtgtacaaaccctgtgtcatgggagcagagagaagggtctgcttccattccggaggatgacagaggcttaaggacggtgctggcgtttcagctgagcctttaagaagtggaattttatccagaggtgatcttcttggaatagagagaacaaacaggtcagggcatgcagacttgattacaggtgctctggggaccactggaatttttgttgaacagaggatgatgaaataaatcagtgttctagtgtgttacctttgggcagtggcgagatccgagtctccatagtgaacaaatcagtgcacagaccagggcagaagtgcaggggaacatggaacattcagggcctggagggtggtacccaggccaacactgccccctttttccagctcccatctctgtccacatagttgggccagtgtagacatctgggtcatatagggaggcattccagtggccccatgtggtttccatggagatcttcaggaaggggttttggggtgagagttggtatctcgtggcaaggacacactccctgggctaggtacatatgggtggttttcttgtcctacagattgcaaagatacaggggtagctgttctgctctgggcagcttctgtagagacaggatgtgtatttgcttgcctgctcctggaagccagtcactgaggcagacctctttactcgtccagaagcatgacttggggatgattatagttcaaggacataaggcctagtggtgtctttcatcagcgccccccattttacatttctgggatccccctttctcttttactctgatctggcctcccttcccacccctctggccactcaggtgaggagatgccagatcccaggtgggcaggaaggaatcccactgaatgagatccttggaattgcagcgtagcctggagctgtatgttcattttagatagaaatattgacactattgacactatttggccgggcgcagtggctcacacctgtagtcccagcactttgggaggcaaatcactttgaggccaggagttcaagaccagcctggccaacatggcgaaaccctgtatctactaaaaatacaaaaaaattagctgggcatggtggcacacatctggaatcccagctactcgggaggctgaggcacaagaatcctttgaaaccgggaggcggaggttgcagtgagccgagattgcgccactgcactccagcctgggcaacaggtcgagactgtgtcttgagaaaacaaaaagaaagaaatattgacactatctgtccgcaaaaggtcaaaggcataattacaatatgattttgtttccatttttctttttcttcttatttcatgcaaatgctgtctttttgagagaagtggttataagcacagcgatattctatgctatgtacagctctcatatatagaactctctagaatggctcaagttaccattaagcctcaggtgatatcaaggttataaaatgtaaaatgaatgatcatgatcattaagtagaaatcctggctgtgtcttccaagttctttttctttctttcttcctttttttttttggagataggtactatctgcatttcagcttagcttgccgccagtgttctggtttcttgaccatgctgagtaattttcagccacaccttgtatcccttagaagcccttcttgattctgaggtacggggctcagaaagctttgtcgtgggaggttgtaaattaggaaacatgaaaatcagatcaacaacagtggctggtcctggctgcagggctcatctgcctggagtagcttgaagttgaatgttaatatatacttttaaattgcagttgtttaattaggtaaagtgcacaggtgactttctcacactaaatggatgatgagtattgggaagagttgactaaaatttctctatcttttgcccatatccaactctcattgaattttaactcttatgagatatgtgctatttaataaataatgagtctgagttttctcccttttggaaatgtcaggaaagtctcaatgattttaagtatcttttattttataatagcaatagaatctagaatttctaaaatcaaactgagttcttgattaaatgttgaaatgcttgtcttcatccacctgggagcagtcgttgtgaacgagaagccccagtgcataaatcattgaatgatacattggagaagtctcagagtaaaggaagatttgtttacttttcagacatcctggaaggtgagcatcaaagcaggtgagtggctggctcttggattcaagcttccctgatcctttccagaagtgtatccttctcctttaagagaa[450 bp omitted]cagaggttgacacccaggactagagctcagtagaggggccgtttcctacctgcagttcccttggaagagaaggggtgaagcttaccatgttggtggtggtttgtttcctggggctgctgtagcaacgtgccaccaactggctggcttaaaacatgtatggtctcccagttctggaggccagaagtgcagaatcaaggggtccgcagggcccagctacctctgaggcctccaggggaggatgcttcctgcatccccttgctgcttttggtgttgctggcggtccttggcttgtgggcacagcactttcctctctgcctcggtgactacatggcctccctgggtgtctctgtcttcttgcaaggacaccagtcatgttagattatggctccaccctgctgcgatttgacctcattttactttaactaactatctgcaatgaccctttttccaaatgaggttctgaggtgctgcacgttaggactttagcatgtgatttctgcggactcaggtcaccccataacagtagtcatgccccaccccatcccactccacccttctcccaattcccctggtatactccagggtggctctgtggccacacatgacccaggcccactggccattagacactttggcagggtggccaaagaaattctttgtgctgaataaaattaatgtgtaaatgcggcggtgctccaagggcagtgttgcgtgaaagggcaatagaaccatggctcctgataaacagaagcctgttaagcagcaaggtcaaaagccagatgcagaagtcagaattagccgggtagactttttatttcactttcccccccttttttttttgccagtggactgccaactgttctcttaacagaagggcagtttttgagtaaatgaagcaggacttgatctgggttgtcataaattgtctctccctcaagaggtaacttctcgtgtttgccagttcagaggtgtagggagacatctctgatgtgtagatgtcctagtttggggtgcagggtggctttgggtctgagagcctgctgttggccactgggtgcgcgtgggcttctccacatgacaagacgggaatgctgtgaaggaggccgctgttccgcttgggatgttggccgagcgccgctggcctgtgtccctggaatcctctctgattcaaccattgaacattaactctgtgaggtcacagccaccagcggggcttctgagcccggccctgttctggccatagagggtcaggaggagaagacgtttcacccttggattttctgtgtttggaatccaaggcctttcccgtggagtcttgtgaggttttctcgggaagaaatgatcctctgggagaggcttgggcgcgaactgaaacatctttcaagacactgtggctcttttcagggaaatgctaagccaagcaaacatccactcagaaatgttctgtatttggaagcctcagagtgttaggggaagccttgaccctggaatgtcatctcctggtggtggcggcttcacgtggtaaacaggaggtaacctgggtgtcatgtcacccaggtgacatgacacagggccacacaggatcatcttccagtggcagtggtgaagataggggatatgatttcacatcctcattagagcccacacatgagatccagctttataattggaatcccagataatgagcatgtgaacgtccgtaagttccgcctattctgggtatgatgtcacactcataaacaagctaagcacacaaactggaatttcactttggaggaaaaaaatttcaattctgttacatgagataatacaagtagtttaaagccacagagggtctctttcgatcaggtagatctattcttctgtgctcatgcaatatgatagaagagcttcttgcatctttatgtcaagaatttgctaaaataaatcagacaagtttaggatttacctcatagtaaatcaagaactttaagcaggggcttttcttctaattaaaaatgtcatgtataccacttagacatggaaatgcttaggtaagtggagcaaattattctctggggatttagaaaaaagaaaatcagtctggtttctatggctgcatgaatctggaaggtaaattattaacccagtagactaagattttactaaaaacagactaatttgttgtggcaagacagttccagtctgtgtgctagggcttttgtttgcatgcttgcttgaaggcagacaagtcaaattaaacaataattattggcttggagggggagcagatgtattggattagtttctgtgccacatttctctcatttccaccaatgcactccagtttcagcccttgtatcagttatctgttgattgctgtgtaacaaatgaccccaaaactcagcaggtgaaaactacaaacgttaatgatctcacacaggttctgagtgtcatgaatccaggtgcagcataaccaggtggttctggctcagggtctctcgtgaggttgcagcctgcgctgcagcctttgagacctcgtgtggggctggggggtcagttccaagctcccttagggtgtggctgcagcagaagtgatgcaccatgtgcaacaattctcttggtcctgtggatcaacctggtgaatgtgggacaggccggtactggagtgtgaatgccagggctcacggggaccgaccgtctgagaagctgcctgtcacgtctctctttgtcttttacacccataaatgggcaccttggtcagagaataactccttttgagtccataatcgtctatcagaaaattctgggaaaattacttgttgatttagccacgttcatggcctatctttggagccatcagagcccacaaatggagactgtcaacagcttagcagtcagttcattagaaagtagtgttactgcagcctgggtgacacagtgagactctgtctgtacaaaaacattaaaaaattagccaggtgtggtggcgcatggctgtagttgctggaactcgggaggctgaggtggaggatcacttgagcccaggaggtagaggctgcagtgagccatgatggcatcactgcactccagcctaggtgacagagcaagaccgtgtcccaaaaataaataataaaaaaagaatgaatcacataccaatttttttgctcttaattgcatttttgaacagaaaaacagttttccctgcaatcaaatgcaaacagttcctgagcccctaatggacgagcgtcctcagctcccacctgcactataaatttgcgttaatcttccagttaacttcagaactgctgctgtctctctatgttccttctgcctcaagacatataggaaatgttggcctttccctttcaaaagaacaaaacagttgaataacctactacagtcttctgtgcaaagttagcttcaaaaattatcaagaatgttttctccaaacattcacaaagtttacagagttttcccttttactcaggatttcagcccctttgttgctcttggctctcacagcaccaagatcgtctgtccactcgttcattgggcagatgtttattgaatacctgtgtgtgccaggccctgggccctgaagtcagggccataaacacagagcacagtcctaagggcaaacgattttctcaacagggatttgaggcctgtgaggtttgaacaaatgagcctcgtgagtgccagttctggacactcggcctgacttatcggacatttcgcagattcctaagattttagaattgggagagaatctttgagatttgcttgtagcccttacattttctagacaaggcagaaagaagtccagtgggatgaggcagtgctggtgctggcaccgcctcaccctggcacttgcatcgcctggaaacaaggcagagcccactggggcccccagggtccaaagcctccaggtacgtgtctgagttctagcattggagttgccgctctcacccttgccagttgctttggcatgaagcttgatggtaccagtgtgtttctgtcttcacagcttgtggccctggccctgagacctgaggcttggatggcactcccacttcttgctttaattcttccctggagagttctcaccttccctgctttccaagtccagctgagatgggcaaccaaaatttcccaagggagaaaatagctgaaaatagaagtagaacatgaaagaggatggcttttcttttttctttttttttctttgttccttttatttttttaagttgatttatttatttatttatttgagatgaagtcttcactctgtcacccaggctggagtgcagtggtgtgatcatagctcactacagcctcaacctcctgggcttaagcaatcctcccacctcagcctcccacaggtgcatatcaccatgcctggaattttttttttttttttttccaatttttgtagagacagggtgtcactgtgtttcccaagctgttctcaaactaactgatcctcccgccttgggctcccaaagtgctaggattacaggcatgagccatgtgcctggccgagaatgtttttcaatttgggcttgttcagtggttttcacatgattggactggggtggtaggttttgaggaacgagaccccagaggtgaagcgcccttctcaccacatcatatcaagggtaggtactgtcaacctgactcaccactgttgctgttgaccttgaccactgggtttaggtcatgggtgttgggttgcgattaatgtttttccctttccatgtagtattctttcaaaatccccactcgggtggaggaggggtgttaagcatctcttcctggaggttgtttatttcggttttatgttaaaatatatcagtgcagatccattcacccatctcttgatagaaggagtaggatttttcttgggacagggatcctttattcctagtttggagtcagcttcccccattccggatggtgcagcctctacaatgtttgtctctttgaagcggagtgggaattgaaagagatttatgaaaccatctcggtatagaatctatctaggattttattttcttttcccaaatcccttgaggcaatctgtcttggttaagtctctaaaaaagcagtcaaagtggtttttgtcgaaaaaataatttgggggtactcctagttcaccattttatataatattcaattacttttcgtaaatgcaataacaaggccaactgacataagcgagtttgaagcagtcagcagtttgggtgtttcagacccaggtaggcagctgaggtgggagatcccaggggaagctcagggagcagctgcccgccttggtcagttcagccaggttaagtggaggccttgggaagagagtttctcctcttgagtatttttagaagcagcagatatcagccataaatatttaatgttgtgtttctaaactttagcgtcataaaaatacaaaaaggtgactgggcgggggttggtcagtatatacctaggggagaaaagaacttcctcaacacatcacactgcataaggaaaaccgtcttaaacgttcttagaagaaaagtcagtaggtaaacagctatcgtgtaatctgatgaatacccaccggaggaagtattagtaattattctttgcttgccagggttttcataattcttttccaattataaaaattaatatgctgtaagcagtttttaaaaataaaagtaagcatgaaaagaaaaacatctataaacccacccctagaagttttgccccagcattttggtggtgtgttttcttccaggtgtgtgtgtgtgtgtgtgtgtgtgtgtgtgtgtgtgttgccccagcattttggtgtgttttcttccaggtaggggtgtgtgtgtgtgtgtgtgtgtcctgctgtattctgagctttgtagtatgccccttccacttgaccttctccaggaagcatttgatcatccagcaacatcgattgaaaatgtttgtatgcatctctttcatgaagtacatgttccatcatttatatcacatgtgttgctggagatttcaattgcttccattttcctttaggataaattgctggaaatagaactggagggctcttgagaccgattaccatattgctttcctgagaggctgtgcgggttgcgtggcagtgaggagggacgggggtaagtggaggggctggggcacaggcctctccaacacttcatgtgaacatggtcagctgagccaggaatgcgtgacatctttatttttccccttgcatttctttaattcctaacgaggtggaatatttgatcacatttgtcagctatttgcatttctttttccatgtattagacctaagcctctttgaaaggtgttatctcaggttctttccaatattgcactttctgagtttctcttgaatcccagttattttaaggattgcagtgttggagtttcagctgaaggggccatgtctgatgtttgctggtccattagcctcctggcctgagccaaaccatgcatcttcatgtcagagctgcatatgaaacaagagctaagtccagaaagcaagaagaagctagcagattgattttcctaggtggggcctaccagggcacttctgttgttgactgtaccactctctcctgaagggccctggttgtgtactgcagttgggactgctgacgtgttggggtgttacaagagcatgcggaggctgctcctctcctgtttcctggtgtgctgatcaaaagactttttatagaatgacagttgtaggaaaagcacagattcttatgttagccaataacggattattttttaatgttattataaattggcaagcttactaatttgtttctacttgtcattagccaaagttcagtgtttcccaaggatatatgtgaatgtgtgtctgtgtgtgacatctgttgtatttttcacatgaattaattgagtatctattatgtggcaagctctgtgctgtctttgaagcactgaactgtcttatgatacacacaggatgaggacaggatcattttctatatttctgtgaagtcctttttcaaattcccattcttttgctgcttctgcatctcctttgactgctttagggcatcccaggtagaaagcttacctaatgtcaactccagttctttcttttgtagtcttcattttaagcatgatttctgtttttctttttccctttaaagaaagcttctcaaactttgaaatgaaaacaaatgaaaggagagggaaaagattcagaaattattgatagattgctaaaaacaaatgctatgataattttgggtcggagcatctgtcgttttacagcacaacagatttagcttcttaatgatgtttgtatgtttttcctcaaaagtgtattgactaggtaggagttgagccaagccttgaatgaatcatttcctgccaaattcaatagactgagcaaatcctcggagaaatggccatatttctctaacactgggttcctttcagggctcaagattccattttctctcaatactttgctcctacagactaggagtcctcttcatgctacagtatgcagtgtgtatggaaactgtgaatggagaagcagccgttcatgctgccaagtttctttcagaaggtggctccaggtggatgactttcagtctgaactcagtgtcaccaggcatgtgtgtgcccacacactgccactttaagctgtggacaaacagaacggatattctcccaccaaaataaacatacaagcaaaacactctgtcttcattcagcatcatttgcatcctataaaataatggtttctccttgatgcccacctttcttatgggtggttcttaattagttccaaacagaacttaacgtggccatgatattccacttgctaaaacaagggcagtcgagtgttcgatttgccatcattgattagacgcatgcagtcacccagtgctgtttgcccaagcatctgtaggcggggattccccagtgctgattccccaatgcttgtaaggggcaggacttaattaaatcttaaagtgacagctgaaaatgtaagggtcaggaagtcatgtctaaaaggggatttagtataacaataataacagcagtgactaagactaatcctggctcaggcattttgtttggggtcacctggtcttaattagcagcactctgggatttgagtggcgctgtgctgttgcccacaaagcccatcagtggcaccattgcctgtgtctttcggggcagtctgttagggagggggtggcacaggtgttggcacggccatccccattttatatgtgagggaacctcagccaggcaggatccttgcctggatgctctgtggggagccctgtgagtttgtaaccctccgtgcagcctgccaggtcagcggccccaaaatggagagatacagagggcaccaaattgtaaggcagagcgttggctagtgacacaagctgcctttcgatcgcctgggcgttctgaagcccgcaaacattcgcctggaccttggtcaggtgtctcacagaacctacagtaattcactgttaagaataacttcaaacacagaaaatcgctttttgtttcctagagaaggctagtcttcagcgagaacaacttgtgatttttaatctgtttcacactggtcggggaggggggaagaaaagatgttatgggcatataattaaaaatttgtcggcagatacaattacaggaagaatcatgtggcctaaaaaactgaaagcctccatatgcctcttcatcttgccagctacagtccacaaattgtagagcctgcgggcactgtggaagccagctagatttgctctatccagtagcagcagattgagagccatacatggaatttatacttttctagcagccacaggaaaagagtacaaagaagcaggtaaaatttatattacaacatcttttttactgtgtattaaattattattgtaatacctattttaatatataataatgccataatatattttatttaacccaacgtatccaaaatggcatcatttctacaagcgattcctattttaaaaattatccgcaagatattttatgttctttcttttttgtacaaagtctgcaaaatccagtgtgttctttggtcagtgatgtctgagatcccaagttccaatgtctgtctgaaattatgaaaatcaagtcatgggagatggataccctattccctacgatccacttatttcacattgcatgcctgtatcaaaacatctcatgtactccataaatatatacacttactatgtaaccgcaaaaattttaagaatatacaaaaaattttaaaaactgaattaaagagcattgtagataattgtatttttcaaaaaataagtaaaatatctggtatataacagttaaaaaaaaaactgtattatcaactctgtgaccttagaactacctttttacattttcaaagattaactctccttaaaaaaataaatgtacaaattattaccaaaaaaaaaaaagaaaatcaagtcataatgtgaaaaataatttttaagctgaaagttacactgtttctaggagttttaaactaggatagtttgtggttattaatctgtttggaagtagtccagaaaaaaatgctatgggtcaataacttgaaaatgtgcatgtggactacttaaagaggaatcgtgtggcctaaaaagtccctgttatccctccaccctgcagactccaataggagaatttccgctgctgcagactctccttggtggccaagctgcccagcactctcccgtcccaccaatggtgtgactcctatcactgagaaacagaccccttaccatttcatttccttttaattaatttaaatttaaaaatcaacacttccttggttactggaatgttgggaaccatgtgggtgtgtgcatctatattttccagggtctattttgttacctataataccagtcatgtatttccaatgaaaatttaacttgtgaattgagatatagtacaaatgtaaaatacatacactgtgatgatttaggaaatttagtaggaaaaaggaacgtaaaagatctcagtaattttttaaatagaatacaagttgaaatgatactattttggatacactgagtaaatcaaaatctatcatgaaaattaatttaaggctgggcgcggtggctcacacctgtaatcccagcactttggcaggccttggcgggcggatcacctgaggtcagcagttcaagaccagcctggccaacgtggtgaaaccctgtctctactaaaaatacaaaaattagccgggcatggtggggcatgcttgtagtcccagctacttgggaggctgaggcaggagaatagcttgaaaccgggaggcggaggttgcagtgagctgagattgcgccactgcactccagcctgggcgacagagtgagactccatctcaaaaaaaaaaaaaaaaaagaaaagaaaaagaaaactaatttaaaattatacataaggcttgccttagatttctgttgggttgtgcagatctagaccacagttgtcatgtaacaaaggaaggagagtttgaaattacaggctcacagttaatgataaaattccaacctaaacccaagaccagacattccaaacactcaagtgagtcaatctgatgatttgtaaggcttaatgttgaaccgtcttcaaatgtgatgacctcatcctaactctttccaagctcccactttgggtatatcaagaggctgaatgtggtggctcacatctgtaatctcagcactttgggaggctgagtcaggaggattgcttgaggccaggcatttgagaccagcctgggcaacacagcaagaccccatctctacaaaaaaaattagccggatgtgttgatgcacacctgtagtcctggctactcatgatgcttgggttggaggatcattgagtccaggaatttgaggctgcagcgagccaggatcatgccactgcactctagcctgggagacagagcaagaccttgtctcaagaaaacaaaacaaaaaatgaattggccaagagaagtcaaggctcatctgacttggaagggagccaggttctcagtctatactgcttttctcatcctggcagcatccccatgagataaaaatgattattcccattgtacacttaaggtaaaaggtctcaaacagatgaaataattgcaccatgactatagaaactagtaagagtcagcgcctgaaattaagcccagggctgtctcctttgacactggccaaaaagcagtaacctcttttgatgaaggggcttacttcaagctttgtttatgtgatgaaaacaccccagggctccagaaacttaacatttggttccacatccagaaaagtaaatttacaaaatggtactgcaagtgataattctcgttgacctgggattgctagggtataagcattctgggaatacctgggtttctgatcaggaagtcattcgcagctataatggtgatcctcagtcaccgggactctgggattgctagggtacaagcactctggggttacctgggttcctgaccaggacatcactcgcagctatagatggaatgctttaccccttttctcctgtgttatatgacatcggttagcaccttttaacctttttagaagataggttggaagttgagttagataaatcaacaggtagctgatggcctagaatataactttctgtagctttcaaagtgaggatgaggggcatcttgttccctaaactgcttcctcatgatggggaacctcagcattgtcttgccttgtgtctgagtacccatgtaaaattcagtatttcattcttaaaagataaaggggaagaaggaataacaatagacaaagagattccaccctagtccccatcctcattctggtgaaaagttgtcattactaagacaatcacacactcgatggagaattgtaggctgtggacaacagagccatagatggtgtactaatagctgctacaaaggacgcctctgtcctacctttcatgcccagctttgagtatatcctgtctcttgctcattaccgatgctgagttttagccctgtaaccagagtcctctttctttttccacagatgggactatgaactgtgttttaatgattagagggagtagtgaagattttcactgtgaacattttcaccccctttcccatccttggccagagatgatctcacatggtcttggcaggtatctttttacaggagtgcatgttgtttatcttgggagctttttgcacagggaaggcctttgtcttccagctctgtgaatccttcttcactgcgtagcaccttgcagaacatttgcacatattaggctcttggtgaacacttagaatcctcagtcatttgcattcacgtcatgtttccataacacattgaatgaaccagcaagtatttattgaacatttactatgtgaaacacagggaagacagccatgaacagaccagacacaaatcttacgtgctactggataaaaatgtaccccacggatgacactttgggtattatgatgccaacaatgagaacatattaaatcactttggtatttgcattagattgtgtcctgtaagtttcagattggtgtatttgccaaagaacaattgtgtgtaccccccacccaccagaaaagaatacagtaaaagtgctaaactattgaatatttttaaatggtattatatttgaaacgtgtgtttgtaattttgagccatgtaattagaaatctagggtttatttaaattcttgtttgttttagagaaatatgtaaagccacatttccctttatataaagtacttggttgaaaaaacaatttttttctaaagaaaaaaaacactctttagtgtacttttgccaattaaaagacagtacagagaaattgattcctcctggagtttgtgtagaaattagaaaacataatgcttttccctaggcatgaactcgcttaaaactactgagaagcttatactcacgcaggttgaatggagtgaatagtggtttagagaattgagctgattaataagaagtccctgattttcttttaataacacgttctgacccaataaggaaaatttgcactatgttttcctacagcgatggtgctgttaaaacttatgcaaatgggacaactttattattactaagccttttacagtatgttgctttccagggagctttgtaaatcattataattgtgtttcctcagtgtatgggttctgaatgctcctgttgtcctgtgaggtgaatttccatttggtgaagatgatactgttaaatggaggtttctaccccatagaaattaagaagagataaatgcagacagacccagcccttggaaattctgctttgtgatgaattatttccttatacttatggtgaacttttttacccgtgatgtgcacaggggcccagaatcatatatgacaagtccttccatgtggactacatccatatgacaccatgttcactagttggagccttggaaatccagtgggaatggtgagatagtgtgaacagctccaaggcaccgtgtttttaatgtaacccattcgtttctggctgaataggctagttgttgatgtggtgggcattatgagatagtgttaatggttgggccacggcatttcaaagagatgccttataagtcctgagcccattgtgcgtctctgatcattttggtcttcatttgctccccttgcccaccgtccttccacagagcattctctggaagcgctcagggagcagaacagggcaggcccacgtagaaaatggtctcttgagagtagaaggtcaggttcgctgagatctctgactcagaccacccgtacccatgctttttgttgtgatggagaaggtgctctcatatatacacatttgtgtagtaattactgcatattgatagcaatgttactgcacctgttaattaatataaccaaatggcatagctacagtgttttattctagttcaatttaggagagtatatttgttctcaatgggaattgatctggggagacccagagagtggggacatgagggttatttgtggaggggatgacacagcagcttcagaaaacagaaacattaatgcattagactgctgacctgtggggtcacacttccttcagtgatgcccataagagtcttggagtgccggaaagtataagcaacgctgagttcctgccagtatcacaaaggtgtgttttggataagagaggagccagaaagattacacttgtgtagaaagtgaaaactgagtttgagggaacagtcacattctcatggcaataaggtgggtagaatgggccgctcagcctctgcactgtggtcagctggagctggaagatggttgtggtggggctgccgtgtgcacggtgggaggtttagcagcatcccaggacccaggagataccagtagcaccgcctcccccagttgtggcaactgaaaatgtctccagatattgccagatgtcccaggatgccatagggggagcatgcagtatcattgcctgttgagaacctctggaataaataggtaaatgcatacaaatataaggatcttagtcttgcattgggaggcggcgtctgacatgtaaagacaccactagagcacactgaagtaggttctttcagagcattgcatgcatgataccctggagcccaaggagaaaatgatcaggccatgcctcctggaatcaagaaggcttgacttcacggcctggaggagataagttttaaactgatccttgaaggtagaggtaggtgaggaactagatgaaaggatcagtattaggtgggcttttaaaatattttctggccgggcgcggtggctcacgcctgtaatcccagcactttgggaggccgagacgggtggatcacatgaggtcaggagttcaagaccagcctggccaacatggcaaaaccccgtctctactaaaaatgcaaaaaaaattagccgggcatggtggcgcgcccctgtaatcccagctacttgggaggctgaggcagaagaatcgcttgaacctgggaggcggaggttgcagtgagccaagatcgtgccactgcactccagcccggacgacagagtgagactgtctcaaaaaataataataaataaataaaatagaatttttctgagtattttgtatgctgttgaaaaatttatcacttcgtagatgtatctcactttgtctatatctaagaaaaaaactatgtgcataaatgaatttttattagctagttaatctagtcagtggaatggagtattatttccagagttccacttcatattccttggtaatattgagacgctggttgtagtgaaaatactcttaattaaggcatgttgtaggttcagagtttagatggctgaatttcatgaagggtcttcaaagcattgggggtgtttggtgtacggtagtgattttcttgtgttcatttgacattttaaagtgatagacgtttaaccttgggctttctcaggactctagaatatgaatgatcactgttaactgtttagaaactcatgatgtaagcccatatgacttatggatttatgcacattctaaacagataagcatcatacaaatataacttgagttttctatgaaaggacagtgagacaccaccccccgcaagtctggcctgaacattggtggactgggaatcataaaaactgatacatacatgtcttactttgtgtttgtttgttctaagcgaaagcatgtgaatatgcagtcatctgccaatactttgtgggccagcccaggcctctgctctgaggatggcccacagcctggagtgccccagtgatcccagcactgtccacacccgcggtgcatccctcctggcttctagtttccagttaacttaagcaaagctgcacagacatctcactgtacatctctctagatttatacctcccctctctaccttcccggtcttgctgcccacacctgtcctcaagtaaaaactgattcacacttaccctgtctctcaaacattcaatgttattttcattttgaaaaaaggctgtgaccctgtgtgtactcgtacttcatccgtctgtgtaatatttaaagtttgtagttaaaatagtgaggacactgagtgaaatggggctgggagcagacttggatcggctttgggagatggtgtaggcagcgatggggacaggtggaggtgcggaccggagtgccgccctctagctgcgagcttacatcctcatgcttgggtgtctgtccttcagtttcttctccagtgccacgtcacctacctgagctgcctcaggtttgctccctgctgctgtgcacacgtaaatcagtgtctggcgggaaacaggcagacgcctttacaagaactagttgccatttatctttttattgttagacctcccagtaatgtgtgaagtctagtaattgcctgtgtgtcagactaactcagttgtaagctctacattatggtgctattaatctcttcaatgtaggcaaaatggggacagtggctcccacagcaagcccatctgctctacccatgtaagttgggagggatgtggtaccgtgtggcttctacttctccatccactttacggttgatgttcatgcttattgtaaaagccctgcaagacctagagatgctgtgagtcctcacgaaggaaaatgcagtgttccgtggggttgtgctgtccactacaggctcttgacttctgaactttctgaagtttgtatatttatccgggaactcatacttaccaagctgtattttaagtttctttcctgagtcaggcaccctccaagctaagtgctgtggctgcagaggcccctgccctgatggagcttgcctgttacttgggagacttgtagcaaacagaggaacaaagaaacaaaataatctgatgacagtaacacatcctgtgacagagacgaacaaggtgacatgggttggaggggtttgcacattagaggtaagaagactcctgtgaggaagagatggatgaaccgaagtgtgtaagatgcagccggaagagccaggagaagagagtttcaggtggagaggccagcacatgcgaaggccaggcacccaggaaactgagggaaaacacaggccaggccagcatggtggagcgagtgaccaacagagcagaggtgtgcacggtgaacaaagcctacagtgctttgccggccataatactaagaggatgagtgtggacctgaaaccccccagcagcttcctaccacactaaccagtggctggctgctggctgagggacggactgtgatgactcccactgggtcccaggcagggagataacctcaccttccactagcatagctcagcggagccaagaaggggagaggacagattcaggacactccagtgcagaatgtcagcggacgtgcatgtgtcctgccaggggagtgaaggtgtggcatgtgagcacggagtgggagggaggtgtgacttatggagactacaggctagaagagagacgagatgccatggttgggtgggtggaggtctctgctgtgggcgtgttgcgtttgagatgctgcttggaccttcaagtggccaagtcatgcagtccctgcagggataggtgaggagctatggaggttgggggctggagacatctgggatgtagacctggagactagattcgttcactggagagacccatggcggtgtagtcagcgaggggcactcaaaggtcgggaagatgcctttcagaaactcagggtgcccaaagcatttccaaaatcatttaacacctccttgcattttcacagggacttggaacctcttaggagataagaatatagggaaccagccatctggagacttctgcagagaatatacattaatatcactgtcttattctcactgactccccacctttttaaaataagggagatggcctagactaggaattttgcttaacttctatcctcctgtcctttttttctgactctgcagttttcatctgaggtagagagaaatgatgcactctgctaaattagacctgaatatctgttgtttttcttagacttgtgaagtttttactaacaaccacaagcacagtcctgaacatcgtataacagcatcatttgttaattttttgaatgaattttgtgattaaccttgatttaacaagaacacccagcccatttcccaacgacacaaattaatacaaatttaatgaaccgaagtgtgcccttctgctgccacgtagctcagttctccagggatggaagctggcctgagaatttctaagtttgacgaacattcagatgttccagaaactatcaagattctgagactgtttctaggaaaggccacaactctactggaaagtatatcagaatgacatttttgaatctgaaaagaaaaaagtcctgtacatttttaattttagttaagagtttgaatctggcttaatatattcttaacttgctagtttgaaaacaaactggtcgatgctcattttcactctcataactgtttcgatatttctgattttttttttttctttaaccaacagaggggtctttggaagacatatgtgcttttaagtttcaattttcattgcaattttgtttgtggtaaaatgcacataacattacatttaccattgtaagcatacagttcagtggcattaagtacagtcaccatctacctccagaactttttcatcttcctgcactgattctccatcccccatctccacacccccggaaaaccaccatcccactttctagctcttgttttgactactctggtgacttcatatagtggaatcatacattaattgtcctttcatatcgggcatatttcacttagtgtagcgtcttcaaggttcacacacctgtgtcagaatttcattctttttttttgtttttgaaactaagtctcactctatcacccaggctggagtgcagtggtacaatttcagctcagtgcaacctccgcctctcaggttcaagcaattctcctgcctcagcctcctgagtagctaggattacaggtgcgcgccaccacaccctgctaatttttttgtgttttttgtttgcttgtttgtttgtttctttgtttgttttttgtatttttagtagagatggggttttgccatgttggccaggctggtctcgaactcctggtctcaagtgatctgctcaccttggcctcccaaagtgctgggattacaggcgtgtgccactgtgcctgaacagaatttcattccatttaaaggccaaatatgtcattgttcgtataaacagcatgttgtttatccactcatccgttcatagacatttgggttgctattccaaaatagcttttggctattgtgaatgatgctgctgtgaacattgaggaacaagtgtctgtttgagtctctgcttccagttcctttgcatatacctagaagtggacttgctggatcacatggtaattctgtttactcttttgagggcctgccatactgtttttctgaaggtttaagtttttgtgagatgtgataaaggtagggtccaaccgtgactcctatgatttgatgcaaaggttaacccactgtatcctgcaagccaaatttagcccttgctaattttgtacaggcaacatgctaaggatatttttaatattttcagatggctaaaaaaattgaaggataatatgtcattatccatggaaattcaatgaaattcagatttcactttacatagttgaagtttcattggaacacggttatacccattgtctgttgtctatggagcagactttgtatggcccatggagtgggatttgctatggcccttcgagaacaaatttgcaggcctggcatggtggctcatgcctgtaatcccagcactttgggagggtgaagtgggaggatcatttgagcccaggagttcgagaccggcctaggcatcatggagaaaccctgtctctacaaaaagtacaaaaattagcggggcatagtggtgcatgcttgtagtcccagctacttgggaggttgaggtggcaggatcacttgagcttgggagatggaggctgcagtgagccgtgattgcaccactgcactccagcctaggcaacagagtgagaccctgtctcaaacaaacaaacaaacaaaacacatttgcaaacctggttaaaatgataaggagttcgacaaagcttacttacgtctgttgactgctctgcccaactccgtgggcttttccaagggtctgagtaggtgcatcaagctgtccacctaattactcacaccatcctacacattatttgtcacttttttgcatgtaagcaccaatcccagttgcttaagcctgcagggggcatttccttcagtaggagatgcagagtgtaaaaactccaacccatttgcatcttgcttatttcaggtacatttcctttcctgtttataattccaaagtgtggcttcctatcatgccttttaaggaactatctattcccattgactaggagataaatctctgtatagtggaggaaccaaactgaggaagacttctcaaaattgttctttttatcatacacttttttggaacgaagtttatagccaactaagaggcagtcttctatttttaatctgtgatatttctgtaaagtcatgtaaatgtcataactgcagtgttttcaagttgttgttgtttttgcaaagagctgttctctgcagtgagggctgagtgtgacttgttaaaaatgaaattcacatagcatccgtttcctccgttagcttctttcacttaaaggacatcttcaacatatcatttaagggcaacacttggttcatagtgtttaatttgttgtcaggaatgtcagcctcagaacttcttaatatacacacccaactctactgtaggtgcctatataatttacatttaacctattattttattttattttattcatgagggtgatcttaggacctgagataaatttgaacaggatcaatacaaatcaggctatgtttaaaccaggaagcagaattaaattctatttttcttgtatttgggttttgcaggaaatggggcatcgtgttttctcttttgaaattgtgtttgaagtgatatttgcatgaagaagcagcctgttttctattagactggtaaagtgggaatagtagaaaagagaaaggcgggatttgggaaatgtgacatgaagacgttgttaaataaggtatgcgtataactaaatgtggcaagaacaatgctacttagatacggaagctgctaaagtattttaatgttctctttacaaaaaaaaatttaagaattttaacatctgctagagctcaatctagtctgaattttttttctcatctgacctttttcatttttcctttctcaaacacacttgctcatttaaaaaattcagttggagaaccaagtaatatgtttccatttaagaaagccacagataaatattgttccatttgaaactacagcttcactcacttgatacttgtatgactattttaagttccttttaaaaaaatggctcaaatttatccttttgggagggactggtgaaaacgtctgcaggttcatcttggtttttaaatttttatgtgtttaattgtggtaaaaacacataaaagtttcatcttgctttcatgtttgcttttaaggtctgagaatattaatagaacaaaaggaacacaacagcattccaatgaccagtgagtgtagctgttcccactgtgtggttatattgtttttttacaagcctacatatgtggctttacctatattttaatatgtgaattcatacagtgtaactataaagcattgtgctcacttagtggcacagagaggttaagttactgactgggggacatgcagccctcagcacgaaattctgggatttagccgagaacagcctcactccaggatcatgctgcttctcagagtttgctagcttgcattgttagagtgtaatttctggaaaacaaggccatactggaatccggaggagagaaagatggcttacactgggtatgagtacagtgtagttgagatgtgcaaacaagatgtaggtaagataaaagaaaatgcaaactaggccgagtgcggtggctcacgcctgtaatcccagcactttgggagactgaggcaggtggatcacgaggtcaggagttcaagaccagcctggccaaggtggtgaaacccccgtctctactaaaaatacaaaaaattagctgggcacggtggcaggcgcctgtaatcccagctactcgggaggccgaggcaggagaatcgcttgaacccggcgggggggcggaggttacagtgagccgagatcatgccactgcactccagcctgggcggttacccttttttggttgtttttattttttattttaagataggtcatgtggtgtaacgggaagctgatgggacttagggtcagacgacctgggatcattcctggattccaatctccctggcaatgtagtaaaaggtctccttgtctttgagatgtcgggacggtgatgcagtgaggggcagggtgttagggaagactaaactcatgtaacacgaagcatgacacgtgtcgcgtgtgtctctttgtaccacaatatccttggacatacatattcctgacctggtaagatgagattctgtatgttttttgagacctcagcatcccatgcccagacactaaagtcacaggggaccatcagagtcccctagtagtttggaaattctgatcaccagtcagcaaagatatttgactgttggaaattttttaaatggtgagctctctttttctgtttcaagattcggtcatcctttctaatagtagacacggaagtctttttgacaaaggtaatgctaggccctgcactggctgacactccatgcagtgtactgtccttccatagcctgtgccgttagtttacagaggtcagtagtacctgcccgccccacagggtttgtgtccaagtgcttcatcgtggtagaagtggtttttaatgaaacaatagatttcttggtcttgcttcaagtgaaatccctgaagtgtttgctttcccgatgatttcatgctgtaaactgcctatttgtggccatggcccatgagcataaagcagcatcattgctattcaggcacataaaagccagatagaagaaaacctcactatttagccatcgtgtcagagagagccaaactacatgtctttctgggccctggtttttaggggattgaatgtcacccagaccttgagtcttagttatcagtgtcgcatatcaagaaaggacactgaggaatcagaattcttacaagggtggcaacttttattttatgaattgaaaaatattcctattcagcggctgtagtcacacaaaactaggcctgatgtaaggttccacacttttaaaaagcattgtatatatttaactaggattctgtagtcatttatattaggaatattgttgctagttgttttgcaagtttccagtagctgtaatgcaactagggaagcatttacatattgaaggcaggagccaccaataatgtacggattttaacagtaattagggtatctgggaattgcacaggtttcattctcgaaaagttaactgaattgcacagatcaaaagtgaaattgattcactcatctaaacatgcactctgttgctttcttggtgagaggaatgacccacctacttggtcttcatggagctcggtctcctcatctataaataatatattaagtgttgatctaagaatctatgaatctgaattttacataatgagagagatgtacatgtgagtgaaaagcaaaaccctgtgataactcatttttgttccagctacaatattgtggactctgtggactaactatagccaagacttatctgagtcaggaaaaaagtatcatagaaaatccaaaaattaattgaaggcagttgtttgtaggtacagcccaagtgactgcataaatttcacaccaactaaaagtgttaaagagtaacaagatgaaggggttagaatgatttgtgatggatacattgtgcattggaaattgtttgtaagacttccccaataattgtgtttcagttgcccaattcctgtttattctcattgtgcagaagtaagttactactcccttcaatataaattagtgtaaattgtgaattgctttcgtctaaaacaatgagagcacccaacatgaagccaggacttggggttcaaatcctactacttgttacctgtgaagccagcctagattgttcacttacactcttcagaaagcagcctctttatctacaaaatgagaataaacagggctgatgtgatggttcagttatataatggacataatattaaatagactctttctttctgaatgggaaagtgaggagttactgtatttagaagatgcataaccagccttgctgttcaagaatgttaggaatgaaaacagttgatatgtggttctcatgactcaattaaaagatgctatgtttgtgtaaaaattaagaatacatttctgctgaacttgtggaagaagcttagagcagaggctgcctgtgcattaagactgagaggacttggaaagagaagatttttaatgttttccttttacattagggtttcctaactgtggcactgttgacatgtagggctggagaactatctgtgggaggtccttcctgtgcactgtaggaggttcagcagcatccctgggcgtcccccactggatgccagcagcaccctctccgtatggtgaccaccataagtgtctccagacattgtccaatgtcccctggggggcaaaatcacgcctgcttgagaaccactgaaaatttccccaatataaacatgcattacttctgtaattttaatagcaacttaaaaaaaaagatgtcatttccaaactgacaaggctagtctgtacagcttcacatattgaagactcagaagagttggactttttttttctttttcttttcttttttttttgagacggagtcttgctctgttgcccaggctggagtgcaatggcgtgatctcagctcactggcaacctctgcctcctggattcaaataattatcctgcctcagcctcccaagtagctgggattacaggtgtgtgccaccatgcccagctaatttttgtatttttagtagagacagggtttctccgtgttggccaggctggtctcaaactcctgacctcaggtgatcctcccaccttggcctcccaaagtgctgggattacaggcatgaggcactgcgcctggcagacttggatgtttttacgaggcgttttgggcttgtgttctgtaagcatcagcttaacagaaagtgatgttgcatgactgccccaaagactcctggtggcagctgtgaaagcatccagggaccaaaacctgtgctgaggttgccctcaggcacctgtgggcctgtcagtggggccattctaagtaaccaagacaaacctgctctacttgtggaatacggatcttcttcttctgcatgttagttgtctagggtcaccttgatgatattagtaggttatctgttctactttagtaatgtgttaggagtgcacagcttaatcaatctaatatgatactgctctaaggtagggctcagcaaactactgcacacaggccaactggcttgcagcctgcttttgtaggtagttttattggaacacatacacatctgtttgcataaacacacccatttgtttacagattgccagtggcttccaggtacacgtgactacgatggctgcaaagtccaagatccttgctatttggccctttagagaaaatgtgtacctaccactgctccatggttctggaactttctccccttctgttgccatatctaggtatatctcccatctgttaatctcagtttcagaaagggggaggatagtaaacagcatagccaaacaagacaaattatgatagagagcactgtgaatatttcaactttattcagtgcttttagtgagtatgcgtgtgtttctctgcatatcagatgcatgtaacgtgtaccagagtgtatttattaaaatgcctggctcatgtacttgttcatgaaagaagcaaaacaccatcgttttccttgatttaaaaaaacggtagcagcatttgtgctggagaactttgatagaacatggcagttgcgtgtaggatattggaccagacaggctgttggggccagagttttaagagggtttctctagaaacagaccgtactaggattacatgggaagtgagtgtggaatacttcgggatcgctgatcgccggttgtatgggagtgaggagcaggacggggctcagtggggagctttctggaatgccagtcccgctctttcctgcatgtctactacccccgtccaagcacttccttggctctagtatgtcctcatgagcagggcccatgacttcccggtgttatcttctggataatttaatacagggttcaggatatttgttaagtcccataaaggtgttttaagtgaacagctgaatggcaacctcagtttgatgatgctctgtctcctggaggggcctaatgtctggctgtctccagtctccttctaacagaccggcatcatcgtgtcgtgttaagttcgcttattaattctctaccaaaggcatctgcatttagtgtccaggaatcactcgatgtttcgtttctttttatgttttctttgcctccgaaatatcttccacagattccctaaggacgtgaggaatggaggaagttgtgaaggaggagaactgtaagctgaatagaatacagtcatccctcggtatctgtggggtattggttccaggacccctgtatataccaaaatccagggaggcgcaagtctctgatataaaatagtgtcctatttgcatataaactatgcacatcttcctgtaaactttaaatcgtagattacttggaatacctaatacattgtaaatactatgtaaataattgttatattgtttttaaaattgtttttattgtattgtttttattttttaaaaatattttttttctttctttttttgacacagggtcttgctaagctcactgcagccccttcctcccgggctcaggtgatcctcccacctcagcctcccaagtagctgggactacaggcgtgagctaccacgcccagctaatttttgtattttttgtagagactgggtttcacaatgttgtccagactggtctcgaactcctggcctcaatcagtcctctcgccttggcctcccaaagtgccgggattagaggcgtgagccaccacacctggccttaaaaatattttcaatccgtagatgcagaacttgtggatacagagggctggctgttcatattttcaaagactatatatcaacaacatataatcaatatataacatatatgagatatatggataatatatatatatatattcagtaacgatatacatgtattcaaagtagtaggtttgttatagacagcatagagaagactctggctttttaaatccagtttcacaatctcggcctcttatttattttgctttgatttttattttatttttgaactttttaggttcaggggtacatgtgcaggtttgttacacaggtaaactcgtgtcatggggggtttgttgtacagattattttgtcacccccagtattcagcctggtacccaatagttatcgtctctgttcctctccttcctcgcactcttcacccggcagtagcccacagtgtctgctgttcgtgtctcagccttttcgctggagtggttataccatttaccacttgctctttgttttctctttgtaccacttactctgtgtttcctttttcctcggttcctgtgtgcttttgcataaattgcggcttttttgtgactatacttcacagtaagcttattagcaataactcattgctttattttttagggtgttgctctagtgttgacaattttcatgtttaaccttatcacaatctatgtttgaaagatattttacttcacatataagagccttacaacaacaatgtgctttcattctccttccattcttagtgctttgtgctacatttgccgtatgttttacttttatacatgttacaaacaccataatacgttgttattaattttgtactaagaagtcaattatatggaaaaggattcttttaaagagaagaaaatatttttatgtttatatttactatttctgccacttatcatttctttgtgggaatccacattttccatccgaagtttttcttccccttcatggactcccttcagtctgtcttgtaatgcaggtctacaagaagtgaattctctctgcttttgtttctttggtaaagtctttattttgccatcattctttgaaagatatttcatctgagtgtagagttttgcattgatacatcctctcagttctttaaagatttcattgtcttctgccttgcatagcttttgacaagaaatttgcagtttttactatcatttttcccctggatataacttttgggttgttttctggctgcttttaagagtttgtcactgattttcaagaaattgattgtgtcttgttggggttttctatgctgtttatcctgcttggagtttgtttagggttttgaatctgttttactttccttaactgagagttttacaacttgatttgatcttggaatccttaaaatgcgtttttggtttttgtggtttttttgagacagtctggctctgtcacccaggctggagtgcagtggccgcgatcttagcttaccgcaacctccgcctcccgagttcaagcgattctcgtgcctcagcctcctgagtagctgggactgcgggcgcatgccacaacacccagctaacttttttgtatttttagtagagatgggatttcgctatgttcgccaggctggtctcggactcctggcctcaagtaatctctccacctcggcctcccaaagtgctgggattacaggtgtgagccactgcgcccagccaaaatgtgttttaagtaacatattttatcatctcagtactagtgttttattaatgaacactaaaaccagttagagaaacactgatgaaaaccagtgtttattatttttacatatttttataactccatattggctccttggaccttttagagttgggttacgagaaagcaattgggcatttgcctggtattatgtagagggtatgcaaacacggttagcttgtggaaaagatatcagtaacaattgcctgtgtaaccgccagctttatgggagtgctccagtagtaacatttttgcttgtttcagctataaaagctattaccacaatctgtctctctcattttgtacagtaatgatccatgaacatactaaagggaaattgatggcatacccagggttaccatttacagatggcagtactgaaatgttaatttcaaaaacattcaaactgtagttttcttctgtagacatgggacaagcaatttttatcatttaatcatgcagacttggttttaaaagaaaactcttttaagatgttctttgcttttaatttatagccttctagtttgcttataacatatatgcttatttttaaagaacattaaaggttaggcctaaggaatttgtgtgcaaaattggtcattgattattaagaaaataatatagaacctttttttatgtcataaatacaactttaaaaggaaggggactcttcagagttgcctctgaggagcacatatgaaaaagaagggcagaggtttactgcagtggtaaaaaataatccacctagatcaagactattccaaaagtgaatttaaaaagaaaaaaagatgagatggtaagatatgaggaaataatgaatgcattgtgactttccacctccccatacccattttcatagtttggtgagtagaaagagaaatgaggatgctggcccaattttgattcccagtggatgaggctcacacagaactgccctgcttcttgacactattatgatattaaaagtaacttgtatttttataagttattaccatcttggcacacttgcattcattttagtcaagtactgtcacctttagatttcaagcttgcagagtcttaaaaaaatacacattggagaacacatagtcttttaacagtaaaatctcagcttattagaatgtttagtgactgaggtattcagagtcagtcagaaaagtatctttaggatttcagcatgtggagatgtctttcatagagaaaccggggagagtcaggcaaaccctagcacgttgagcatggcgtatcctcatctgcacgggcacttagacacctggacaagtccattagcagtaaggcaggatagaggggttcacaggatacgtgctgcccaggatacgtacgtgcagcccagagctgggaggaaatcatgaggaccgactagacatttattgtacagatgcatgactggctggtatggcctgggatatgtcagtgaagatacaccgtgaggttgtgggaggtaggattcacagtaaatcctaaattcttcatctttgcactcacgacgcacaatagctgatcaaagcttttagcaaactgcagcaaatgaaaaggcggcagaacctcatggtgacaaatgcaaaccctggagtcggactgcaagcattcacaccccagctccaccagtccccagccctaggacctagacatggagctgcatgtcagtgtgtccgttccctctgtgtgagaacgggatagtaacagcgctccctcacacgctcctgtacacatggaaaccaccactgccgtcggacacagtgtatgctgtagaagcacttatggtactaagcacattaaatatttaaaattattaattagattatttaatccaagctcaaagctctcagaacagagccaggcatgtaacaggtacaatatacatgttagctattattattattatttaatagagatggggtcttgctatgttgcccagactggtcctgaactcctggcctcaagtgatcttcccacctcggcctcccaaagtgctgcaattacaggcatgagccactgcgcccagcctattattttttaataactttatgtaacccggtgttgccaattgttttgaagtgtggagccgtttttcagatgacacatactaaacatctactaaacagcctgagaaacggcactctgaagagcatgccttggcaaacactcccctacttactctaaaactccagtcgattggcttccaagttcacttggttctcatttttcctggcaacaactctgcaaattattacccccatttgatgaggtgctggctgagaaggccccttgcccaggtatgtttccgacctgcctgtgacaaagtgttagattctgaaagccgggagtgctggcctcggttagctgagtgataccagcgtggggtctttcgaggctgcaggcaagatgtccgcccacctaaaggcaggatgggggctggaggggccgtgtcccggcgcctccttcctgtggctgctgagttggtatggctgtaggcagggggcctcagtcagtgttgtaccgtgctggcctcgccacgagcacccgaaggaattttatcatacaaatttgattctgttttatcaagagatgccagtagcacctccacttccagttgggacaccccaaaatatctccagacattgcctaatatcccctgggagatggcggggggtgtggggagggggcggcagcgggcactgtctcccctgctccagaacactgtattgaaatacagaaacgtgatgccaatcccatgcttttatttgggattaaatgtgtaatccatatgcttctgagtgggaaaaaaaaaaacttggctccaagcagaaaatggtgcatcctttgttgtcattgggcaaatgcttggtagggatttgatctgtgtagaggaatgctcagtctgcagtggcagccaggtagtgagcatgtgcggccctgcacacagcatgagcttgtcagacagacagtgcttgccaagcagggctctggcatgcgcttgttgttggctatggctcttccatgggcaggctcccggctcctccttgtgcatccatcccctttgttggccaccctgcctgctggccttaggccttctgctcctttccccaggtcctggctctctccagcttggcctccctccgcccatcctgtgcacctttcattcctgggtaggaggagactcaggtaaagaaggataaaggcagaacgatgccaggcaattccactgctagccattgccccaaggacatgaatgttcatagcagcatggttgacccaagccaggttcctgtcagctgctgcctggaaaaacacaacgtggttcagccacgcagtagcatagtattcagccataaaaggagtgaagccctggaacgtgctacaacatggatgctctgggaaaacatgctcagtgaaagaagccagatgcaagaggtcacatattgtatgatctcatttagtgccccaaatagggaaattcatagagccagaaagcattctgtggtcaccaggcctgggggaggagggaatgggagtgactgcttagtgggcaccagaactcctttccaagtgattgaaaatggtttggaacttgacataggtggtggttgcataacatctgaacgtaccactaaattgtacactttaatttggccaggctcagtggctcacacctgtaatcccagcactttggaaggctgaggcaggagcatcacttgaagccaggagttcaagaccagcctgggcaacatatcaagacctccatctctatatttaaaaaaaataagaatttttttaaaagaaaaataataaaatggttaattttatgttgttacttttattccaactgaaaacaaagcaaaacaacaacaacaacaacaacaacaacaacaacaacaacaaccatgtatggtccaggggaatgtctatgttgggcctgaggtgtgctgttctggtttttcttaggtgaatgggttctgaaggctgcatcaaaagaggagtctttaaagttgctaattctttcctgataggaaaagaatataatttctcaaaatgactgctttcgaggaatgcccctttctgaatttgaaaacatagtattaaaaagaagagtctctcagtgctttagattattatttcttgtattcgatgtaaaaatcccttacagtggttttacaagtctgcagaggaattcacaaagcacgattgaaaagtgatgtacaggatttatagttgaatgggaacaaaccagctgatctgcatataggatgaaatttagctgagggtgctattgagtttggacaacatttggctggacctttgtaactcttcagctctatgaaacaatagttgtgtgaagaattaaaaggtggaaaatgaactgtaggtggctggctcacatatgcctaggtctatttccagacacagcgaacagtgaaatgacagtgtcggtgaggcaccagttcaaggaaatacacaaagactgcctactcataaatacagacacaatggggtgataactggtgcttgcacttggagatctagaattctaaaacatcggaaaacaatagcagaccattctgtgtccttttctttaaaactatctcttgaaattttcgtgcttcccccaagaacatcctcaaagatgccagtaaaaataactccacaggaatctttctgaattccaatatccatgtgaaaaggctgcattttattctgatttttcacaatagaattaaggcagacatgatgaagaaatgaatgtgtagaggacttccgaaatctgtattaacgtgtgtgatcagcaactgtaatgttttgattgattatatatggtacatctttcattcattaagctaactttaatcaagtatgtgttatgtgtcaagcctggactgtagaaatgaacttgaagaagaaaggactcttcctcctgttcgggtagaaaaggtataatgcgtgttatggatggtgtgaccgaaggaaacaccggataccatgaggaaaattgagatcatcacccagggattctgtattctacttagggaataggctaaacatcaaaatacagcaatttgagacaaaggcaggcggtagtcccagaagggtaggtgtcaaatccccaagagcatcggcggatccaggttcctgttgtgttactatcctgccttcctaagggtcagacaggctctcaagcaacccccatgaccacaagttgtgcacatcctttcccagctcctctcacctaccattggcaagaactcagtagtggaacacctggggtctcttaatgaggtgtgcttgtgtgactaaaagaaaaagaaattttgggggaggagcaggctggtggatgtgcagtttctaaattatcttgtattttatttgattacagtgtttgaattcagtgttttgaagagatgtatgtagcactgcaagctctattctaacctactttctttggagaagcaggtacatgctgtgttgtgtcagcttagagagccccttcaaaacctctccatgttcaatgtggagggactgtcactatacatgcatggcacaccacaccaagaacagagggctaccagaaaattagaatcccttttatatttgtcacatatcagcatttatttagctgtaaaaataaacagcatatggcatttgttaaaatcgtttgtatttcacacaaatatttggcaatatgtaaactttcttgccagggctgtttattgtggttctatttgcatactaataatggggaaatcagtaatgaccaggtgttggaaggtctgatttctcatttaaatgtattgtttctagcaataaactaattatttttgacatgtttcataaccagaagaatgttattaaccaaagtcataattcctatttttgtgttgatcacacacagatgataagttaattatacttattgaatttaacaacatatataagagataatctcaaatttcaagactctcatttgtgggttaccatctgttttggaccaaagaataggaatttgattgcaagctttcttctgaacagcttgtaataagagctgtttgtatattaattacttattgaattattgtggattttaatgttttaatttacaagcaatttggaacttattgtggtgacagctgctcatattttgatactttatggtatttagcaatttcatcataaggctattttttcccctggtaatttataacccaatcctgaaaacagtaatttggtctctccagctcactataaggagtattgtcctgtttcatccccactgcagatttttttcatagttaaaagtatattttataagcaaaatcaagattcctttgtgcctgcttccctggtgccctttcatttctattcagagttacagatgaatttagtttcactctcattattttacttcagtggtagattttttacaaattgccctggttattactttcatcttgaatatccttatggtttttgttttcaatgtactgtaatgcactttaggggcctgtgaacctgcttgtaggtttttttttaatctccttcctttaaacaacataactataaacatgactcagtgggaataatttgcttgaatttccttaaaacacttgagtttctatataaactccctaataagaaacaccttcactcatagcttcacttgtggacttcaattatattaaacctggtacctttttattatcactgaagactattaaataagaatttagagaaaatggtggacatttaatttccttagttcttgaattcgtagatgatagaggataattgatactctctaggaggcaggaatcattcacaaccaaagaaattttataaggtaaatatcattaggtaaatggtttactgattagtgtttatagtgactgagaaataaaaacaatttttgatataaaggattatcattttatgagccataaacctggcttcctcataaatcagtgcaaatggaacacttgtgaaacagaaatgtctgaagagtaaatgaaaagttgagacgttagtgggtgcctttggttttcttgattttagaggagccggaggagaaaggattctgacccgtttgtgtgtttttatgagcacagtacatgaggatgcatatatgcacacaaatgtgcctggtagagttattggaaagctagcccaagcgatggggaatgtttagctaaagcgtgttgtcttctcccgagggtgtgcacaggttcatgtatcagctgaataaggccctgttccaaaaactgatatttcaagggaaccttaatttatctttaaatttaatgtaatttaaaattaatttaaatctttaaattatctttaaataatagcagtagcaatagctgagctaacattaattttatctattttgagactcttttatttcagaacttctacatgcataatgcctgaccggccacttttaatttctcctttctttcactttgcaaacaaaaccttacaatctgtgctatggactaagacagaaattaagaaccaataaaatgtgttaagttttaattaggaagaagaaaaaacctaaaggaacgggatggttgagaggtaaacacaccccaatgatttttaagtcttttgtttcaaacctttccctttctccctaggctggtccctgcagacggcttcccatttttatgaccggatgctgggaagcctgctggtccacaggtccatacatgaagtcaccataaggtaagcagcccagcatgccattggatccttgcccttgtacctgaaatccgtttgaggagcagaactgcattttcccaaaatggaaccccttctgttttaaatgatgttgtcaggggaagtgcccggtctttctccttactgaaggttgaaggtagtagacagacaatcattaaatcattgcgagctgcatagtcaattccaaatgagaaatttgcctttttactgacttctgagaattttgggttgtgtttttgttttgttttgttttgtttttgtttgtttgttttgagacagagtctttgctctgtcacccaggctggagtgcagtggtgcaatctcggctcactgcaacccccgcctcccaggttcaagcgattctcctgcctcagcctctcaagtagctgggattacaggcacctgccaccacacctggctaatttttaaaatagtttcagtagagacagggtttcaccatgttgtccaggctggtctcgaactgagctcaagtgatccgcccaccttggcttcccaaagtgctgggattacaagtgtgagccattgcatctggcctgccttctgagaattttggatcctgaaggagctataacaaatttttctgggtcttaccaggcgaggatgacaccttctaaaatcaacctctcttgtcaacattatcaattacaattatgcagacaagttaattataattgggtgcatgagtatagattttatttggctcctatatcttaattctatgctttatcagtttcttaatatgatttgtgtctgtctccaaattgatttgctagttaactttgaaacttattagaaaatcatggagattactatgtgtaaatctggtgagatgctaaggtttcctgactagcacaccaaacaattgtatgtgcacaggtgtcaagagttgagaagcccgtagcccaaactaaaactgagacccatgccccaaaagttctgtaaaagttatcttactacctttcggtacgtgtgattttaatttcactttacttaattgttatttaattttctgtttctttctctaatgcctttttagttaaaaaaacaaacaaacaaacctgtagaacttgggcagttttaaagtgtaaagatagaattttgaggaagctttttgatttactattttaagagaaccaactagaactaaaatgatagacttaaatttaattaaaataagcagcttactgtttgaggtacttttgtttaaagccagacatatgcatatgtaggttgttttaacaagttaaatatgtataagtattttaatgaaaggtgtagtctgtttataaaaacaaaatttgtaatgtattagtgaatttgaattttctgactggctttttcactcagtataatgttttcaaggttcgtgtgcattgtggcatgtgtcatttctttttatgtcagaatattccattgtgtggctagaccatggatagaacatatttgattcatgcatcagttgatggaaattggagttgtatttcccttttggttattattaaaaatgatgtcatgaacacacatatacaagtttttttgtgtggacatatgtttcatttctctgtggcatttacttaggagtgggtcatatggtacctctgttgaacattttgaggaactgaatttttccaaagtggctgttacaccagtcaatatttttcgaaatgccattgaaccatattttaaatgtcagagggaagcagggaggggatctttctcttatcaatgttttgagtgggtattagttcagtactttgggaacataagcttcaatttcattgaatccagcacacattggatttctcctctgcgtgaggtatctgtgtttggctttatacctcagtcatttatacatgactgagtgtttttgtagcctttgataacttgtatggtttatacatgcagatagtcatttggcattatcctcaaaaatggtactctattgctgtagttcattagtaaggttgggaataacctacataacatactctttctgcctatgctgcgtgctgcgtctcagaaagtgagggcttctaacggtttccttgaggtgtgtgtggtttcaacacatgtcctcctttcaaaggcatccatcgcagaccctggtgatagtgttttttgtatctcagtcttaaaggggttggtatggttatgaggaatgttcacattcaggggcgttcactgttgaagttctcaggcaggaagattccaagccgagaagggactaggcagtccgttctcggatgtagaggtgggaaaatctgtggtagagcaggaaggactgagagcaggctcagcaagcatgttctgtgatgggcccgatagttaggggcttaggcttcgcgggccaggcggtctgtgcggcagctgctgtactctgccattgcagtgtgaaagcagtgtaggccctacagaaatgtatgaacatggctgagtgccaagaaaaccctatttatagacactgatactgggttgcagtttgctgaccctaacctagaggaacacaactgttttctttccaccttttctaattgtggccttttgagttggaggccacctggaggtgaggctccgagaggcccacccaagggccatgatgtgatgaagacagactctaaattgtgattacgtagcgaaggcactgcagatatttgggggtcaggacttttacgtaaggaatttgagggcctttctgccacataagagggagtggctctgggcctgtgtaactgccctaacttgggttctcaccctgggggagtctccacccccaagataacctgggaatgtgtggagacatgtctggttgtcaccactgggggagtgggtgctactggcatctagtgggtagaggcccgggatgctgtcaaatgtcccgcagttcacaggacatcctccccaacccctaaatgtcaaacgtgaggagattgaggagtcctgctcaccgctgcttctgtcagccctttattttgtacttgttgtcagtcatatggctgtggaattataggctatggggcattaaattacaaaatttagtacctgtgtttgctgacataagtgtaaggatggttggactctgatctaatatttgggttcatgatgcttttagttttttccttttttaaaaacgtctttgtcattcatttaaatataagcctccaaaattgatataggccaggcacggtggctcacactttgtactccctgcactttagaaggccaaagcaggaggatcacttgaggccggaagtttgagaccatcctgggcaacatagtgacacccccatctttacaaaaaaagtaaaaacataataattagccagaggtggtaacacatacctgtagtcccaactgctcaagaggttgaggcaggagaatcacttgggcctgggaggttgagccttcagcaggctatgattgcaccactgcactccagcctgggcaacacagtgagaccctgtcactaaaacaaaacaaaatgctgatataacactaagatttatatgagatccaggccacattgggggatggggcaccgcctgcctttcgaactgtagggtacgcttcagagtttatttttcacaacttcacaggccacatcatatgtgtaggtgaacccactgctgactccatctactgccagaaagagactcatcatggtcaaattaaattcttcatatgtcagtgaaaaatcagtgtcttagagatatcatgaccagagtgcatgtattcctgaaatttgtttgaaggcccggtgcacattgtgtagaaactgtgttcagtctatctaaaagataattaaaatccataaattaatttctggctggaaaataggtcataatggatctggatatcagaagtgctaggttaaagaccacggtcatcaggaaaataggatgagctcctgctccgtggaagcagtagcatcagtgccttccaaggcagtctgctctgaaatcttgggcacgtgcatctgtgttgaactgtggccagaggaggagaggatgaaagggaggcagtgctctttttcttacatgcattgtccggctcatgtgatgtgggtttccctggtagtggcttgctcttgctaggtggagcattttcaagagggcttccttcctgtcaccatagcatctgccgttgacgtgcatgtgggctttggatgaaagccccagccagccactaattaacccagaagggtggcagggcacagaaaggaccttttctgaatgcctcatcatggggattttttcttttcttttctttttttttttttttagatggaggctcgctctgtcatcctggctgcagtgcagtggcacaatcttgggtcgctgcaacctccatttcccaggttcaagtgattctcctgcttcagcctcctgagtagctgggattacaggcgtgcgccacaacgcccagttaatttttttgtatttttagtagacatggggttttgctatgttggccagtctggtctcaaactcctggcctcaagtaatcagcccgcctcagcctcccaaagtgctgggattaacaggcgtgagccaccatgtcccgtcagggatgattttattctgtgaaaagcggcattccttttctaacacaaaacctctcctctgctctgccctcccaaccctgtagcctcatttcctatatagttgttttcatactgattatctctgaagacattgccaggtcgtttttgtttgttttgagacaaggtcttgctctgttacccaggctggagtacagtggcacgatgtcggctcactgcagcctccacctcccagggtcaagcgattgtcgtgcctcagactcccaaatagctgggaatacaggggcatgcctccacacctagctaatttttgtattttttgtagagatgggtttcactgtgttgcccaggctggtctcaaactcctggactcaagtgagcgaccacgcccagccgacattcccaggttttctttacgttttaataaatatgagtagtccatgttcagagtagaaactatacaacgtgtagaaagatacacatgcaattgggagccgtgcttttcccacacagtcccctgtcatggacattgcccctgcctgaaatgctgttttcctggccgcatcttatgccactagtttattccatatttaaatggaggcgtcactgctcggcattggaactctagtaacgaagaaataattctttgattatatttaccatttcagaccattgactccaagtaaataaatataaccgtaaaactaatgggaaattttttactttgcggggaatattttcgtactgaaagtattgtatatctgattgtgggtaaatggagagaagtgtatgaaagaaagcaagcaacataaaatatttttatgcatttctccccaaacttttcctctgtatgtgttttcctacaggtttgggtcaaactgtaaccttgttggccctcttttctgttttgttgtcgccccctgccacccaatttgggacatatcataaatatctttccattaacctagctttgaaatttttaacttgcactggaagaccacagcgtttaatgtcaaacaacgtaactttaaatcctagcttcgctgggatttaagttggttatcttccctaagcctttatttgttaaacctataaaatggtaataagagtaatggtcatatttatctcttggagttatgactggtgagatcgatcgtatcgtgcacatagcactcacacctgatagctagcatacaatccatgccgtgtattggtttctaaaatcatcttcatggcggcctgatagttcccatatgtgttcactgcaatttatttcatcgtgctgtcactggacaatgagattgtttcgagaaccacacattgtcttctttacaattacataggatgaaaagatgtgcaaagtggtaaaacaagcctgtgtcagcccccaaataagctgctccccaggcagatgttagaaaaggtgtattgggatttatatgtaaactttatacatacatttaaaattctgtcttaagctggttactgattgtgaaatgaaaataaactcagtttacatctgagcagagaaaagagccgctgcctccaaatgggcagagtttgctcgtttccatgaagcaacttggagaaagaggtgccctttagaggctgaggtcagttcaagcagatcttccagtgaccctggctcggtccagtctgcatggagacaagccccaaagacctgagccttgtccaggccatccctccaagcaatggattcttccagcacagacgccaacagcctgactaatagcagcctaactaatgacactcactttctcaggtgccttcagaaaccaagggctgctttagaagatctttaagatgtttacataacagggcaaatggctgaaagataaagcttcccctccagtgatgtcagaggagctctgtgcgctgcccttcctacaatacacgcccccttcatcagctcgtgcttccttcgctgtttcagaacacggctggcctcttggcaagaaacgaacttgccctttctgtccttaactaccagcaccagctctccagcaggccccatgtgattctactttttaagataattaaaacagcaattaagattttgtttggggccagtgttctcccacagaatgatggcatattgagtgctctaactacatactcaatgaaatgaaactcttaaacagccatttctcctgggaccgaatgctgaactgttttgtgaagggaactgcgaattaataggacttttggccaccttgaaaccaaggcttaaaaaaaaatactataaataatctccccttcagcttcttgacggctctaaaccccaaattatcacttatattgaattacttatctttagcagagaaacttcaaaaatgccatcagcccatgctcgtttgttcttctttgccttctttaagcagcacagtgagagaatgttgtggctttaacccaaagtggaaggtggttatttcgtttttgcgcaatcacaactccaaacacctcaaatcaacctaattgaaggtgtctttaatcaaagctgggtcaggcaagaaaataaacacagttgctctaattaagactcccctctcatccccctcctgtttggggccaaggaggagctgtgagtgctgccaaaactctcctttattttagaactggagaaattggaaaacatccacaggagttctcagaactcgaaggctggaagcggatgctgttcgggaaaccggttaggtgttagaatgcggcttgtgtctccagctgtacatactagaaaagaatgcccaaacacaggcctctggtggtagttctttttggttgggctttatgtgtgccaccttgcctgcttgacattgctgatgagccaggacgaggagtcgagccctgagtggtcatgggcgaggcaggtgtgtgtttccctgatcctctcctactgacctttcaggtctctcttggggaattgctggaggagctaaaataccagctcccacatactggatattttctgtgcatcgggctctgcataaaagcattgactcctcacactctcccctttacataggggctatttgatactcagtttagagataaggaaacagccatataactgaccctccaatcccagggctagatagtggtgcagctgcccctagaagtcagggtctctggcgcttggccaaaggctccctgaatcccacatctttacctgttctctgtggctctcaggacgtgagctaccttatctctagccaataagcctatacggatggggactctcaccctgatttaccctaactttattgtaataaagtcataactgtcataagaagtaatagttgcaataaaaagtagtaattgtaataaagcatgaacattccaaactccatgttatttgtccacaaaaatagttcttggcacagaagacaaaggcggactttttcccacagaatacatagctgtcgatggcactttgctttgaaccttggtgtagagggcagtcctcatgccctgggctgaggggtgcatgtgacacatcattaaaagtcaaaaatcattttcatagagcaggtcctccccacatgtacacccagagctcctgtgcttctctcctctttctctgacttcttccaaaatcgtgggtcttgtctccatcagtcaagaatttaacttttcttccaaaacatccccctcctcttctgtgaaggaaggtgcttgtggactggccttaggaaatgtcgcccagacaggaacggcacaccagtgtgccatcactcaagccagaaatgaggtttgcagtgaccttctctgtgcttgagagttctgctacactacgaataccactataataacagcacatttatttgtgggaaattaaacagcaaagccctgggtgggagatccataatttaccatcttcctgtgaaatttagttctggtcttagaaaaaagaggaggaggaggaatttttattcccagccttgtgtgtggtgaggtttgtctggaacagtggttcttgcagaggaatactggccaggagactcacttgagtcaaaaaactgaagaagatccatgaaaacaaccaccaccttcaagtgagccacttagagataagcgcagctaaacgccgggacacccagctgatggatggtttctcttgattttggtgtgatgaagcccacagagctgaagggcattaaatacagctgttagggttaggagtccattcagagaatattctcatgcttgtatctaataatctaagaatatatatgtagattctacaatttttggaattaggttttaaaagaaaaataatcatttaaaagctagcaaagtaagtgtttgttgggggagaaaagtttgatccaaatattaaatcagtcttaaaaaattaaaatatgtacttgagatggagcagtcagtcttaccaaacattacatcctggctcgattgcaggccatggatagtttttgttttgttttctcttctgcttagaaatcaaaaccctttagaaagttaacaatgtattggggaaagcattccaatccttggaccctaacttatacatttaaaaacaatgaatctgtgatcagaaagcagaaagccagagctgaagcagaagtttttctagttggaagaaagaaagatgtataatgcaaattagaggaacagataattaaaaatggcccgtaatccccatctcctcaggatcttatattctcattctccatagttctatataaacacatgcagagacacctgtatttatcacagatgctcctggggtggggaatattaaccaggctgtgtatacaggtgtttcatctccacgaatcagagtatctgctcttattttgaggcaagatctcactctgtcacccaagatctcactccactcactggagtgcagtggcataatcatggctcactgcagcctcagcctcctgggctcaagcaaacctcttgccttagcctcctgagtagctaagaccacaggcatgtgctaccatactttgctaatttttaaaatttttttgtagagagggcatctccctatgttgccaaggctggcctctaactcctaagctgaagcaatcctcccatctcagcctcttagagtgctgggattacaggcatgagccattgcgcccagctggtaccttttcagtggtcaggtcaccaagcagcgtctgagcctgcaccagttgccttactttataaatggagttcatttcaaacacaaaatgcttattttccctctaaagagcaatggttctcggccagctgcagttttgcaatgtgggacatttggcaatgtgtgcaggcatttttggttgtcaccactgcaaggaggttgggggagtccaaggatgctgcagaacatcgtgctgtgcctggaacaggcttgcttttttttttcccccagagtaaaagaggaaaggagctaggcatggcaaacaagaagggcagctgggaagctggggtgtttgccaggtcctgccagacatagtttcctctctgtgcctcagtttcctcatctgtaacatgcagagatgagatgccctccaagattggtcctttccagctgccctcactgggagggggcaccgtgccctgcctcccaggctgactcgtcctttgtaattctcttcctttccacgggactccagattcatgccggtcccactagccctgttgccctgttcctaagcctgtccagaaatccttgggactaagtgaggctgaagctatagcgctctgctcttcctacctttttaagaggtcttacattgtaaaacttcaatttttcaaacactcactggctcacagaagaaaataaaataaaaagctgcaattgtgaaaatgtaattgctcaactttagctcatgctccagatcagtgattttctcttttagccaaacttctttataattatttcctttatttttataatagattcttcaaaattaatttcaaaattccttatctaccgtctttcacaaatgtatgtatagcctagagaattttggtaataattttgtgatacatttatattgggatttgtagctgccagcctttttttttttttttttttttttttttttttttttgagaaagggtctcacttccgttgcccaggctggagtgcagtggtgatcgcggctcactgcagcctcgacttcccaggctcagatgattctcccacctcagtctcctgagtagctgggactacaggcgtgcaccaccacactcagctagttttttcgtttgtttgttttgttttgtttttgtagagacagagttttgctgtgttgcccaggcaggtctcaaactcctgggctcaagcgatccgcctgcctcggcctcccaaattgctgggatgataggtgtgtgccactgtgcccggcccaagccattttttcagtccattctttttgctcctcctagtaacccttcgtagcaaccagccttccattgttcagtcaccagaagttaatgatagaaaaccagagatttctagctgtgcaagatgtagagagaaacctaaactctatacatttgctattggcactgtgttgccatagtcactgcagcactcagcatcaccaaaagcctgcccagtgctgcaacattctttagatagatttttgttgttttattttgtctccttaaataatatttaatttttcattaggtcatgctatgatttcatagcttattttgtctctaatattttcttctgcatgctgtcttttgagagacctctccagagttcaagcacaaatcctaggacagacttgtattttgactgtcaaattttcattgcagtatgtgcaaaagtacagaaatgtcatcaaattaagcaaagaagataagaatttttgaatggcagtgttctggcaactataaaataaagtctattaagagtgcaaagtgagaggtggaatgtcgccagggcagctgcattcattatctcttgctggataacagacgaccacacgtttagcagcttgaaacaacacacattcattctctcaccgtggctgcgggtcacgggtccaggcacagcacagctggggccagtgctcagcgtcccacaaggcttggtccgggtgtcagccaggctgcgctctcctttaagctcaggggttttcttccaagcacaggttgttggtagaattcagttcctgtggctgcaggactgagaccctcagctccctgcaggctgcctgccattgcctggacagatcatgcaatgtggtgttaataatcacaggagagaaatgtggtcaaccttgccatgtaatgtaacctaacctagggagtggtgccccatctccttgacgcattctggaagcaagtgacagatcttgcccatactcaagggtcgggagtataccagggcaggactttgtgggggtaaggtatgtccctggcagtaaccattactttgaatcctcccattaaatgtaaaatatcttccaacttgaacatatactttgtacttttctccccctaaacaaacaaaaactcaatcctcattcaacaatgaaagttttgctgcctgtaaagatacttgcaaatgtgtgatatagacaccaaagacagttcccaaacagcctaaagatgtttagtgctggccgggcgtggcggctcacgcctgaaatcccaccactttggaagtctgaggcaggtggatcgcttgagttcagaagctgaacaccagcctgggtaaaaccttgtctctacaaaaagaaccaaaaaattagctgggcgtgctgatgcccacctttggtcacagctacccgggaggctgaggtgagaggattgcttgagcccgggaggtggaggttgcagtaagcccagatcatgccactgctctccagcctgggcaacactgcaagactctgtctcaaaaaaaaaaaaaaaagaaagaaagaaaaaaagaggccaggtgtggtggctcacgcccgtaatcccagcactttgggaggctgaggcgggtgggtcacgaggtcaggagatcgagaccatcctggccaacatggtgaaaccccgtctctacaaaaaatacaaaaattagccgggcgtattggcgggcgcctgtagtcccagctactcgggaggctgaggcaggagaatcccttgaacccaggaggcggaggatgcagtgagctgagatcgcaccactgcactccggcctggcaacagagcgagactccgtctcaaaagaaaaaagatgtttagtgttggtgacatcattgacgttagttgcagcctttctggggctgcccagctgtttggagtgagcagctcttactgatgtatgaattctggtttgttcatggacaacagagttctttccttgcttgttccctttgggctggtttgctcttgtgtctaaccgggtggtgtctaagaaaaccagactctgtcttggctgtctcacacagaagcccctgaacgttttcctgcccatcctccctccccagatttctgcctgccttctgggcaccagaagtcttagccagacggatgcagcggattctgtggtgaaacacaaatgacagaggtgctccctgccttctgtgttctggttttccaccaggagccctggcctccttgcagaaacatcgaggtgacatgtagcatgaccgagctcgctggcgcctcttcatcgtgctgccaccgccctgcaggaagaggggccatgcagtcagtcttgcaccactttcaacgtttgcgagggagaggtactgcggttcctcatgtggccaggaccgtgtggtcactctttgggggtgttgacatggccgcgggtgtactcggtcacctctccatgtgtccagaaaagtgctcagtgttgaatccctccacgtctgcctgagtgcactttgggattccattcctgccgcttatggggcgcgctgcggatccctgcatgcacagagctttattgaacgcaaagtcagttgtttgttgtcgtgctctgttgcccctgcttctggcttcattcatgtggtttttgctcaattcttccccggccttaggaaataggccaactcttgtttttttggaaaacatttcacctgggcatatttttctatctataattacggaatttttatgtaatcacataattataaaatataacacaatcagatattaattaccttcatgtgtataatagcatggatattattttctttagtcatctcaaaaaaaaaaaagagaaaaatacaagcagtgtttcaaaactctcttctctttttgaacagagggtggttcccacttcatcaacacctcatcgccgcgaggtgaggctaagatgagcataaccagtgacgaggtgaactttctggtgtatcggtatctccaggagtcaggtaagaggcttggttttctgtcggtaggaaattcatctacagcatcttacaagcagaaggatcaacgcttaattcaaaaccaggctgtagaagaagaagaagaagagctaagaaggttcttagtgctgatggggagaagagaaggttctggagctgtgccatccccgggtggaaagagggaatgtgttctttcttcccttgacacttctgtgcagatgaatcaggcaggaatcaagagcggttgtggtgaatgtggaaaggacggaagcagtgcggggctcttggcctccacctcggcgagggcatgcatgagctggtgtgtgtgtttgaacctcttcgattttgctccagagatttattcagctccccagcctcccctactccccgccccctaaatgggctgctaggcaattttctaaaacttaggaatcgtcgtagcatcttccaacatttttgattaccactgagacattactttatggttagtaagtaaacagccaatcacatgtgttcgttgttgacaagacagactttgagctgagcagctgccctcctccgccagcagggaagtagtgggaagaagccacggagcccagggcttgggttctaacttagaagatatgtaatttaagacctacaaaatgatattggtgaaaaacgtcctgatacccacctacctgttcaacttaaacaaacctctcaggtgcattggaaaccccgcccatgtttgcctccccgccttcctcgatgatgatgaccctggtggacttgctgtttgttatctccacgtgtttattacacacagccgttttcctaagcgacatacggtgcaggtggattcgtttcctagggctgctataatgacgtaccgcaaactggggtggcttaaaaagaaatatgttgtctcctagttcctgaggacagaagtccaagatgaaggtgtaggcgggtcggttccttctgaggggaagtctctcctgtgcccctgcctggctcctggggccttgctgcagtctttgaactccttggctcgtaggcacatcaccctcatctctgtgttcagatttgtccacatttccccacggtaaagacagattggattcggaatttaccctcctccaagacaatctcattttaactattgtttttgaatacagcaataattacatctgcagtgaccctgtttctaaatagtgtcacattctgaggtgcgctgttggtgaacactgcaacctgtgaatttgtggaggagggggcacacttcaactcataacagtcggtttgggattttaagttgggttttaagcttcgtgcccttgatatcagattgtatatattctggaacttgattatttgaaaaggaaaccccagttcctaggccccgtcctcccagagatgcatgtattcgattggagggaaaaccagtctacgatcctctaggcttgagttctctcacagctggcctggtagggtagactgtacgcattggagccacacagaatggctcgagctctgatcctcgaacaagtctgagtgaggcctgttcatttgagcctgggtttccttgcccaggcaaatgtgctcaaatacgtcaggcacgtagcacattgtaagtgcgtgccttccccatccaagcctgggtctctgtcccttgcgctcccagctagtgttattcatggaaagtacacattcttttctgcatatatattagatgcctgtgattggctgttgccagaacatagtataggaagttggtatacaaaacaaaatatgtactgcctcactctggaaatcagggaaatgataaccgctctgctaatacctcaacctcggctcttagaggagcacaggtgatctcctgcctcagagcccatagctttccagaggtgcctgcaaatggaaatccatgtaccaaaccctgcttccctgtcgacttgtggcatggaatttgagattctttccatttagcaacacctctgcacaaggacacgatgaaggccaaagagactcacagctcttgtgtaaacaagtcccaggctggaactgtccggtgtgaaggaccacgtgctccggtaacctggagacagagccatgctgctggctggtccccagggggccacggagcatgagctttgctggcttcttgaaataaacacagaaacccccatccctccccagaaaggtcggcttccttattcagtgtttgtttatgaagcttctgtaaccaggcagctgagagggagagttggagcacaacaatgcatagaccttggcaaatgtcaactttgtgtaacatctgtgagctccattcctgattcatcagtgtcactgaagtataataacacttcttaggcagagttgatattgaagagagagactattacaccttcttcagctcactgtgtgtattgtggaactttttagagcaccctacaaggttgtattcaaaggaagaagggagcaaagaaatacttaatgttgaaatgttcattctggggttattttctatgttcgtctcaagtcctaaagttttggttaggtcaatagtcattgagcccccatcaagaaagcacaccttctcagcctatcgctgtctcccttctaccttaaataaaaaggaaaacatttccctgatcatgcttcctcctcaagcacctgtactcttactcctgcaccccaccaaactcattaaaaacaggttctgcatctcagaagatgattcattcctcagctccctccactctggctttctccactagaagttgtcagtaaattctgggttcccagatccactgatcttactgcaactggcattcctccttccctggtcatccctccttacctgtgtgtggcaggaagcgggtgggggtgggcagtgaggcagggagtaggtgtttccctgcagtgcggcaggacagctgcttccctggaaggtctgctggaacactcaaccccaccttccaggtacagtgacggacaagttttccagagtcaccaagcatgtggcctgagccctgcttctctgccctggacccagcagaccaggttgccgctcctgtccatccattcatctccttcaccagtgcctctcttcctcccctctgccagtatccatggtgtcagttaggatgtattaggctgcaaggaggaatcttcagtggagcactgatggcctcagacagccgggaagcagggtgttgaagaaggatccaagacacatctcttcaaactcggaaaagaacctcaaaaacagatgtgttttgttctctgcccacaacaggcagaagtcaggtcatctggcttttagcaaaccacatatatttccctacctgtgtggattagtggattttcattgttgcccttgttacttgtccaaagcaagggctttgcccatcagaagcactcaatagctgttacccacaggcgacatctcatagcagcagactcatggcagtctgaaagaggaaactggttaaagcaagaatgttaagtagtagggaacttttgcattaccaagctctagtgccaaaatggatttgttggtttttgcatgagttcagcagtctggctttgacgagtgatatggtttggccatatctcatcttgaattgtagctcccgtaattcccacatgtcatggggagggacccagtgggaagtaaatgaatcatgggagcaggttttcccgtgctgttctcgtgaaaagtgaataggtctcacgagacctgatggttgtataaaggggagttcccttgcacaccttctctttcctgcagccatgtaagatgtgactttgttcctcattcaccttctgccatgattgtgaggcctccccagccatgtggaactgtgagtccattaaacctctttcctttgtaaattacccagtctcaggtatgtctgtattagcagcatgataatggactaatacagtgtgtgagtccattggcctctgtcttacgggatccattgcctggtcacttgtgctatctgggcagtttttaagaatcacatggtggccatgtgcctttcccgtgagctcgtgttaccatcccaggaggagagaagcaagggagcgagcccctagaaatgtgcacagcctgcacctgctgtagtgagcagctcccccaaatgctgggggagtcgtgagttgtgtgcccccgcatatttctgaatacagccagggaagtggaagtccattttccacttagtatggaaagagagaaaatttggcaagtgagtccctgtaaacatattatttcctctgggacttcatcccaaaatccaaactataaagaaaacatgttctcccagacccacatttttggcataaattaaataattcacaggaacttgcaaaacggtatgaggaatacagggggacagaaccacagattcaaactgaatttaactgagaaagagctgcctgcaagataatcgggtgatacattcaggggaaagggaggtactatgaaaaattttgttttttgagactcactcatgctgagggtctcactctgttgcccaggctggagtgcagtggcacgatcacggctcactgcagcctctacctcccaagctcaattgatcgtcccacctcagtcgcccaagcagctgggactataggcttgtgccacaagaaattatgcccagctaatttcttattttctgttttattttatttgtagagacagggtctcactgtgttgcccaatctggtctcaaactcctgggttcaagagatcctcccccccggcctcataaagtgctggcattacaggcatgagccactgcgttacctggccaaaaatattttttaaagaagtagaagatactgtctgaagaggaaagaaggaaggaatgcgcggagctggcttgagcatagtcaacacacaggacagttctgtcaccctcaaaattgccttgtatccctttgtactcagctcctcttccacccccaccctgccccggcaaccaccactgctctgtccctagagttttgcccttgcaagaatggcatagagatggcatcacatattgtgtggtcctgagagtgtgacgtctttcactcaaccttatgcatttgagattcatgcatgctgttgtgtgcaccagccattcattcttgaatagctaagtggtgttccattttgaatgctgtttctgcgatttgtttatgcatcctcttgtggagggacatttgcgttctttccaggttttggtgattccaacataaagctacaaaaaagattttcatacaggtcatttgtatgaacgcaggttttcatttctcttgggtaaatatcttggagtggggttgctgggtcgtgtgacaagtgtaggtttcactttaccagaaaccagtgcattcttttccatctaaggcagaggcaggacacgtcgtaaacatgactggttttatagacgtgagttgagtcacagaactcctctgcctgtcgcacaaggcatactggaaagtatgtaaagggacgttagctctggcgtatatatctgcaggacgctcatgaagtgtgattcttcctttgaggatttgcagctagccttctggactaatttcatgaacctgtcagggtcacagtttccatgggccgacatgaatgtagcccaggtcggctgaatgacagagcgtccttgtttgcataccttcccctccttaagcagtgccgttggtctaaccttctgcttaaaaatagaaaactctatacagcctcatcagccctccggtggataagcccaggcatctgggcaaggcaaaggccaggcttccagatagcaggattccgcaggctgggccctgtggcggccacgaaagctctctgtgcatttgcccacatacccatggtatcaaagtcatcgaaaacccagcgaagtatttccctacctggagctttgtgactgacgtccacacaccaccaggaacaggcagacaagttaataaaaaccatgtgatgatggtggtggcgacagtactgaagaaaaagaaacacaagtagaaatggaatttcactaacgttgtgtccggcacagggatgttaccaagttccgtgtccatgacggcagtaattttaaacactgtagctactaaaaggagcttgtcaccataataaatggtaaaaatccacttctcacacacgctgaattcccagagtgaggaacttctggcttagctctaaagatttaaagaccctagaggatggttgaaatctccttattcagtggaacttatgttctgatttgccctgattcgtagctgagaggccaatttattatacatttttcttgcctccattaacgtcaccaaacatgggttattcagagtgagagtatcactagttatcaaaagtgagcatctacactctgggcactcttgttttcctaaagagcccatttctgcacacctgactagctgggtagaagtaggcatgcttcttttatttacataacgtatatatggctctgtgttatatgtcatccttgctcataaggaggatagttgctatggtcccaatgtttctgttcccccgaattcctatgttgaaatcctaacccccaaggggatggtatttgggggtggggcctttaggaggtgatgaagtcatgaggagagctcctttgccccttctaccatgtgggaacacggtgagaaggcaccatctatgaatcgggaagcgggttctcaccagacacccaatctgccacatgttgatcgtggactcccagcctccagaactgtgaaacacacatgttgtttataagccacctactctatgtattttggtagagcagcccgaacagagtaagataatagtgaagtagtacatccacatgcccagactttcagggttgtgaatataacttagtgacatttgtcattcatttcgtgaagcttccatgccaagaaaatcattaataagaaagatttctacccagtgtggaggcccacgcctataatcccagcactttgggaggttgaggtgggtggattgctttgagcccaggagttcaagaccaacctgggcaataaatacaaaaattagccgggtgtggtggttcatgcctgtagtcccaactactcaggaggctgaggcgggaggactgcctgagcctgggaggtcaaggctgcagtgagccataattgtgctattgcactccagagtgggtgacagagtgagaccctgtctgaaaaaaaaagaaagagtcttgctgggtgacacacttcacctgcagtgcttctctctggtggcgatgccattcaggtgagttagcctcagaggagtgcatggaagagtgagtgagacctcagcggcctcctctttccacaacaaacccaagcacagagataaaaggctgtgctgagcgcccaccaacacgcagcgaggttatactgtccaaaaagagtacctggcagatgacccagcaagttcacagcgggtaagctggcgtgggtctcggttagagtgaggtggagcggaggggaaggttccctgttcttcaacactttctacagaaacataagactgagggtgaagtgagatcccctctgaaaaagcaccaggtgtcttgtgggggcctgatgctgagggatgggttgtagctcatgccctgtagaagagaacactgttcaaagccaaccagtctggattcaagaggggtcctgggagcttcagtctgtccgtgaaagaagcacttccctgaggcttccctgtgttccaatgcccttcatatcctaggcctctgaacagggtgctgtcagtcgagtgggattcatcatcctcaagtttttgccggagtggaggccaggctgtgtgctgggctgatctcctcctgttgcatctgtgagctgctgttgtgaggacagtggcttgagagagctgaacagaaagacatgccccctccttccaagactgacctcacactttaggggagcagtacagtgtcctttagaacacctcagcggaagcaacccagatgtccattgacagaggaaattccatcaacagaacgtgtccatccatacagtggaatatcatgactcagctttgaaaaggaaggaaattctgacacaggctccagcacggatgacacttgaagacactatgccaagtgaaattagccagccacaaaaggcaaatactgtaggattccacttagaagggatacctcgaggagtctaatccaaaaagacaggcagtggaagggtggttgctgggggatggggagaagcaggggacgtggagttgctatttaatgggtacagtttccattttgcaaaatgaataacgttctggggatggttgatggtgatggttgcacagtagtgtgaatgcacctaatgccactgaactgtgcacttaaaaatggttaagatggaggccaaggtgggaggatcactggaggccaggagtttaagacaagcttggacaacgtagcaagaccctgtctcaataacaaaaaaaattttcaaaaattagccaggcatgggctcacacctgcagtcccagctattcagaaggctgaggtggggggatcacttgaggctgggaggtgaaggctgcagtgagttatgatcacaccattgcattccagcctggacaaaagagtgagaccctgtctcttaaaaattttttttaaaaatggttagcatgatatattttatgttatatatattttaccacgattttagggggaggtcatggtattataggtgagaagttccatgtgtagattgtttttcagagtttagaaaattagtctcaaagggaagagagaaccacctgtattcacagtaatattaatattactaatattacatgataagggctttttcatagtcccatataagtgtttggggcaaatccctggcacagctagtatcatttgtaagctacattggtgtctgacaaaatccagttatttaaaaaacagaaaacagtggcttatttataatagcaatattctggacatatggccagtgtccatcagtgggcgtagttgaagcaagctgtggcatgcctgtgccgtggagcaccactcagctgtgaaaaggaaggagttgtgggtaggcacagcaagctggaggaacccccagagaaatgtgccgagtagaacaggccacgtcagaagattgcagactgggccaggtgcggtggctcatgcctgtaatcccggcactttaggaagcctaggtgggcagatcacttgagatcaggagtttgagaccagcctggccaatatggtgaaaccccatctctactaaaaatacaaaaaaattagccaggcgtggtggcacatgccagtagtcccagctactctggaggctgaggcaggagaaacgctggaacccaggaggtggaggttgctgtgagccgaaattgcacagctgcactccagcctgggcgacagagcgagattctgtctcaaaaaaaaaaaaaaaaaaaaggaagaagattgcagactatatgattccatttataggacctgcttaaagtgctgaaaatatacaggtggacaccagatcagtggctgctacagatctggagtagggatgggagcacgtgcgtacaaaggaaggttataggagagttcttttgtgttgaatgaagagtttggtaccttgaccagagacacagttccacagatctacacgtaggatcaaactgcatagattatacgtacacaaccagtgaatgcagtgcagaaaggatgacgatagtttgtgttccagtgagcatttccgtcctgcctcctacttagtggtgttgatcctctttgacagtagtgtaagatgcctagatgggaggagacaggatgaaaggtgcacagcacttcactagttttgcagtttcccctgagtccatagtaattgcagaattatttaattgtaaaaaagactataccaaaaatgtaattcaatgtttctattgtctgcaaagctttgtgtgtgtgatagatggtggtccataatgcaaaggcagccaagacatttttattatatttcgcaggtcattagccatattgcaggcctagggctgggtgggggtactctcttgtgtaatggattcgagtggcagccctattaactgagaaatggatggccacacagacactgtggggccgttggaaacagaagaatcagctggaagcaaacagcatttgtcatacggacattgcttgaatgtttgcagactggggactgtcgtttctgggtgggctgcatttttactgggggaaaaagtcggtgcatggcttcttccctgctcatttaccagtgagtcttagaatgcttttacaatatccacttagaaccttcagtgtggaggattctgttagatttatgtgttcagcctgagagaagtgggcagatttgagggtcttaacttctgaagatgttgtgaatggccacaacatataatgcattaactcaacattttcagcccattcattgagatcagggtttcttggccttggcactattgacaatggcggctggattgttcttcatcttggggggactgtcctgaatactataggatgttcagcagcatccctaacatttgcccactctctattacaatggagagagagtgggaagacatttgtcaaatgtcccctggtgggtaaaatcaatgtcagttaagaagcactgattcatatcctttagttgtaggatttttttttccttccaactggtttttcttgggaaatggagttttaatggcattctgatttctttgcccttcatcttgtgttctccttgggcttcattttgattcccttacctgcagaactcaaatagacgttcacggcaagcaaaatgcagtccttgttattattaaaattttgcaggtattttttcccttgaggaaggagaaagtctgccaaaagcattctctggcagataataaaataattgagagtagcagactttccatttgatttttcttttttggcttggctcctggtgagtaagttagttaacccggaaaagggtgttactgaaactgcctttgcaaatattgtaacggaagaaattatgacagtgagagaaatctgacatggctgactccatcttgtctctagcttcacaggctggctgtctttgctcattcctggttaaaatcaacttaattaaaaactgatattcaagctatatatatatatatatatatatatatatatatatatatatatatatataaaaggccttggtgctttttcgcttcttggatcttgtttaagaaaaatttttctttgtttttcttcttagtcagctgaattatttccccagtctgttttcttgccactcttgatgcccacatgagaggacctaaagtaatttctgacagcccgggactccttgggaaaaacacaggaggtgccacataccctgttttgagaaaaacctacgttttcctcatggaaccccaggaattgaaggaggctagatccctctcaaaatctaaggctctgttccgtgttacctgatgtattttgactttgggaggtatcagaaattactttgcaggaagaagagcttttagcctgtgtgtgtaataactaggtaggaaatatactttaagggatggctaatggagttatggaaggatactcagctctttgcacttttggattagagaagcatgctgtcagccacctagaaggtatggaaatatttctaccccacactgagagatgagactcccttgggggatgggctgattggctttggattgccttgcagtggaatgcagggtaaaagcattgcactctcttctcccattgcattcccctctttttggggatccaagatgtcatataaaaatgggacccttaatttgggggatctgtttttgccttccagctatgcctgcttattaggccctagaaactacatgctctcctggctctgtttctataagggctccaccctgaagccagtaatccaatgaagaaacttaaaaattgaaagataaaaaaatcatataactaccggatccccttctgtctgtgtatttatatgtgttgtgtgtgtgatgtttatataaaacatgttaatgttcctattagttgacttttaaagaaaaaaagtgctaaaaaaaaattgtcagaaaaatagaaacattaatgcatttaggtcacgtgactctaatctttgaaaaataaaggcaatttaaaatattattggtaaagtaaaatgtcttcaacatttatacatttggtctaaattaggcaggtcagatactgtttgctagatgctttaagcccataaactgcttctgtgatttttaataattgtttgacttgtctgttttacagccattggattctagataaggcctggggacacgtggaattagccaggtgccctagctaggctgggaagagtcagacattgtctgcagctctgtctttgtcctgggctctataatctaatacatggttaaaattgcttacctatcagatattacaccacaaattaaagctactgagaattaacattgtaatatactggagaaacaattttacttataaggtatacaaggaaaatagaatgtatttttggtaaaatgttataagaaggtatggaaatacggtttttgttaaagggaaggtaatgttgtctagttcaggggattttaaggatcgtcttaacctaaaagagcgataagacaaaactgcaagtttaaacaagcgggaggatcacaaggtcaggagatggagaccatcctggctaacatggtgaaacctcgcctctactaaaaatacaaaaattagctgggcgtggtggcgggcgcctgtagttccagctacttgggaggctgaggcaggagaatggtgtgaacccgggaggaggagcttgcagtgagctgagatcggccactgcactccagcctgggtgacagagcgagactccgttcccccctacccccaaaaagaacaagctataaagggtttgtgaaggattgatcttgtaaaggaagttctgtgtgtatgaggaagttggctaagatttgaaggagattatttcagtttttggtaaattaaacattaaaataaaagcacactgatacagggctcaaatctgggcccatgtgtctgaataatggttttcttaggaaattaatcagctgtttaacagaaaattataaagggttttaaaaggtttttgaaaattttacctgatggtcaaacgaattaagattatatagatttgtttataaggttttattaagaattgggtttaacattaatagtacacaaatgcaaaggtgaaattttgctttttcttttaaacaagattttcgtgtaatattaagggatacaaaaggtttttgtttgcccctttgagtaaatggcagggaaaaggaagaggggaaaggaaagagattcagttggcttcatgctgtcttcattgggtcctgttgtttggaaagctgaggctcctatcaaagtaaagattttttccttcgtaaaatttttgagttatcattttggctaaatgaatgacttaggtatggtgacctgggattctattttgtaatatctaatgttttaaacctttgatatttgacaaacttgccaagatcaaattctaggttatgttttaaaaaaaaattaggacacctaaagtccaaaagagatatatttggcttattcaatatattaaaaccatgcaggaagcattgtcaaatataaaatggtgtttaactttctttgggttatattcatataaatatgttattagtatgtgttacaaacttgtgtaagattcctataattctgatgtttcagtgtatgttatcattaataattataattgttatgttaaattgttgtgtgtcacagagacgaccagaattccttgttgattgcatctttatggctgtcctgagacttgtgtcatccatagacaattattgtcttgtgttgctccttttcagaaggcagttgttatattcagctataggactctgacaggtactcttgaatgcgggtctctgataagtttagaaattgtgccattggaataggaaaaaaaaaaaaaaacttttgggactctcgtggagagctgatgtgttaaacattgctaatccctttgttattcagaatcaagaaaatgttttctttttagctgtttaccacttttagcaattgaataagataaacttgtgcaaaatttactgtgagcaaaatttggagcatgttactttttctctacctgatttctgcagaatttatagaaactatttgagtattctcaacttatggcagtatagttatttgcataagtgcagtaagaatctgttctcttttgtaacagaacagaattagaaacactggttattttaccaaggctttgactggaatggcatgcattcaaatataaacagactgctttaaggaatcaaagttgacttacagagccaacaaaagcccctcaggaaaacgcctcataccttgtgcggtttctgtacagggttcctgacttgtggtaagtaaagaatgtcattttctggcgggcctagggagccccaagttatcttgagaccttgggtggaggaaagagcctattatggcaaataattcttcttgctgcactttatacaaataatcagtccaagcataataagactaagacttattttgcaagtaaatttgtcttactatgatttgtctttaataaaaatggggactagagagagaaaaattatgtttcaaaaaactataaacttcttgagttttcattatcttctgttaacactgaattctttgtgggctacaagtccccaaactaatgctttcaaatttttcttccacttttctaacttggactcagtaaaatgctactaccttgttcctgaggccctgcaagctgaagcttattcctcgtaatataggcgacaaaaacgtttcagattttcactgcctgcctcatctataacgaaagaggcctaacccacctgcattgccacctcctgatatgggaaacagctgtttaattaaacatctagtctcaggactaggaaactgacctaaaaagaatatgggatgatatatgtaaaatgtgttctttcctgtccatcccaatctgtctgtctaacaaccactggcccaaatctctctgctagccgccccatgtctgattggttctcagagatgttcacctgggtccctcagagcttaaggtccagtctacaaaggcttcggaagctaggacttccactctttatcctaggaccttatagctcactgttcacttcaatgctgtgccaaaactacagatgaccatcctaatgcctttgtcatgcaagccctgaaaccccaaccaggcacatgtgagtacatgcagacagctgcaaaggggttccactccttttaccttggggtctgcagctacacccactatgcccactgtcagcaggaagaagttagggcagtcgtctcttctttttccatcttcatagcccacaccttaagaataaggtgttataaaacccaaagggagggattgaaaccacctttgcaaaaattataactgagaacatgttgacagtgagagaaaactgacctggctgactgtcttgcttctagctcacaggttgactgtctttgctcattcctggccaagctaacctgggggaaaaatttagtttatagtttcaatgataatagtccttcccccaaactaaatgttgttgtaaaactaatgaaaggctaccaaattaggatgagaggggcttgaattctaaataatttaccattatgccattatgccataataatttgccattatgccggcagtcaagatttgcatcttccccttgaagatagcatcactgttgtagaacctaagattggcctttgagatgtcttttcaggtgttcgcatttctgacaaccagattgccccacttggacctgcgaacaaccggtcctgtggccccccctactgaggaatgactcagcataagaggacagctacaattccctatgatttcatctccaacccaaccagtcaggatgctccctaccccaccccactgctcaccaaactatctttaaaaaccctaatctctaagccttcggagagacttgatttgagtactaataaaactccagtctcccgtacagccggctctgcatgaattaaactctttattacaattcccctgtcttgataaatcagctctgtctaggcagcaggcaaggggaatccattgggtggttacattactcttaatatttgtgaataattgcatctacaaaaatgattaagtggctttgcccactgtaatcctagcagctgacaaattactctgtagactccactgtgtttcctagggccatggaatgccttcttatgcaagacacgtttccatggattcaggaaatcattttaatggttcagctatcttaatttaaacaaaagttcagggcttattgttcagctgagtctctaaaaatattttttgactgcagcggctcttttacattgctaatgtgtatccatgtttaaaaaaagaatctttatgaaacagtgaaggccagcatttctttgaggtgttggcagtctttgctttaggaataataaaggaaaacattagtttcatcaaataataaaataaggaagacctgaataaaatgtccacattagtagaggatgaaagtaccctgaaactctgcaaaacagtaatgtctcatgctttgatgtgatctcattaagtgagagcagcacattttgctggtatgttgggaccccccaagaccaccctcaggcccagtggtttgctggaagggctcacaggactcagtacctgccacacttacggtttattacagtgaaataatacagatgaaaatcagcaaggggaaaaggcataaggcacgaagtccaggtgaaactaggcacaaccttgcaggtggccacccccagtggagttacagagaagctgttaattctcccagaagaatatatgattggccatgtgcgggagagtggccagccagggaagctcacctgaaccttggcgctcagggtttttatttgggggccattcctgtgggcatgcggcccatgccgaggggttcagaaggaaaataggagaatacaaggctatccacaccacttcaggcccaggccacatggaaatctgggtgaggttctgtatctgtcgttggtgcatttatgcatttgttagatgtcaatgataaaaactaatttctaagaatgtgtaggagtgggtaagtagctggagaacgtgatacccaggcctttcatatagaaaagaatagcacatcaccctggccagctgtgtggcatgaacaattgatcctcctccaccaagtatgtccattctccctttgctaaatacagtggtgtaggtttgcagagcctctgctcacatgggaggttatgaaggggctaattgttcaattaccaaccctctcataactgtgctagttgcaaacaaactgtttgaaaagactgttttgctaaactgttctcttggtgtgattataaccatttacagtagcaaaatgcaggaatccagaagttcttacattccagatgttcataaccattccactctcctggttccagtgcagtttcagttgtacgatcttttctaagtttattgttctaaattaagacttgccattcttatgctcattaatttgttacagggagaaaaagcaattagaatgaaaatcagttgagtatttataaattacagttgtttaagtatacatcttgttcagtgtagtcaaaaattctccattggtattgacacccacaaaaatggtcagattctgttgaagatgcacataagccttaaatttcacttcctactttaaaaattggtgacgatgtgaaaatgtctaagagagtccacatttcctgttttagataagatgaaatagccactcaccaaggtgcctgtcttccgagtttattcaccgttacattcaagacttgcctgctctgaaattctactgtgaccttaaaagtgcccagcattgatatgttttatgccaaattctattccctttcttgctttccagaccgaacagcaagcgagttgtctggactgtcagacacaacactgtccctcttccccgaagtctctgtacatccctttgctggtgcctccttctccgttcacttctcaactactactgtcctcaagatgatgttctttttaccctcccacatctgtgcctgtagtaatatgtcactctcttcctcctgaagtctgagtcccatccccagtctctctgctgatcccccaagtctgagtgtccactcccaatctctccagtgactcctcccctccaagtcacggtgtgtatccccaacttctccattgccatccatactgatattttgaatgacacttcacgagcactctttaatgtaaacccacacttggtaccatcaccatttccctaccacagtctgtccacttcaaagacaagcttcctctatcctgtgattatgtcactctttgccttagtccattcgagctgctatgacaaaataccataaacaacagagatttttttctcacatttctgcaggctgggagtccaacatcaaggtgtgggagattcagtgtctggtggggacccgcttcctggttcatagatggcgccttctccctgtgtcctcacgtggtggaagaggcaagggagctctctggggtctcttgtataaggacactcatcccattcatgagggctccaccctcatcacctcccaaaggccccacctcctaatgccatccccttgggggttagatttcaatatatgaatttagaagggcggagagaagcattcagaattagcactgtttagtagaaaaacatcaggattgtgttcaaacatttttttccatgttatctttcctactgcctccttgtcttcagttccctccccaccacctggcacccagatatcctacccttgtcagtgttacctctatccccccatcactgttttgttgtagtaacaatatctcacatttgtcaagcacttgctgtgtgccaggcatgattctaaatattgacagatgaaactgtttattcctaccaatccctaggaagtagaaacagctccatcctcatttacagatgagaaacccaaggtactgagaaggtcctggcctacccaagtcacttcaaggaggtcatacagctgggattcagaacaccatccatctggctttggaatctttctcattttttcatttattcaacattcattgaaaataatgtaataaaaattatatatgtgtatctatatctacctatagatgcatatgtatatatgtatatatagctatcatgtgctacgtgatgctttcaaatacagttggccctccatatcctcaggttccccatccacaaattcaaccaactgtgactcaaaaataaattgggggctaggtgcggtggctcacgcctgtagtaatcccagcactttgggaggccgaggtgggtggatcacctgaggtcaggagtttgagaccagcctgtccaacatagtgaaaccccatctctactaaaactacaaaattagctgggcatagtggtgcatgcctgtaatcccagttacttgggaggctgaggcaggagaatcacttgaacccgggaggcagaggttgcagtgagctgagatcgtgcacttgcactccagcctgggcaatgagcgaaattctttctcagaaataataataataataaattggaaaaataatacattggaaaaaacaaaaataacaatacaacaattaagataatacatatatttttaatttttaaaagtggcagttttattagagcaagtatgaaaatatgaattaaggttgcaatgagcagcgcagcagagaaggggctgcctgccctcctccccccgcccgatatatatttcatgtgtgggacagggtctcactgcattgcccaggctggaatgcagtggcatgatcttgcctcactgcagcctcagcctcctgggctcaagcagtcctcccacctcagtctccccaagtagctgggaccacaggaatgtgctaccacacccagctaatttttcgtagtttttatagtggcagtgtttcaccatgttgcccagactagtctcgaactcctgggctcaagcgattcacccaccttcgcctccaaaaaagtgctgggattacaagtgtgagtcactgcgcctgacctatttattgttttttaaagacagagtctctctctgttggccaggctggagtgcagtggcacaatcatggctcaccgtagcctcagcctcctgggcacaaatgatcctcccgcctcagccccccccccccccccccccccccagtagctgtgagtgcaggcacgggccaccacactcaactaattatttttattttttgtaaagatggggtctcattttgttgcccagtctggtgttgaacccctggcttcaaatgatccttccacctcgaccttgcaaagtgctgggattacaggcataagccaccacacccagtgccaatcttagttctttgctcgttatctgaattttcaccatatttgcatacacctggagtattttcttaaattgaaacagttgctttttattagatataccaatacctgttagtttacgagtttcatttagttctattgttcgcataacatacatttaaatagctattaaatttcaaacatttgccctcacgctacttaaaattattttgagtaccgtcagaaatgtggaggccacaagagagtacttgaatgcagcagttgtcaccttttctccagcagcttgagaaagggcatagagtgctatctgagctggatttgaaccagaagtttttaggcaaagtaagaagagcacttcaagaaaaataaagagcaaaccccagcatttttgaggagaatgcgccatcttggtgatgcggacctaggacacatgatggcaggaaggaggaaaagatgctggcaagtagggttagtggcacattaacaccagctgagacacgggaacctgtccagttagaagccgttgattcattgttgaaagataaaactggatgtagtgtgagtaaaggatgacctgcctgcttggtgaaaaattagtaaccacagaggtggctgtcaaaaccaaccagcaaccagggaaaatgcttatagtgtgctaggtaaaagagaacagggatacaatattctgtgaccatgatgattatacatagaaattaagacgcacaggccaggcgcggtagctcacgcccagcaagtaatcccagcactttgggaggccgaggcaggtggatcacctgaggtcaggagttcgagaccagcctggctaacatgaaatgaaaccccatttctactaaaaatacaaaaattacctgggcgtggtggcatgcgcctgtaatcccagctattcgagaggctgaggcaggagaatcgcttgaacctgcgaggcggaggttgcagtgagccgagatcatgccattgcactccagcctgggtgacaagaatgcaactctgtctcaaaaaaaaaaaaaaaaagaagaaagtaattaagatacatagagaaaagggactggaagaaatcccccaatgtgagaacaggagttgtgttgattgtttaacaatgtgagttaatttctccatcttccaaattgctttctcttatattcccaaagtcatatcttgacttttgtttgagtgtgatttgcaatggtgctatccgtcgtaaatctctggtttagcattcatgctgtcttccaatttccaaatattgaatccagaattcatgagtgttccaaggtgctggagaccacactgtagggctggaggacatgagcgtctctgcacctagctcttcctagtagctgacttgcagcaggagctgaggcttctcctggcatcacctccactacaattctctgtgagcatttccaggaagcagcaccccctaccctagccgaggcccgtccaaggttgtctcgttgtcctagcccgccattgccctgggaggaagtagccacatgagtttatggcctgagtaatgcttttccctcctggatgctccccacatctagaggatatgaaaatagtcttggcaagggtgcctggtctgcgcttgtcagcggcctgagctgtattcagccaccacccttggggtccaggccagatgttatggcaaaaccgtattttaacgagatccttctggtatttcttttggacgccgtccgaggcagcttcattttacgctaaattccatgttatggtgggtcatctcaaacaggtctgcagcgcataaaaatgttctcactgcactctgttttctgtagcaaaatgttgttggaggttaggatgggagttgaggactgggccttgagggtttttttcatataaacacattaaaatggaaagctgatatgaacacgttcagtgatatagactgcaaaggcaaaaagaattctccccagcatatttttttttctttttaccatggatgtaattggagtttacatatgataagaactgcttcttgggcagaaaatgtaatcctctggtgagactaatccatcattgttgaagtgaagggaactggtagtgaattcgccccacagatgaagataggatttctaattccctcgccttttctgtttactgttcctaactccgtgagagtgtgcgtgtgtgtctgtgttttcttcaccatttgatttttcatcccggctcccacttcctcatccttggcctctctcgcatctttatttttatcacaccctccccacctccaccaccttgtcccagcactgagaggaaagtgggcagctttccaggcagctgcagtcctgctggagaaacctttatgatccaggaaatattgactgaggagaagctgtgctgactccgctatgaataaggaggttggaaaactgtcagcatttgcagaaacaaaaggaagtgctacatatacgttttggtttcataatgactgtattgtaaaaccccttctctttagcctactagattggacaagtgtgttaaccagtggctgtttggtatccattgatcatagagctagaccaacaaccaaagttgtttacctctcataaggtggcttttgcaggcgtgccaaaatcatattatgaaactcccagccacaaattctgacatgtattttcacttcctatccaataagggatatccccacccctttactccccgactactgtagtcataaaggtacactcctagttcctccctctctctttctcagcttctcggtccctgtgtgtgataaggtttcttgttgccctgtgtggcatggtgtggcacgccccagcatactcccttccttgggaactgagtaataaattctttcaatggcattagcctctttgtgttgtcactcagtcacctccataaattaaaacccttcaggttttgttggcactgtaaggtaatttattttctctacataggattttagaattgaaagggaccttgtagatcattgaattccacctgtccatgggtcagaaaagggagctggggaaactgttagggggcagatccaggccttggagcacctggttaaatgtgttctccccataagcctaagaaatggtaccaaattcttatgtcattgcatccaatatggtccttccttctttcttctcttctgtttctttcctttgctctcaagactggtgtatcactttgtctcccaggctgaagtaaagtgtgtttgttatattgcagtggttttttattcgtattattatcatcatattgttttttgttgtttttttctggatatttttgatctgtggttggttgatttggtggacgcagaactatcggatatggagagtcaactgtatataaaatcaggtcagcacacttttcctgtagaggagcagatagtaaatatcctcagctttatgagccatgtggtctctgttgcacctactcaactctcccattgtagtgtgaaaatagccatagacaacacatcaactcatgggtgtggttgtatctcaataaaactttatttacacacactggcagtgagccagacttggtctgtgggcctcagtttgcaagcccatgatctaggcaatgcacagatagcagatggtgtccctcagctttggatagctgtaagtattacaagtatgtgagtctgttaaatacttaataaaaattccagttttaatgttacaaattgatacccttggtatttgttttagctgaagatgcaaaaccaactccacagctgcctgagtattaaattctacttttctctgccaaataagcagtatttctaaaggccagtgattgataacttagcagattttgctgatgaatcaggccaacattagctgagcatagtagtacactgtataactcaaatggtttgtgaagtcatttgtgaggggtgtggtttagcagtgtcataattgcaagaaacgcaatacatgtacttggtttgttttaaatgtttatgttgcctagttagatgagacaaattcttatacagactgtttcctctcttgtgagactattacacgttttattccaaatggacaggactttacatggaagatcctaccatcctttataaaatgtcatcctttgtgtaagcctttcagtttatcatgattatactcttttttttctccctgggaataattttacctcatctggttatgctctgttactgtgtgttatgttatctaaggtctatgaccaattgcatgcagagggtggcttgcttttcaatagcaacaaccaagaaccaagcagaaatgtaaggagagtagagctgggggtagtggcctttcagggtgtcaattccccaaccatggtggggttgatgggacaatattggaaacatttttggttgttacaatgggagtgtgctactggcatctagtgggtagaggccgggggtgctgctcaacatcgtacaatgcatgggactgtgtcccccacagcaaggaatgagccagcctaaaagtcagccatgctgtgcttgagaagccctgctgtcaagagattcatcaggaatacgcctcctaagtaggtggcaagcctagcgtcttcaggaatgtctctaggctagcctactggtgacaccaaggacactaacccatcaccctcacacgatctttcatcgaggtaccaccaagctctttgttctcctgccctttaactacttctgcacctgccgcaggggcagtccttggtgcttcgtttatcattgacattctggtctttgttcctacggatgtcttgttgggcagaagagatgtgttcagagatgcgggaaagctgaggaggcacaaggcaccgaagtctcaccactctggcagactgcatatgaatgtgcccattagccctggagtccaagtgggaggggtgagatgctggcaggtgtggaggcaggcattaccttccgcagcaccctggcacctggttctggcaactgtggcctaagaggaagtggtcaagcagcctctagtacatagtccttgggcattgtcttagttagtatgggctataaccaacaccttagactgggtaatttatatacaaccaaagtgtattgctcacagtcctggaggctgggaagtccaagatcaagacgccagcagatttggtgtctggtgaggtcctgtttcacatggatggctccttctgtgtcttcacatggtggaaggtgcaggggagcttgcttgagcctcttttatagggacactgatcccattcacgagagtggatccctcatgatttaattgcttcctgaaggccccaccccttaataccgtcactttggggatttgtctcccacatacaaatctgggggggacacaaacattcagaacgtagcaggcatcttcctgtcccagaatgaatatcagaactagcaaatatcctagcagccatttcatctgacatccttattgttccaacaaggaaagctgggacagcaacctttccactcactgtggtctcctctccatcaaatgtgttgggggtctggctgctgtcccatctatgtgtctcatcagcacctcaaggtactttttatccctatatcacagaggaggaaatgcaggcccagccaaatgaagcgacatgggccaggcaccagtggcagaacgaggacagaacccagccatcctgcctgctgctgacattttctccatccagccctcctgcttgccttcatgagaccacatggccagaaatcagtaagaaaatcttgcaagcaaatggactgaaaaaccattgctctagaggccatgtagagatccattcagagaaatgcagctagtgaaaatttcagcaaataggaggacttctgttaaccatggcatggaatgcacatctcccaggtctttatgaaggtgcctaatttccagtcatgacctaccctctccaaaagaggacccaagctgatgaaagaccttcgaggtacccctgtagaactttatcctgcacatttgtcattgtgcatctgcacaggatattcctttcggcagacgactttcagctctttgcagaagtctcagacgccacatccttagtccatctttactggttcatctctttgttccaagaagacttaattgaatgtggatactgttgtccacacgatctagaaatgaaatctgtgttggagagcataatcatgtagagagataaagttatacagccaaaacatgtactcaacattaaaaacccagatgagagagaaatcaagggcacactccctccgtgggttagactgagctttgcacaccgttctttgtgagttgcctgagctgcacccacgctggctgctgtccagagctgccagtggtctagctgagcagccaggtggaaatggagtctgtgtccatgcagggaattcaagaattttggttcctgtgcttgtgggtgggtcttggagtgtaaagtaaaaagcggaatctcggagtcacatagtctacggttcacagtttagttcagcgtcatatcacatgatccttgggcgggttacctgatgtctccaatgtttgtccttatgtgtgaaacaaaaacagtaccaactccaaacagctgctacaaagactgaggtagtggacagagtgcccaggtttggttgaagatggtaatgtggtcagaatcggctctgtttcacagagcatgtgactgcaagtaccagttctgtggcccagtgctgcttgcgggaatgaatgagtcagagtggatgaatgaaatgtcccaggagcacgagactttccttccacaattgctccatcagccatgaggtttgcttgtcaggtgccgtcatcagcacataatgctgcattctggtgcattcagtagatgtttctagatactgtttcatggtggctaagagtggtttctggcacccaggcttagatctcagccccacccctacaaactgagcaacaggaggctgtcagttaccctcaaaagatctcagagactgattgatcaaggggaaagcggcagtgacagaatgatgctgagaagcttgaagccatttagtaggagccacgtgagtggcccccatcagccgtgagagtcatgatgtctatgagagaggaatcactgtggcccagagtagataaggaagattccatgtagtggatcgtcaagccaagaatgcagtgaggtcccgctttatccattgactggggtttttctcttccacactttgccaaagacctcaatgataaaagcttgcaggtaaaactctgtatagcattggcagagaatagagtcgttggtgaacccaagggtgggttgcttcattttggtaggagtgggtaggagaaaaggaaggtggatagagagaaagcaagttagaaggaaaaggtaaggttgttgtaaacagccttggcttatatcctccaaaaacacaggggcggaggaacccttggggataggggaacctggaagggcgtcctttggaacctaatgtaggcagttatagttctgtaaagaaatatgcaaggctctgtgcaattgattgtaaaattaatagcagctaccctattactctgttagataaatctcaactacacatttgatatgttctttacaacctggcggtggggacagaacagagggtggattgaggaggagggagagtagacagagaaaagtgaagtgtaagaaagcagcaaggagagcacagcgcagagctcgtctcctggaggaacattcccatctggtgagcgttttgtttattgcaaggtcagtttgcatttggataaggcgaggcagaagggcactgatacggaagcagagggaagccggctgccactgcccctcattggctgaatgaaaggcggcggaagaggagcacctgtccagcaaggctgacagtcctgcctcctgggataagcagattctcagcctgcagagtggtctaaccagggaggtagagtggctgctttccgaactccctgcttcctgctcatttgcctcatgcatggaagttgtaaacagtgtgagagttgaaagccacaccatgggaatgccttggtgtccaccccacctgttgccaggaaccgagcactgggggtccatgttcctcacacgagatccccccatgatgtccacctcccaaggatttcaagctcctgtgcaccctcaggccgcctctgcaccaagcaaagtgacccagccctgccaggcggggttgcctgttttaggaaactccctgcagcagcctaggcttgctggcagtgggatgccacctccctctctctccttgatgaagggctgtcgcagcttcctcatcacccccagacctccacatagatgccctgcatcattgccttctttccttgaagcaggcgccatccacaagagcaaggcatggctttctgtgtattcggtcctgacccccttcccaacagcttcattcaagagccttcatccaaagctgatctgaaaacacctttaaattgccaagcatcattgatagcagcttcctagagcggcagtgaaagagatgcactgggggaggagaggaaaagagccagcatcaattagcaaagagaaaattcccagtgttttgagaaaatgactcagtgccacaccagtcagtccaggacggcctcttctccgtcttcagttgttgagttgtgatacacttgccccgcgtgccaggaggactcagggtcagcgtttgctgttccctcatcttgggctgaagaaaggtgccctgtgtgctttcagggggtgacacagagaggcttcagcatgagcttctgcacagtcttacgaaccacggagttttggtggggagcctggagccaaatttgagtaacagaaatgtccaaccggggcatgcagggcaaactattgtctgttctgctttgttcttaataacactgaaacggttctaccatttaagtcccttgtttcatcacataccaatcctggtcttcctgggtctgaagtccctccctctctccctgccctttcccaccttactgaacccaaatcagaagcatccctgggcattctgcagccgtgtctgtccctgcaaattaagtgtgtttgaagtctgcgggccaccttcagatctcaatggctgcacctccctccttcaattcgggtctcactcaacctcagctttcccctcttgccacaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggtacgtagctgctgggcccggcccccaaacagcagagccctgggaagctgcaggagcttggaacacattggaagctaacatgcatttccctcaggcatttgggattaattccgcggcagggtgcagtggctcatgcctgtaatcccaggactttgggaggccgaggcaggaagtctacttgaccccaggagtttgagaccagcctggacaacatggtgtaacagcatttctacaaaaaacaattttttaattagcccagtgtggtggtacgcacctgtagccccagctctcgggaggctgaggtgagaggatcagatcacttaagcctgagaggttgaggctgcagtaagctataattgcaccagtacactccagcctgggcaatgcagtgagactccatctctaaaattaaaaaaaaaaaaaaaaaaggaagaagaagaaagtaagttgggttcttttccactttgtgttaataccggttgtgtggacacacagcagcaagcttccagtgcccctcccacatggctctgtgtttttgacttaaatgtagaatcactggctgttagttgatgtaaacacttacaccgccacatctgaaaaagatacggcagatcttcagctgctctgggcttcggagtggacgtttgccttgcacttaatgcagacttgctgtctcttcttgatttctggagcaggttggttagagaggggccccacacatggtcaggtggaatctgtatttcagcagaacccggcagagggcatcaccagaggctgcgtcagggcagagaggtgatggctctggtgttaatgaggatctcaagggatgccttcattaccgggctcgttgtagagcagatggggtaggaggatggaaaaataaatgcacattaaaactgtgcacttggcttggaacccctcccactttttacattggtccacagtgaggagttgtgccaattttataccaattttggttttaaaccacacacctcaccctctcttgtcccctcctattctggtctcatgattctgcagtgaagatccccttgacttctggggaataatgggatccacaacctttcttgccgccttcacctgagtccctattttatttttagagactgagtctcacactgttgcccaggctagggtgcagtggcacagtcatggcttactgcagcctcgacctcctgggctcaagtgatcctcctgtctcagcctcccaaagcactgggaccacagacagtccctgttactgatttctcagtcccctgcagcttcctccctctgcttctctttctcctactctgacccaggcgcgtgattctactgaacttttccatactgtaccgtcatccatcccacctggcagtcacattcttccaggattccctctgtcccgtctttctgggaactggtcttgcccttacaaacctttctccttcacagcatgttacactgctttaaaaaactcttttagaaaatcacaaagtaataatatcctgttctctttttcttttcttttctttttttttttttttttttttttaagacagggtctctctctgtcacccaggtgggagtacagtggtacaatcatagctcactacagcctcaacctcctggctcaaaagatcctcctgcctcagcctcctgagcagctggaacttataggtacacaccaccacgtccagataatttttttattttttgtagagatgaggtctcgctggtcttgaactcctgggctcaagcgatcctcccgcgatcctcccgccttggcctcccaaagtgctgggagtacaggcgtgagccactgtacccagtccctgttttctttcttgcacttctgcctgccatttttcgcaaagctgtggctttcgaaactccggtgttttttcctctcttgtgctcctttttccctggcaaaccccttcacactgtgtgcccgggatcttccactgactccttctggccctgtctagtttcctcactgcaaaacacacacgtgtgtatctaagaggacatgtctccaaggtccagccagccatcagatctcaaggcgcctgtgactctgtttttctctgctcattgccttctacctctcatctgttgagaagccttcatagttgccttccctcggcactccagattccagcactctaggggctaatgaaagactgtcccatttgtcacaatggtttctaatcattaaaaagtgagacgccaggggcggtagcacacatctgtaatcgcagcactttgggaagccaaggcaggagggttgcctgaggccagaagttctagaccagcctggccaatataatgagaccctatctctacataaaataaaaaaaattagccaggtgcagtggcacatgctcgtaaccccagctactcggaggctaaggcaggaagatcagtttggtccaggagtttgaggctgcagtgagccatgactgtgcccctgcactccagcctggatgacagagcgagaccccgtctctaaggaaaaaagagagacagtgtgcccgcggagtttaaatgaggacatgttgttactactttggacagttaccgcgttttgtcatgggcttgttcatttgggtgtgaacatatgaaggaggaagggggtgtgggagcgtcttgacccatcggtcaccattgtccactccatggccagaatcaagggccaagagtgcctgaggaggtgatgcagctagttctttacataggttgtattgttttctttattttgaatattgtcttgtaatcagaaatcatctggagtgatgtttcatttagttattcttcagctgaaacctgagcctttcagttcttcctcacttctgaagtaattcaggttcagagcatataaacatgtgtttgcacatccagatacaaccccaaggcttactgaggttcacctgattcgaatatctggcgtgtttcacaaggaaagaacctcctgctgtatttttaaacgtgtgtggaaagttttccatggtaaacggaaatcagagaatcaaagaatggtcaaaaaaacatgaatcaaaacaaaatgatgtcaattgtgtcatggctatggttagtctaaccctgaacccaaggagtcatttcaagtagcagcaagtgcctattttattaaatcccctggacagatggacttggaatccaggcctaaatgctgtgtgcatctcatttgggctctgcttctgaagcgttaccctcccatataatggatggtcatttgcagagattttgcacagtcgcgatagcacgtgggcaggtcttctccaccgcagcactcagtatttggggctgcgtgtttctctgtggtggggccatcctgggcactgttggatgttgagcagcgtccctgggctccacccaccagatgccaggagcacctctcctcccttagttgtaacagccaaaaaagtctccagacgttgcctaatgccccccaaggagtcacagtcaccccccgcccccgccacgttgagaattgtgccatcagggatagcactttctgtcaagaataaatggcctttttgtcctcaatgccccaattgggtttgacactcagaacaaccatcacacttagttcttaccaacagtttgtcgtgtccccttccctgcccaccgtgggatcccttcaccccaggctccaggtccatgccgcttcccccgtggccccctggttgctgggagccagctgtttacgccccacttccctgcgcttctcctgcccagagagcagaggccattcccagagccctcacccccgtgagctgacagctgtaccttggcttgcttccccaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcagtgagtgcaggggctctgggagttcggtgggcctctctgggttcattgttttcttcttgggcaaatccgaatgccttcttaaaaacctgcctgctataaatgtcttagaagctgctctctagtgtttgcttacgatctggccggaagaacttcccgttccattttttccatcacaacccttggacctgagcttcttcaccctcatcttcaactttaggaaatcgtgctgcgcctgctaatctgagaactctcatgtaacacatgattattgcccgtgataaacaaaagtgtttcattcatggacacctttagtctcagcctccagccttccatgttgagggtttttggccaaattatggtataattattgagcttgcagttcctgccaagggcactgggccccagagactgggcataggcttatttggtctttgcaaaaccccaggacatcagtccctgttaggtgattgcctgtgagtatgtggccagtcagagagcccaaaattctacccagagaacctgctccacttagacatactgctctatacacccgtagggacgccacttcagggtgcaagttcagagcgagcatatgtgccgtgcatggcgcaccgtgtgcgcgcatgcacttgcatgcacaggtatgcatgggtgcatatgtatgttgtacatgtgtatatctgcatgtgtatgtgcctgtgtctgtgtgcaagtgtgtatgcatgcgtgtgcgtgtatgtgtgcgtgtgtgcgtgtgtgcgtgcacgcgtatatgcgtgtgcgcacctgtgttcctgtgcgtgtgtgtgcacaagtttgtgtgcgtgtgtgtgcgcacgcacgcacacctgtgcatggtgtagtgtatgtgtgtgtgttcttccttatttgaaagttgttgccctcggagcagccatgcagcccagcagtccttgaagatcgagctgactatgacgttgctgtcttacctggtacgtcttggctccacaacttcctggtgtgtagagagccagccggctgcctctgatgaggctgcagcccgagccaagccctgtgacaagttaccatccacaggcaccagctaaaaaattcttggagaagcagatccagcatttaatggaaggttcacagattgttaataacgtttctattgcaatagggtgacagaaaggccacctgcctcaggtaaaaggaaaagacctcttaccagccttctattgataaggtccacaattgtggggcaggaaaagaagagtctggccctcctcctctgtgcatgtggccagagttcaccctggttgaacttctggaacagccaccccaacccccttctcaaaccctgcatcttgtgcctgacccacagcccagtctatggagacaggagcattggaaggccgcattttgataagaatgaaaatactggctgtcactcctgcctggagttaccaggccccctgccactgcgtggctggctaagatgccagtttccctcttgccatcaccagggacagtgggtctgccacatgcagaaagatgtttttcctctcttccagccagatgacactttcagagcatggaagaaacaccaacattgaagagtcccattgttgtttgaatcttttgtatcaggcttctcgagctaagcaggaccaccaggcgttttcttattttttacataaacagcactcctactcagtgacacgtaacctaagatcacattgcttctgtttcctgggttttccaccagagcacctttacgaaagacatatgacaaagcatgctcaattcctcaccgtattgtgaaactgttaaccatggctaattgtttgatgatcaggctatattgctcctttctcaggagcataaaccagggtctagcaaactttctttacagggacagacagtaaatgtcccaggctttgagggtcatgcagtctctgtcacagctgctgaagtctgtcagagtgcaaaaacagctgtgagagtcagctcaggctgccgtaacaaaaggccacacaccaggctgtttaagaatttgctctcacagttctggaggctggaggaccaagatcaaggtgtgggcagggctggttcctttgcgaggcctctctccttggcttgtagagactgtcttctctccatgtcttcacgtgctcgttcctctggttgtgtctgtgtcctgatctcctcttctcataaggacaccagtcccactgggttagggcccacccttgtgacctccttttaccctgctcaccttttcaaaagccctatctccaaatacagccacattctgaggcccctggaaattggggcttcaagatatgaattttagggggacatagtttagcccataacagtagccatagacaatttgaaaacatgggcagtggctgtgtgccagtcacactttatttatgcagaagcagccagggactaggtttggatcatgggctgtagttagctggccccagttacaaaaaataactgtcacccaggctggggtacagtggcacaatcatagctcactacagcctcaatctcttgggctcaagtgatcctcccaccgcagcctcctgagtagctgggactacaggtgtgcaccaccagggctggctaacttcttgttgttgttgttgttgttgtttttatagagatggggtcttgctatgttgcccaggctgctgttgaactcctggtctcaagcagtcctccctcctcagcctcctgaggcactgggattttaggtgtgagccactgcacttagcaaactgtttttattcctcaatgaaatttagagactgtcaaaatgtaaagaaacctaaaatatttactaaattgcactaaagccacgatttcgttagaatcatcagaggtaggccgggcgtggtggctcacgcctgtaattccagcattttgggaggctggggcaggtggatcacttgaggccaggagtttgagaccgaccctggcaacatggtgaaaccccgcctctactaaaaatacaaaaattagcctggtgtggtggcacatgcctgtaatcccagctgcttgagaggctgaggcatgagaattgcttgaacctgggagacggaggttgcagtgagccgaggtcgtgccactgcactccagcctgggcgacagagcaagattccgtctcaaaaaaaaaaaaaaaaaaagaaaaggaatcatcagaggtagtatttagtacataaaaaaaatgtttctggaaacaaaagagccctttaagtgtgtttctcttgtattggtaagccacttgtctctttgtgtttgctgtgacagataatcacgcgaagccaatggaaatagatggagaggttgagattccatccagcaaagccacagtccttcggggccatgagtctgaggtgttcatttgtgcctggaatcctgtcagtgatttgctagcctccgggtaaggatgtcagggtggggggcgctccagagttggggagatgggagatgcaagctgctcgcccttctctggagttctgcctaaaggaacacacactccccttcttaccccggtgtgtgggcagaccaaggaatgggtggctctatgagccacttctctacatgtctcatattgtggagaagccatagttccaagtcgttttctccatgtggtggtgaggaacacagcagcacttaaattaccaaatgcaaagatggcaaagagggaaacagggatccagagggatgaaaaagacagaagagcatgtgctgaagatgccctctggccagagagcaagctgtggagagcttcttatcccatttgaaccaaacaccagaggctcctgtgtttttattctgtagatctggagactcaactgcaaggatatggaacctgaatgagaatagcaacgggggctccacccagctcgtgttgaggcactgtatacgagaggggggccatgacgtcccgagtaacaaagacgtcacctcactggactggaatgtaagcatcttccaccccctgggcactttgaaattggtaaaatcggccagccaccaggcaggggctgcagcaatggagcccatgcagacataggaggcaggtggtcctgtgtgctcagcccccactctgatgggctgccagagaggtgttcttggcttctttttttattttgagacggagtcttgctctgttgcccaggctggaatgcagtggtgtgatctcagctcactgcaacttctgcctcctgggttcaagcgattctctttcctcagcttcccgaatagctgggattacaggctcatgccaccacacctggctaatttttgtatttttagtagagatggggtttcaccatgtcggccaggctgctctcgcactcctgacccaatgtgatccgcctgcctcagcctcccaaagtgctgggattataggcgtgagccactgcccccggccagtcttggcttctaagagctattaacaaggctgcatttggcaggcagtgagctgtgtattcagtagccgtatctttgcacgtgagcatgccttagcaaaatgagcctgtggcctcatggtgggaaggtaggctgggagccccaaggtagttcttctggagagatacgtcgtgcagcccaggaaaggtgattctccaccttgggatttcagcaccaggtgttctgtgcattgacacatgggatgcacacagtttgactgctttttattttctgcaaggtcttacgatagctttcagcatggtattttcaattctgtcattaaagaacacgcagtggcaaatggttccagtgtacctggatcctcggagaggctctccgagctgcttcggtgctgccgctcctaagttgtttttgtggggttttgtctctttctggccctcagaccaatggaacactcttggctacgggttcatatgacggttttgcaagaatatggacggaagatggtgagttctgtgtccctcgtgctggggtcgggtaagaggagctgccgaacttaacccttgagtgaacagaccatgacattgaggtcaacatgtttgtttttactaacaggtaacctggccagcaccttaggccaacataaaggccccatctttgccttgaaatggaaccgaaaggggaattacattttgagtgctggtgtagacaaagtgagtattagctgaaaatacatccctttgatctataggtggttatatatttttaatctcaaaataacatcgtggtttcttggaactcgtaggctttgtgcttccccttaagaaatgaaaatgatttgtttaggctttgtttttgtggttttgatctttctgttcatttgtgacacatcatctcttaatatattctgctgttctgcagaccctcgtgcaaagcttccctttatttgaggtacatggttcagtggtagagagaggacaatctccacattgcatttgtcagttgctggaaggagccacgtggtatggggcgtgccctgcctgaacttgcacccactgaggggtgagtggcacaggctgtgtgtgttcttcaggcttcggctttcctcatttgataaactgctgcttcccaccgtagaccgcagatttctctgagtaggagtcaagcaacctggctacaagggcacgctcttccgatggcccacagagccaggttagaattgacttgctctgcacctgggcagggctgcagggagacacggtagtgttaactccaggtgcatgtaaaagccatcaatggggtgggaacccaagggcaaagagtaaggggacgcagactccatcctgggcccgagtctgatccagccagcaacctcggcctctgtgcatttcactttcctcacttgtccagcgacaaggctggctggagtcatgagcggagacagccttcatggaacagttgtgcgttcccgagactcagcaggaattctaagtcatggctttggaaaagaagcattatctagaattgagaaaaaaaaaaaaaaaaagacgtgttttcacatgaatttgtgtttctacaacaactggaaaccatgcctgaatactggaggatgctcgggcctccacaaagctttgcattttgtggtgatttcaggataacttgaaaacttactaggtcttgaagttcgagaccagcctcgccaacacagtgaaacccagtctctactaaaaatgcaaaacttagctgggcatggtgtcgggtgcctgtaatcccagctacttagagactgaggcgcgagaatctcttgaaccagcgaggcagaggaggttgcagtgagccgagattgcgcctctgcactccagcctggatctggaagaagagtgagactctgtctcaaaacaaaacaagacaaaacaatacaaaacaaaacctgagtcagagctctctgttctttctagttctgaaagttataaaatgatagagttggccggtcgtggtggctcacgcctgtaatcccagcactttgggaggccacggcaggcagatcacctgaggtcgggagttcgagaccagcctgaccaacatggagaaaccctgtctctactaaaaatacaaaattagctgggcgtggtgggggatgcctgtaatcccagctactcaggaggctgaggcaggggaatcatttgaacctggggtgagcccagatcgcgccactgcactccagcctgggcaacaagagcaaaacttcatctcaaataaataaataaataaataaataaataaataaataaaatgatagacttgacctctgaacatcatcccactttgggagaaattgctaaatgaaataattgaatttggcaaactgtggcccacataggccaagtctggctcctcacctgtttcttaaatttaaataaagttgtattgggacacagccacacccctttgttgagacttctccatggttgctttcatgctacaatggcagagatgagcagttgcaagagagaccagatggccctcaaagcctaaaattctactacctggcccttcacagaaaaagtttgcggactcttgcactagggtataactaggtcaacaaatcattcattcataattgctctccctctcttttaagccaagaaacctttcagacttagtagcctggtttatgatattttaaaagctgagttgctgtggttgacacataaacgttctcatgtagctactatcagatctttgccaagatgttctaattcaagtaacatgcatacgcagcactttgctgtgcattcagtaggctctcagtaattgctgcttgagttattaaaatcactcatgaaaatgacagcacttttctttatcaagcagttcactactgcatgtgttaatccatccggtactgccaagataggaggcaggcacaagtatgatcactcccattctatagaggacgaactggaggcctggagagggttattaatttgcctagggacacacagctggtgcagagtacagagggatgggaactcagaccctggtcaccagtaactactgccctttaacttccgtagaattctaaatagctgtttgtttcctggcctccttcctacctggagactgttaacatttgtgattgtttttctcactgattatcagtcttaactccaccaggtgatggactatgtgatcagtgaaaatgcatatgtggaattatgttagtctcttgggctgggtacgatccaccatcattacttagtcaaccacagcaggagtgaaaataacatccttgtacataacactcagggagaaaatgtaacttaggggatgctggtgttgaccaacacagagtgactaaaatatatgtcacattcttcaaatgtttgcataactgttttcttttgtccaatgtacatttaacataaacatcaactaagagaccagtcgctgatgtaatatgtgaaatggtatcagaactgtgaaagagtttatatattctctgcagtgttagatttgtttttgcatggctaaattaagaagagttataccccaacaaagaaatgttaattggtctagaactgacccaaaacccaggagtaccaagtttcaaagacactcactgcttgctttcctctgaaaatgtctacagtcaacacaaaatagaactctttcttcttaaagcaaaatcttgactgagcgtcagtaacagagaggtgtaaagtttccaattaagttgaaaattccagttgatgaagacgtaactccaatgctattcattgagctggttctctatcttcctagcgtcagtaaattcataaaaattcgtgatttcctttgctttccaagggagaactcaacctttctacttactgttagaccagtacattggtgcctggccccagtgcaagccaatggctctgccatgtctagtgcccccatttcatggagggatgggcagaggcattttcagaaatgctcgtctctgcagcccttcacttggaacaaatgccacaaagatctctggagatgctttgttccaggtttttcaacagtttctgcatttggggatgaggaggaattcctaccaattttggtagttcttgcaagtattggttagggatgctctgtccttaaacccatttatgcctagtttccattatcggaatgctgagcatgtgggagttatttatatcctgctgctcagggtcatcgccaaggtctgattgcagaaattcaaaaagttgcaacctcaggcataaatgagttaagggagatgccagcatatgtggctgataggttcatcaaatgtggccgtccagattgctgagtttaaaacatgctgtactttaatgatgtggtatgggagaaaaagaaggcaaatatcccagtaaggttttgatactgattacatgttgaaatggtaatatttgggggcatgttggagttaaatataatagattgctaatgaattttaccagtttctttcttcttaatgtggatcccagaaaattgaaactagcccataaggctcactctctatctctattggacagtgccggtttataaggagaagggctgtcttttcttgtatgataaatgtttccagagaaaactttgccagaatagttactaactttttcctttgtttgcggaacacagacaacaataatttgggatgcccacacaggagaagccaaacagcagtttccttttcattcaggtgagttttttgttgttgttgttgttgtttgtttttttgtaattcaaaaataataattcaggtcgagcccagtggcttacgcctgtaatcccagcactttgggaagccgaagcaggtggattgcatgaggtcaggagttcaagaccagcctgggcaacatggcaaaacccatcactacaaaaaatacgataactagccaggcgtggtggtccacacctgtagtcccagccacttgggaggttgaggtaggaggatggcttgagcccaggagatggagtttgcggtgagccaagattgcgctactgcactccatcctgggcgacagagccagaccgtgtctcaaaaactactaataataataatccaaaattaggctgggcactgtggctgatgcctgtaattccagcacttcggaaggctgagacaggagggtcacttgagcccaggggttctagaccagcctggacaacaaagcaagaccccgtttctacaaaaaatataaaacattagtcgggtgttgtggtacacacctctagttttagctacccaggaagctgaggcaggaggattgcttgagccaggaaatcaaggttgcagtgagctgtgattgcaccactgtattccagcctaggtgacagaatgagatcctgagatgccccttaaagtaactgaatgcgccgagtatggagcccaggaggcctcattggtcagaaggagacccattttgtggcaagcattgattgctcttaaggtttgcaagatagagatgacctcggcacccacctgctcagagctctgaaacacagcagtgagccagccacagaagcagtgcgggctcctttctcttgctgttctaaagggatgctgttttgggggctccctgaaaccactcccaggattggtggtttgctgcgaggacccccaggactcaacatactcacagctaagatttctaacagcacaagaatttagtgcaacattagcaaagggaaacggtgcacacggccaaatccagagcttcgaaggctcctctcccagtggactctcacaggccatgctgaattcttccaggaataagttgtaactatgcctgtgaagtgttttataccagggaagctccatagagtctcagtgcccagagtttttattgggggttggccgtgtaagcacccagtgcctagtacaagccaaaactgcagacccccagaaggaaagcaggggcacagcataaacacactgtttgcacaaacaagtgttagcagagtgagccgcttgcgtctgttaggggagggtgggaactctccggaaatctaaaatctcagtcgctagccaagggccggccttgcaagcaagcctctgtagggagatcagcctcgggcctgtggtgttagcaccttcctacacagatgtgtggccgctgctctggagccaactacatccctttgtgcactggagccaggccaggccacatgcgttacccagggctctggagtctgtagagattccgattttccagattcccacctgattcttcgtgggtcgttttgggtttttttgtttgtttgtttggagacagagttttactctgtcacccaggttggagtgcagtggtgcgatctcagctcattgcagcctccgcctcccatgctcaagcgattctcctgcctcagcctcccgagtagctgggattacaggcatgcaccaccaagcccagctaatttttgtatttttagtagaaacggggtttcgccatgttggccaggctggtctcaaactcctgacctcaagtgatctgcccacctcggtcttccaaaatgattcttcattttctttcccacctccctcctctgtgtaactcagtcctgatgttagacgtggcctcttaaaacaaagacagatggccacccgcagagctaatagactattggaagtctttagactggcttaaagtggacagaagtgggtaggtgccacttcccttaagggcaaatgtctgatccgtcttgaaggaatccctaaatatgtgggacgaaagttaactattctatcagctgtccctggggcattgtccaggaggagatctgagtgtctttcttgtcatgcagcttggggtgcttaaatgatgttctgaatgggagggctaactgcaacaaccatccaaggcagaacagccatcggcgcctggggagggctccaggcaggggacatgggccctgcaggaaacaagaccatgaaccgaaggtcccgtcgaggcacgattgtgttagatgcataggcacccacgtctgttatattccatgcagtacttcagcagggactcctcatacaggcagctcagagagtgagggagactcagggaggacgctgtttctgctctgctgccctggagagggagagccactcctgcacagcttgggacccacaccaaacacacctctcagggttgccggtgaaatttgttactggtgttgctttaattgacactgttgatgaaggtgctgagcatacgagagacaaaaggctcccaatgcaggtagcacgtgtactaggtcctccagaaagtgttcttcaccccaaagggaaaccctgtacccattccatctttccctggcaactccacctacagcctgtgatctgtgtgtcatctccatgccagacacttgctactctgtgctctagactgcaaatcaaagcaggtggctagtgagaatagccttcctaatggagttccgtcacgtttggcttaagtgccaaaacctacctttgtaggcaggaaggatgctatgacaggttcacagccctagacacgcagaccccggggggtgaggcagggatgtctaatgcagaaagctctggcttctgtttttcagagaaaaatatgcccgaggtaaacatcaataaggttcctctaacacttgtgtcttaagaattcatctgtaaagtatttcagcagaaaataatctttcccaaagtgtccccaggccctatggaagggtttcctacccagctgacccaggaagaccacaaaccacattgttctgaattgcgtgagcttctcacctgtgatctggctggccatgaggtagacccaattcccgtcggcaggtcagacatatctaggcgttacttgctctctttttggtgtcaatcagtgtgttaaagaacgttcaaaatgaagagaaagaagctcgctcttccaggtgaaacgcagctgggaagagctgtgaggagcgcctttctgtggctgtggcaggtttggtgtttaatggggcgataggagacattgccttgccccactagcttttccccagtaacacctcgtgggggcgcccttggtcaccgtcggcaggaagccttagctcagagcctcgtggtggagtgaaactcggccgcagaaaggaatgaactattgatgcacgacagccaggagagatctcaagggcattttgccgagtgacaaaagccagtctcagaaggttgcatgctctgtgctttcattgatgtaacgttctcataatgctaaaatgctagaaacctgggacccgtcagtgctgtgggagttgagggagcatgtgaggaggttgtgtgccgatacagtagctgagggagatcttagtggcgacggaacacttctgggtctcagttgcagcgatacacatctacccatgtgataaaatgacagcactctacaggcaaattgcaccagtgtcagcttgccagcgtcgatacaacgctacggctacgcgaaatgtaaccctcaggagaacctgggtgaaggagacacaggacctctctgtgttacctttgcagcttcctgtaaatctctaagtatttcaaaaggaaactgactggctgggcccagaagaatgagggctattgaaccaaactggcctatgcatgggagggagggcacagaggcccccagtgtagctcagccctcttaccggccattcacccacatggttccaagcattgtggctgcaggagctgactcagagtggggctaaccacctgagcacgggggagcctctctttagatcaggaatgtccagtcttttggtttccctgggccacattgaaagaagaattgtcttgggccacacataaaatacgctaacactaacaatagcttgatgagctaaaaaaaaaaaaaaaaaaaaaaaaaaagaagaagaaaaagaaaacaactcttaatgttttgagagagtttacagatttgtgttgggccacattcaaagccatcctggaccgcgggttgaaccagcttgctttagatggaggagtcatcagatgctggtcgccatctcttggaccgctcaccagattgtcacatttccaggtatattaatcacatgccgaaatgcagaggctggaccagaagtttgctgtttagctcaggcgatgttgtaaacgagaacgaagaaaatgcgtcaagaactgtggggctgtcatgaaacacgctgctggggatggaacagaagagatgatctcagatgtggaaaagaccattgctgacacccgcgtcctcccacccacaccttccgcctgcagggggagctggatggggaagcgaatggggtccctgtgcttatggaggataaacacatggaggcttgcacctcttatttgaagaccgaggaagaataggggcaattgatggttagtattcagagaaagctggattcttctcagttcagcgctgactgcctttaagaaacacacatggctgggtgcgttggctcattcctgtaatcccagcactttgggaggccaaggtgggagaatcacttgagcccaggagtttgagaccagccagggcaacacaccaaaaccccatctctgccaaaaacatctttgaaaaaatgagccaggcttggtggcgtgcacctgtcatcccagctactagggaggctgaggtgggagaatcacctgagcccaggagattgagggtacagtgagccaagattgtgccactgcactccagcttgggtgacagagtgagatcctgtctcaaaaaaaaaaaaaaaaaaactgggcatggtggcacacatgtatagtcccagctactcgagagactgaggcaggaggattgcttgagcccaggagttcgaggctgcagcgagctatgattgtgccactgcactccagcctgggcaacagcaagacttcatctccaagaaaaaaaaaaaaaaaaaactcacataagatgagtttctatattggtcgattggtaaggacatggtggccagagcctggcagaagctaaccctctctttcccctagaagcaatgcttcattattggctaattcagtgtttacagctaccttggagaacataacttggcaaataacagaatggaccatagtatctaggaaaaccaatgagagttcttggctgggcacacttgtagagttgccctaaccctgctgcctcctctcctgggggcatcatggagcccactcagtagctaaaagtaatttccatgggcttgcatgggaagcgcagggttacgagaggtggtcagatgcggacgactagctctcgaagtcccaagctctctgccccgtaaggcattacccccttaaattagcatgaaccctgggaagggaggcactgtccctccatttcacatgtaatggagcacagtacttttcacacccctaaatcattccttttgatagtcagggttccggacacggggctggttgtggaggtcctctccacacaagaagcctcatgatgatccttaataagagggtggggttgctcagaaccttcaggggaagggaagagatcaccagagaagggaagggaagagatcaccagagaagggaagggaagagatcaccagagaagggaagggaagagatcaccagagaagggaagggaagagatcaccagagaagccgcctcttcccctgtgcccttctgtctcggcatcgcatggccttttctgctgctcatcagttctctggcatgaggtgggaagaagcccagggaacatgatctgctggtgtggcccccgcagtggaaagagaccggagacctgagcacagcgcccttcctggcccctaggaaggcgggtgacccctgcagtccgtggacgcctgagaggaggtggaacagatgctcgctcccagccgcagacccactctctgctagaggacaggagtgagcagttgaagccatgcttccccagaagcagaagaggatgagagtgcacgggggcccccaccgtgggaacttccacacctccagcgcactccctgtcccgggcactgctgatctcctgagatgcctcggctctctcccccttgtctggggctgcttgcaacatccacatctgtagctgagactccaggaagccgtcaacctgcagctgcacatcagtaaagaggcagaacgaggaatgaggtccatttgctaggacttcagtgcccttgctgtcacctgtgcttccagtgcctctcagggcatggtccagccctgtggaggcagacgctctgaggacagaaccagggcctggcttttagcgagtgccttggccattttggtacattgggaagttgttggattcccagctgccatcctagaaaataaatcagaaggtagagaatgagacccatagctgtaactaaactacaaggggaggtcagctccccgttgttctgtctttgtgaccctgaaccacctggacctgagaaaggcccaaagtcagggagggtgtcggtcacaggccctgaagtgtgcgttccgtttcatcccaaaggggtttttattgaccctaattatcccctagtcaaggggatgccttaatgtgttacaggagagtttttttcatattgaggtatcttgaacataggacatgaaatctttcctctccttttttctcctctttgtccaaaattaaatcaaatgagctcactgcagagatgccgctggaagcagcaaggtacagagcaggcagggcggccctctcacctgcccttcttaactgtgccatgggagcgggagattctgcaggctgtggggtgcaagaagtgtcacggagcctctctcccaggacatcttgtcatccctgccaacgtggcaggagagggtctttaaggtcttagaaagagactgtgttcacgcttgagacgtttttatcatgttactaaatggggcttcttggctgggtgcaatggctcacgcctataaccctaacactttgggaggccgaggcgggtagatagtttgaagtcaggagttcaaggccatcctgggcaatatagcaagaactcgtctctgcaaaaaaaaaaaaaaatttaaattagctaggcgtgatggcatgcgctattcagaaggctgaggtgggtggatcccttgagcccaggaattctaggctgcgttgagccatgatcgcaccactacactccagcctgggtgacagagcaggccctgtctctagaataaataaataagtaaactaaagaggcttcttgattgtgctgttcattgttgtaaatccatggagctgtgcaacagtgagtaactccagatgtcctccctccctactgcagcccctgcccttgatgtggactggcagaacaacacgacctttgcctcctgtagcacagacatgtgtatccatgtgtgcaggctcggctgtgaccgcccagtcaaaaccttccagggacacacagtaagtgagagctcttgtcactggtctcgagtttgtgagaatgtgatgtgggagccgattcttgtgtgcctagaattaaaagctactgcagcagcagaccagctctaatgtgccccttggctatttgagctgtcatggttaccccatggtaaccatggtggttggattgactcagtttggggttggcagtgagaacagttcactcagaaatgacctagatggtggatttggcaacaaagcctttaaggtagccatgagaaacatgtagaggacatcaaggaaaggatgctcacaataaatgaatagacggggcacatctgcagtgaatagaaaaaaaaatcattaaaaaacaaatggagactaagtgtggtggcttatgcctataatcccagcactttgggagtctgaggccagaggattgcttgaggccaggagtttgaggccagcctgagcaacatagcaagactctgtctctacaaaaaattttaaaaagtagctgcgtatggtgatgcacacctgtagtcacatcccaggagctgaaggctgcagtgagttacagtagcaccactgcactccagcctaggcaacagagcaagaccttgtctctttaaaaaaaaaaaaaaaaaaaagaaaagaaattgagaactgagaaatataatgtctgaaatgaaagtcttaataggtgggtgtattaggcagttctcaattctctcattgctctaaagaaatacctgagactgggtaattgataagacaggaggtttaactggctcacagttccttaggctatacaggaagcatggcagcatctgcttctggggaggcttcaggaggcttccaaccatggcaggaggtgaagcaggagcaggcacctcacatggccagagcaggggcaagaggtgggaggagtggggggggtgtcacatacttttaaaggacaaaaactcacgaagacagcaagccacgagggatctgcccccatgatccggacacctcccacgaggccccacctctgcatcagggatgacagttccacctgagatttgggtggggacaccgatcctaaaccacatccgtggatttaccagcagatgggagattgcggaagtaaggttagagagcatagaaattggccaatttgaagaacagataaaagatcgaaaaaatgcataaaggcttaatggcttatggaacaatatcagagaccctaaacctatatgcgtgatggggagagaagaaagaatggaacagaaaaatcatttgaggcagtaacagccaagttttcctaaatttggtggaaaacatcaacatttaatccaagaagctcagcaaatttcaagcagaacaaatataaacagaaccacacaaacagaacagaccatatccacctaggcatatggccatcaaacaccagaatcaatgacagagaaaatcctaaaggcaagcagaggctgacaaatccattatataccagggaacaacaatgggaacaacagctgacttagcaaattccttagtttggcctctgaggcgcttcccggtctttcaccaaatctccctcagattagccaatttctatggtctctaaccttctgcaatctccagtctgctggtaaacccatttactagcctcgacctcctgggctagtgtccaaaaattccctgtgcctctgtcctcctaaagacacgtgcagccaagcaccttgccccgcgctgagccctgcctggaatgctccctgccttagacccccacagcagctctcggtccaaaacagaatcctccccagtctccaggcccattcacgtatcctctgcacgccctggggaggattcacggcaccccctgagctcctactgcccacatgaatgccacagccctggcagtagctgctggcctgcgtgtctgcctctcccagaaaacgcagagtgcatcaatgctgggaccatggcatcttgcctttctctcaccagcacccaggatatctctgtggtggggcagggtgggggtcccttgttaaagcaggagaggatggtcacagtccctggagatttgccattgtgccactaacttaactgatgtaaattcccttgtcctgattcccctaatgcccacctctccccacccctggcccaggggtccctgtcccaaaggaaggcgcttttagagcacaggcacctatcgtcctgttaacatctgtttggctccaaactgactctcttctcccggtctaaacttatttctcctctaaccctggactatccacaagtttttaatagagctgtacacactatctgcagttcccaggtgtcctgcccaggaccttgccaccagcacaggccttggccctttaagtgggtcttaatgtggctgatggccctgaacaaagctccagctcagtggggttgagtggagacccatgagccggctctggaggcggcccaggaaccggggcttgcattgcagagctagggatccgctcccaggaagttatttgttcctttgcatgggcttggctagggacagccagtggtgaccagctctacattcctgggcccatgagttttcctctgaacagctgcagtcagagccacccttgctggccttgcatacacattcacactcatagacacccatgcgtgtgcacactcacaaccctcagccccctctccagtcggccccctccaccctcccgggctctcgcagcagcctgcccctgggccgcgaaacttcttcctcctccctttcctgggccacgtgtgcctcatggaacacagatgtggccttgtcactgtccagttcacacccttcaaaactccatgttcttagaaagcaacctgaccatacagttaatccaaaccggagcccttaggagtatgaaatttagaaaattcattatgagtgtgtcattagttaattgttaggccgggacagcaggtgtcacatggtgggactggactggacatatggggccctatagtcacccctgagggagccccaagctggtacgccatgtcccctcatttctcctgggtaggctgttccccagctgaacctttgccacaggtggttcttttacacatgcctgtcccggtagtgtccccgtctcccttggcccctgggtacattcattcacctttatcctccagggtttagcctcgtggtccccaggtgtcctgagcctgtgcttttcgctacctggctgtgccgatcacgagcccccagccaggattttgcctgtgtcatgtgtgtttgtgccactcagcatttgcctctcacttgtgttgcacatgtgtgcctgcctgtgtgtgcatttgggtcgcccatcttccacctggatcagcccttaccccgcttgaactccgtaataggtgagggttcacttctcatgtttacccctccctccgcctccactcacctgcaggagagaaataccttctaatgggtgtggacactggaggaactgttacattaaaagtgcataagaggcctggcatggtggctcacgcctgtaatcccagcactttgggaggtcgaggtgggaggatcacttgagcccaagagttcaagaccagcttgggcaaaaatcccaaaaaaaaaaaaaaaaaaaaagggcatggtggtgcctgcctgtagtcccagctacttgggagggtgaggcaagaggattgcttgagtttaagaggtacatgctgcaaggacctgtgatcctgccactgcactccagcccgggagacagagtgagaccctgtctgaaaaagaaaagtgcataggaaagtgattttcaaaggccaatttaaaaagtaactggttttactggttttatttgctgcgttttatggtatgtgatttcttcacttgccttccttcctagcagggaaggtttttttcttaatgaagtatggatgagagtggctggtgttgtgtggtatagggctgtggttttatataaatgaaaaaggcaaagtgagaaaaagaggaaactagatggctggttgggctgtgccctttgatgtcaggctgaagccgaagaccttctgcagcgccggtggcgcgctgctgccccctgctggaaggtgacctcatctactcacaggccctgatgtctttttcacactcttctgctctctttcagaacgaggtcaacgccatcaaatgggatccgtctggaatgttgctggcatcctgctcggatgacatgacattgaaggtagagtcggcatggcaaggggtgggctgtttaatcctagacaaccccgggcacttgatgccagtctcacggtcactcttacatgaggattatttattactgaccaccctcccttcctctgtcatccggtgagctacgatttctcagtcatagtcccactgagaatcgcagcctccctgcagcctttctcaccactgtgcaccctccaccctgccctgggccccgtgtgcacccccgggaggaatgattccacatcgttcccggatgcaggaatggcttttgctcatgttgtgtctggtgtgttctgtagatctggagcatgaaacaggaggtgtgcatccatgatcttcaggctcacaataaagagatctacaccatcaagtggagccccactgggcccgccaccagcaacccaaactccaacatcatgttggcaaggtaagggcaggcaacacagctggcacagctcggtgttacacaaagacaacaggaaattctgctaaagcgcgtccatgcacgtgtgttgaagcccttcagaggaagcaaagcggtagctcactttgaaggggccaggatagaattaccgagtaacacctgcctttgaggtaaggatggttttgagtcaggcacagtggcttacgcctataatctcagcaccctgggaggccaaggcaggacgatggcttgagcccaagagttcaacatcagcctgggcaacatggtgaaaccccatctctacaaaaacttagccaggcgtggtgacgtgtgcctgtagtcccagctactcaggaggctgaggcaggaggatggcttgagcccaggagattgaggctgcagtgcgcggtgatcacaccactgcactccagcctgggtgacagagcaagaccatgtctcaaaaaaaaaaaaaaaaaaaacagaagaagaaaaaaaaccacccaacatgactgcagagccacagttgagggacagcaagccaggcagcaccaactcctgttgacggtgctcgaattaaggtcatctcttagagaggacaggatggaattcctgcatccactgagagacggaaccaaaaaaacaaagaacacataggccgtaattctcatatttcaagtaattgtcataaaatccacttaaagtactgtgatatagtgtgatatagtactacacactcgagttgttttgtgatgactcagaaggtgcttttgcgtcgcgtggtactattaggagcataaattatccttttagtcagcaagtataaaaggggcatcccggtacctaatgggtccctgttgaaagaaagcaagccagacaatagctttgtgatagatattactgttctaagtttgaaaataactaaaatttgcagctttcaataatgtgattacgtatgtggatgtgattgtattttaattcttgtttgattaaaatttattttctatttagagacagggtctccctatgttacccaggctggtcttgaactcctggcttcaagtgatcctcccaccttggcctcccaaagtactaggattacaggcatgatctactgtacctggcctaaaaagttttttaaatgtttattcacttaatttgctatttttccaaatatggctgtctgtattaatttagttggtaataatagatgtcatgttttaaattgtaggggcattttaggaaacttgataaatattctacaaaaatatttaccatttacgtctataggaaacatagaaacagggctgggcgcagtggcttacacctgtaatcccaacagtttggtagggtgaggcaggaggatctcttgagcccagaggttcaagaccagcctgggcaacacagtgaaaccccgtctctacaaaaaataaaaaaataaaaattagccgggtgtggacctatggttgcagcttctctgctgaggctgaggcgggaggatcacttgagcccaggagttcgaggctgcagtgagtcatgatcacgccactgcactccagcctgggcaacacagtaagaccccatctcaaaaaaaaaaaaaaaggtgcagaaacaaatgtagatatcaaattgtttccctaataagaccattaaagctttttttctgtttaatgactatggctttgtttttaatacttgtaagtagttacagtttagaagacaaaaagctttttagttattatcttttgaaacgtaaaagctgggaaaaacaactcctggagatctgatacacattatggagaactgtttgaaaccaccgtgtgtatgtgattttgctttctctcccaccttgctagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcaggtaagctcccgacccctacaccaaatccttttagtaagggatgcccaaatagccacgactccagtgcccttggctcagagcagtgccccggagggagttgagcaagctcaggctccccgggcagacccagtggatgctgtccacgtgcaccccacgtgggctgtcagctcttcccccaccagacacctccggcagctcccctccctgaggaagggcgtcgtgtccaccgtaatcatggctcttggccatttgattccaaaccctcaccttggcacacgttcttccttgaaggagccgctgtcttctgttcacttttctgagtccatggcacgaaaccttccacctgcctcttcctcttcttagcagttatcaccgaagtgctgctctctagatactgaggttagaaggtgggagtgggggaccagctaacggggtcaaggccacaccagctcctgcagctcccttacggagcagaccagggagtgggaaggaatgtgctcttgctgttgtcatgccacttcaatttttcttttctgttttgttttgttgttgttgttttttgtttttgtttttgtttttgagacggagtctcactctgtcacccaggctggagtgcagtggcgcgatcttggctcactgcaacctctgcctcccagattcaagcaagtctcctgcctcagcctcctgaatagctggaattacaggcacccgccatcatgcccagcttatttttgtatttttagtagagacagggtttcacatgttggccaggatggtcttgaactcctgacctcaggtgatccgcccacttttgcctcccaaagtgctgggattacaggtgtgagccaccgtgcctagcctcaatttttcaaatcaaagtaggttctgtttgaggacataaggtatgtcaatattgggttgtccttttagcagggattgaaaggacataggatttaaataaaggtggctgctgtgggtatcttgggccacacctgaggatagaagaattccagctgtaaagtgtagaaatggatgggaagtagcactgcatagcataaaggattgtatagggccatcagcacgtgattctagtctaagggaagagagaggtgataatatgctaggagctgttgaaaataaggaaggggtccctttcgcctcaggaggggaggaatcacacagccttccccctgccccctttcatctgcactgccttcttggttccttttggcttggttgacattcaggtggatttataccctcaagttcattccccctgtggactcaatggtgatgagccctgttcactggcaaggggtccactgagatcacaggcttcccagggacctcatgtgaaccacatcctctcagggaaggaagggaaatggtggaccctgcgtagagccaacccgacgccaagcccagccccacagccctagatagctctccgggaagcacgcatctcagcactagtgtccaagagtctccgttcctgaaatcctcgctagaaatagtaatgggtggatttgtaaaaagaacacatcaattatcaaaacaatgacatgatcagttaggtacagcctgttgtcaggaactcactgaactgtttcaacccttttttataaatcaaagaaatccttaggacttttcttttttttttttttttttggatcggagtttcactctcgtcacccaggctggagtacagtgatgccatctcggcccactgcgacctctgcctcccgggtttgagcgattctcctgcctcagcctcccgagtagctgggattacaggtgcgcaccaccacagccggctaacttttgtatttttagtacaaacggggtctcaccatgttggccaggctggtgttgaactcctgaccccaggcaatctacccacctcggcctcccaaagtgctgggattacaggcatgagccaccgcgcccggccaagaaatccttaggaattttcttaagagaaatcttaaagcccactttaatctttctccaagtataaaaatacttatctgtaatactgccgacacacacctttctcagttcatggaacaccaccctttaaggggcccaattgagcagaggatttgggacagccctcctggtctcggtgttcagatttctcctgcctgtcaccatagtgaatcatgagtgaaggcttattcgactctttctctcttttttattttttaaaattaatttttgtagagacgaagtctcactgtgttgcccaggctagtcttgaactcttgggctcaatccgtcctcccgcctcggcctcccaaagtgctgggattacagggtgagccacctcgcctggccttattcaactctttcaaaggcctcaacttcccctacctcttagatttgtcaagttaatgctgttttaaaccggaaaccaatggtctgtggtgttttccattacatgtatattatgcatttcttctttcaaatgtccaaaaatacgtacattttaatgtcatggcatattattacatttaatcatgaattacagtcaatttaattgctactggggtgggtgtattcattatgttgtattcattcaggtcctccaaagaacagacaccagaacaggattagatgggcgagagatttattgggggaaagagctgtgatggaaacagggaggaaggtagggggaagggagaattcagaccataaggccagtctgaccctgggaaggagacgggaagggtaggaagagtcagggatggcccttacaggtctgtagaaagttttggtcgtgctgatggagagtccatgagccacttacccaccagatgagtctgagtctcagcaggtgactgccatggtctcccgcctccatcagtcctcagctgggtgcagcctcagaatccacgcaaatgtggcagattccgcaggcataagtaatcaggttcactcctcgtggtgggaagtcctagaggcacatctccatggcccccagagtccttactgaaaacccttaaatttcaccatgcttgaaaatgttcatgacgaaacgtcagggccggaggagcgcacattccacacctgcatctgtcgcaggcgccccttgcgttgtaagtgacagctgctttgctttgcagagtggaaatcttgtccacagctaccgaggcactggcggcatcttcgaggtgtgctggaacgcccgaggagacaaagtgggtgccagcgcgtccgacggctctgtaagcaacacctctggtttgctggggagtggggtgttgggggcagctgatgcctaagtgagcttccagggcgtgtgcagcattcgtgtcctgaagggcctagcccagtgccaaaggaagcttctgggctggatcccatcggagttggtaccacatctgggaatggccttctccttgtcccttccagagtgtccttctagtcaacattttctcagtcaaattggtggttctcaaccagggtgattctgcacctctaaggacattagacaatatctggagccattttaggttgtcactacagtcatgtgtcgcttaatgacgggaacgttttgggaaatgtgtcattaggcacttttatctttgtctgaacatcatagagtgactgacacaaacctagatgataatacctgtcccacaccgaggctgtgtggtacagcctattgctcccaggctacaaacctggacagcgggtgaccatactgattcctgtaggcaaccagaacacaatggtaagcatttgtgcgtccggatctatctaaacatagaaaaggttcagcagatatatggttataatcttacaggaccactgcggtctgtgcggtgcgttgttgctggaaacgtcattatgtgacgcgtgactgtgcttagatgaggatgctgctaaacctcctactgtgcacagggtggccacaattgtcacccatgctgtggctgagaagcccgggcctctggtggccatcctgcaggtctcctgggccctcttctcttcccatggggcatctggatttcttattttcccctggacttgaggttgccctgacctctggggcaagcggccgttctggctgaacggccaagggtcagagtagtccccaaatgttgtcagaggctgtgtacttgggctcgtattgtcatctgccccacgattgcaggtgtcccttctgggacctctgccactctgttaattcctatcattacccttaacctggcctttctgctctgtgctgtttgcttcagtttgctcggtccgatgtccagatgccagtctgttatgagagcttctctgacccttcatgacgatgttccaataaactttactgacaaacatcggtggagggctagattgggcgtgggggccgtagcttgccgacttctcactctaaaggcatctttgtattgtctctcaagatgacaggtgctttatctttccttccaggtgtgtgttttggatctgcggaagtaaccacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggattttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagtgggtagggtgcaatctggtgtgtgttccagcagtgagacggtgttattgtgaaggtggcattcatctgcggagccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcctgcggccgcaagcaaaaccaagcgcgagatgcagctagcacccttcatatccatccccgttctcagcgggacaacaccatggacagccgttttcagagcctccagcatttgcacaccactactcaccctctctgctgctggcatgttggtagagtcatccctgtaatcaagaaatggcctgtggaatgttattgttcaacgttgtttacagctcttaaaacatggtgaggaatgcctaagtcttagtgaccaaacgtgaccttgaaagcagacatagcatgacagaccttcctagagtgtttggtcgggttcacagtgaccgagagtcaggtccagcacacacctgggaaagggatgctgccccaagggggaccaaaagggccggacgttacagggtgaaaccctctgacccctcgcgacaccgtaggacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaaagcttatgtttcttgtcaaatgcagaaatgttccttccgccactcactgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaaaaaaaaaaaatcaccttgtgtgttgtagctcatttgtttcaagagagaatcaacagatcatattcagtgtcttgaataaattgctctattttgatatta

SEQ ID NO: 2954 - DNA, 255533 bp, human
cccagggagcccaggagcaacgaagggcaggctcaagggaaggccccaccatgtccttctggggggccttgaatggcaactgatacataataagacacaatctattctgctgattcacaattatggagactgtgtaagtgtgtatttttttattgatgtcctctaatgatggtgtagcaacagtcgttttgcatcattgacgttttacagcaatattttgcagggtaattttgaggtccgccgttttggtggaggaccggcctcttaaaaactcacctccggccgggcacggtggctcacgcctgtaatcccagcactttgggaggccgaggccggcggattgcctgaggtcaggagttcagaccagtctggccaatatggtgaaaccccgtctctactaaaaatacaaaaaaaattagctgggcgtggtggcatgcgcctgtaatcccagctactcgggaggctgaggcaggggaattgcttgaaccagggtggtggaggttgcaatgagccgacagcgcgccactgcactccagcttgggcgacagagcgagactcctcagaaaaacaaaaacaaaaacaaaaaaacaaaaacctcaccttaggtccccctccccctacaaccagaacaacaaatggtctagagttcgaggaagagcaagtgaggttatagtttagattgctgagtgtaccgggctcttagcacgaagctcattatatagtaaaggaaggggcaagaatatttgaaaaatattcaacgaggctgaccccagaggtgctggggagggggagtggagatctgtttaactgaattaaggctgcgagtggttgggagtagcctacgtggaggggaggaaggagcgctggggacttaggtacaccggggccaggccgtgtaagccattgcaacataaagcactttgcaagggccagagggctgatgcctggggggttggggtgggagtgatgaggcccgagtgcccaggtccccccaacctcctcagcccccacacccgagttcctggcgcctatgcctgtgtgtctgagtttgtccctaagcatttctggctcttcttgggaggtgttttgcaaaggtcgaggctccgccggaacccccactttttgagctggggtaaagactactggggtgtcttctaagacgccgattttgagggagattcaccatcgggcaggtggcagggggttctgttggggcagccgggtggcttcctttttggggtgggggagggtaacactttagcagtgatcgaggttcccctgccccctagaaactgagggggtggccgaggttcccgtcccctcgaggcagtcgtggaaaggctgggtttgggatgtgatgggggtagccctggggtcctctcagtcccacggaggccacggggaagggaccgggaccagagcaactagggagaggcccgggttcccctcacccaccctaggcgtgggggagcggggcgggcttggtagggacgctggtcccccgaccgtgggacaggggctgggttgggacgcgggtccccactaggagccgcgggggaggggcagggccggagtccctaccctcgtaggggaggggctggttcgggacgcggctcccccggggcgcaggggcggggccgggtggtacgccgggtcccctcccacggccgtgagggaggggccggcggcgggggcggacccctggcggtcctcctggctggggtccgcgcgctcgcggcagctccccgtggaggtcactgtccgtgccagtccctcccgctgtcccgccctctcccgctgccgccgccgccgccgccgcgcccgcctcagcgcccccactccgcgcttgggagcgaggagccgccagcgcccccgccccgccgccgccgcagcgccctcaggccgccattcgccaccgaaactttccagcgcccgcgctctctccgggactcggcggcggcggggcgggggcggcccgggggcggcgcgcggctgctccggggcgccgggccctcttcggccgccgcacggccgggactcggaggctgccggctggagggaggttcggagcgcggccgggcgcgcggcgccgccacaagttgcgctgctcgcgacgaggtgagtgcgcagggctcggcgggccgggcgcggggtccgcaaacttctgcggggaggcgggtcccgcgctgaccctccagggtccggccggcggctcggggcgcccgaacgctccacccgcccctggaactcctgtaggtgcaggtcgccaactgtccccgcggcgctcggactggggtgcggcgcgctcccaggagcctgaacaataccccgaggtggccgctccccgaagtgccggcgcgccttgcggggagagacggaggtcggcggggggctcctttgttttggggagggggaagtggccggtaagtttagggaagcgctcggcttttcctccggtgcccctttgtctgccgattcaggggcttgctgggcaaacctgcgccaccgcgggctccggggaccggggtggagggcggtggcgggatttccccgctgttggggagaagagccccattcatacccgggacgcgggccggccctcccggacccgggtggaagcgcagcctcgcggagtggggcaagcggcgggcgaggtggcgcgggccccgtgtctgctcagtttctgacgcgcagaaactgtcaaggaagtcgggagccccagtcctccgcccatctccccggcctgagcgcacggctgggctgggggcacccttggcccgtcgagggtctgcagagcgccgcccggggagagcgcagacctgttgctgctcctgggctctgacggggcgggtggggtgggtctcgcagatcctgggccccggccttgctatccagggggaccttccctaacgatgggaccggtgctcggagtggagtatggggagtgcgccttcgggagtcggcgctggccggatatgtgacaactgtgggtcgctggaggcccgcctgcgctgggatagggcctggacttcacgtgcgtcgcctgtgttccgtcagaccggggccggggctcgctccctgcaaggcctcgtgttcccccagccagctgcgttggacgttccacaaaggtagggactgacgtttattctcgagtcagtgatgttctggagcaaaacctaaaaagaaacaaaaacctaccctctattgtatttgcaactgtttctgctttgcattgtcatgtgtggtttgacctgccttttggatgttttcctctcctgaaacatcgcccagtccctggtttaacctggaaggcgagggggaaggaaggcaacctccctgctaaggttccaggcagtggctttggtgttggaagtggcacttgacgattttatgaaaagtttacaagtccttcctagaaaagatgtaattaggaaaaataaaatacagaagaacgttgagtatgacgcgtttattttaaagggtagtcctgtctcaaatgtgctgcacatttttgtggaaagccaccaagctgggtaactaatgcaaacaacaaaagttgttcatcactggatcaccggcccttaaggcgattccagcccttagtagaacacacacctgtagggcaaatatggagatttgtggtgtagtgctgccaccctcgctccccaactctcaggcattttgcccctttacctcagagaacttctctctgtcagtggttttaaagaggaaacagtttgcaaaaataactttattgtagacatacttagaagtgaatgtttcaatttctggagttttcccatcaattatatcagtaccactggttctgtacaacatcatcttagttagaagattttttttcaccttttaaggtgacgaacagaggcgggaaaatggtccctgcagagggaggccatctccagcaggtcccgagggtcaggaattcagattatccgatctactcctgctggataggagcacacctccgctagaacctgggtccggccccctcccagttttctgcagggcgtccagattccggtgctctgccccgcagcagtgccctgtgggcctcctggcttagctgatcagcacagcttctctgcccagcgaggcaggaccatcctcccactgctttcctgatgccttggatttgctttttttcctcccttaggaaaagcaaaaaaacctaatatgctacatccgagaagttgttaatctttcactaccacatgcattgaaaaatcagttccacccaggaagcaacactaaaggcatattgtaaacacttttttttttttagttggaaagataaacttttttcccccataactatttttagttagccggagactggactcgagtttttacctccggtcttgccccctccactcccgccctcactttctgtggggctcgaccacatggaccatgctggccagactggcaaacatgaaacccaccagaaccaaaagaaaagctggatatgggaaggggccgaagaagtccacatgtttctaaagggcaaagagcctaggctgaggagagacgtttcagatctccaggggagaaagacagccgttaaggagtccgccgggctgctgcctgcctggccagcgggagcctgacttcagatgcctgcgcctcccaagctggccccctcccacacagccatcgccatccagtatttagggagaatccaccgcatgcctgaaggttgcagaagtgaattggaaaccgttacaaatggaattggaacaaatttaaagttaagatggaagagagaatatgttgagttttcagaggaagtcgggtactgcttccttttcttgtctaggtttgttcttgtccgatgggatcagagagatttgagatggggcatgataggcggcgggttcaggagaaagggaagctttagaaatgaaggtagaaaagatgcttgcttattggaacagtattttcaacgttgagctctggaatgttgcagccaactaatggttctcatttgggacagttttgtcccccacttttgaagggagcatttgccaatgtctggagacatttcccttcctgcaactgttaaattagcaaacaggttgagccagctgggtgtggacctgcattttcctcgtggaggccctcttccaagtgtcagtaggaaaagggctcccagagtgtggtcctgctgcgggaccttggcccccacgtccaagtgagccccagaggtgccccaagccctgcctggtcatggggaatctgggctcccgctgaacttgggcgctggggacagctatgagggaaacctggtttgcagctagcttgccgtgcactgactggagctttgggcaaatcagtgaacttctctaacattaattttctcattgagagaggaggtgggtaggagtatatatatatatatgtaattatatatataggggtcgggtagagggagagagagatttcccaggctccttgtattaaaggagatagagttattatatttctcatttagtttttatttatttgtttattttgagacagtgcaattattatagctagctgcagcctcaaccttctgggcttaagcaattctcctgcctcagcctcctaagtagctgggagtaccaaatgcgcactaccatacctggcaatttttttatttttatttttagtagacacaggctctcactgtgttgcccaggctgctctcaaactcctgggctccagtgatccttcctccttgacctccccaagtgttgagattacaggtgtgagccactttactcagtcgaccgacatagaattattataatgcttggagcctaacatgccttttttgtttgtttgtttgttttttctgagacgaagtctctctcacagcccaggctggagtgcagtggtgcgatctcggctcactctgcctcccgggttcaagcgattctcctgcctcggcctcctgagtagctgggattacaggcatgctccaccacacccggctgatttttgtatttttagtagaggtggggtttcaccatgttggccaggctgggctcgaacttctgacctcaggcgaccctcccgcctcggcctcccaaagtgctgggcttatgggcatgagccatcgcgcccggctagcctaacatgcttatagtttcctgttttctgaagttgggaattgggtctggaaaggtatcaccatcagtcacgatggtgtctagtagtttgctttgtttttttccttatcttttccctcttacattttagggctgtatctatataattttattatttaaattaccatatggtaagtttgtctctttgggtgcattatgagtcttgacacatgcatagattggtgtgaccaccatcatcatcaggagagagaacaatctcctcagcccagagatgttcatggctctgtctcccacagttcctccacagtcaccccccccagccccgaatctggggcacccagccatctgctctgctctggaagtcttggggatcccatctgaatgtaacacatggtggaatgccttaggtgaatccatccgctcttccagtaccacctttgcctcctctctctgatgacacatgaacttcatgcctttgtgtgctttggccaaccgcttttcttagaacagcacattttgcactgtagatgttatcacaagcaaggaaaaaacagctttgctccttaatgtaagaaaccacagtggaaaaacatcaggtgtgttgttgaggctgctaaagctttgctcctttttaaaattttttaaaaatttttctggatacgtaggtgtatatatttatggggtgcattagatattttgatatagtcgtgcagtgtataatcacatcatggagaatgggggtatccattccctcaagcacttattctttgtgttacaaacaatccaattatactcttttagttatttgctcttttttcttttattttgagacggagtctcactatgtcgcccagggtagagtgcggtggcgcgatctccgcccgcaagttcaagcgattctcctcctcagcctccggagaagctgggactagaggcatgtgccaccacacctggctaatttttttgtatttttagtagagatgggtttcaccatgttggtcaagctggtctcaaactcctgacctcaggtgatccacctgcttagcctcccaaagtgctgggattacaggcgtaagccagcacgctcggcctatttatttcctctttgttctatgccagttagttcttgatgcctcattgtttcagatgggacattttctaatgtcgtgtttttgtttttgtttttttgagacagaatttcattggtgtttcccaggttggagtgcagtggcatgatctctcctcactgcaacctccgcttcccgggatcaagcaattctcctgcctcagcctcccgagtagctgggattacaggcatgcaccaccatgcccggctaattttgtatttttagtagagatggcatttcaccatgttggtcaggctggtctcgaactcctgacttcagatgatccactcgcctcggcctcccaaactactggaattacaggtgtgagcaaccatgcccgacctctgatgtccttttagaggatgttaccctcacctttattgcacagtcctaccaaaaggtacttcatatgtgaaatgtatcagaaggttatagtcatggctttagtttaaaaacaggatacatgttcattaaggacctttgccgttttcccaatgggttaatcacgtaaatataaaataggctaaaaatatcaagttgtttttgcctttgttgtagaaataaaaaaatgaattcctacatctgtgtttctatggagctgctaacctgtgttttactctgggccatatgtcgctttctgtgatctcatgacgtggcatgttttctaatataatccttgtcctggcattttggtgacttttgtcctgcctgaggtggtctacctggttgtgtgaagtcacagaacctgtgcatgtcctaccgtgtagagttaaagggctggatgagtggcctcaagccttttcctccctcccaggtgtgaagatttggtttggaagatggaccctgcttcaaggtctgggaggccatgtttttttcagactggttaaggatgacggttttatgttaactaaacattgggatcaagtgacagttgtttatgtccggtgcctagagtatcagttttcccatgattaaaataagcgatattttggtaaacattgataagttagttgcgcattttagttcagaaacccacagcgagtcagaaggcgctttgtgctgctgggcgcctctgagtgattccggggagtgcggcagttctccagccccaggagaccctgtgaaagaagcacaaacaatgctcacggcaaaactcacagtgtttattcttgacctgggtgtctgccttgaattcttgtcatttttcctatcgtggtggatgtagccggaatgctttaaagaaaacatgagagttttttctgcctgtttcccttgagcctggaaccgattatgaccccagatagcctgcacagggctctttcctttctggaacacctgcccaggctagaatatgggagtagggaggaggtgaggctctctcctgcccggtaaccttcccggccagctctccaagacgctgaaaccttccttcgggtctgttgaaactgcatccccagcaccatcatgtcggagcaagaagagaagggcatgtgtcccctttaggcttgactctttccaattagggacctgcctgttgttaggatttagagtccatgtgaatgtgcagtattgttcagtgctgcgagcatttttgcttgtctgaatttcctgatagaagggaatttggacaaaaagaagcttattgtacatggtgccattttattccttaaatcaataataacaaatactttatttatgtatttttagagatggggtcttgctctgttgccctgatcatagctcactgcagccttggctttctgggctcaagtgatccttctgcctcagcctcccaagtagctgggccgacaggcacaagtcagcatgtccagctttttttttttctttctttttttttttttttttaattttcaatttttttctagagattgggtcttgctgtgttgcctaggctggtcttgagcacctggactcaagcaatcttcctgcatcggcctcccaaagtgctgcgattacagttgtgagctactgttcctggccaacatatactttaatatggcaagaccatataaaataattttaagaggccaggtgtggtggctcatgccccccagcactttgggaggctgaggggggcagatcacgaggtcaggagatcgagaccattctagctaacacggtgaaaccccgtctctactaaaaatacaaaaaattagccaggcatggtggtgggcgcctatagtcccagctccttgggaggctgagacaggagaatggcgtgaaccatggaggtggagcttgcagtgagccaagattgcgccactgcactccagcctgggtgacagagcaagactccgtctcaaaaaaaaaaacaataattttaagaactggaggaaaattcagcaggactgagtcgtgatttcagtttctggtgcactgtgggtaattgggtaattgtcagcctggatgcttgtgctcctttagttgtcactgttaccttgtcatctatgtgaagatgagaaatgaagttgagtggagaactgtcgccaaagtctgccatgtaaaaatcggtagtgccaatgtgcaaaggtaattcccaggtgctataaaagtccaggtggcttcacagtttcagattgtatttcccgaaagcgtagagaattgatatccctgaataggaaattgacgtccctgccatttggttcatttggggaacagaataaacttgtgtccttgccttcagttcttttttcaacagaatcttatcaagcatttgaatcgtacacaactgtaatgccagctccatgttgataaaaactcaagaattcaaaattataaacttgaaaacagcaattgccaacttctgacagtagcaggagagtctggaggacctgttcagaggaagtcgggtactgtttccttttcttgtctaggtttgttcttgtccgatgggatcagagagattgagatggggcatgataggcggtgggttcaggagaaagggaagctttagaaatgaaggtagaaaagatgctttcttattggaacagtgttttcaacgttgagctctggaatgttgcagccaactaatggttctcatttgggacagttctgtcccccacctttgaagggggtttggtttaattcccaatttgattatgaagaaaataccagattcagcttgcattttcaagacacagtggttctatgtcaacttcagccatttccagggatctgtcttaggatacttcaaaaagcctaacctttgagatgcactcagctcataagttcgtgaaaataagaatgaataatcttccctgtccagtacatgacagaaattattgtagaccagatgagagcaaggagagatacttgttgatattacatgtcacgggatgctctgttaaattttatgggactctgagtgtaattcctttaagccagtagtctctaaatttgggggaaggacaggggacagaaatgacttgtttcagattttaattcccaaaagggtcttagtgagtttcatgccctctggcaggtgcacagcaagatttattgggatgcaggaagaaattatgaaaatgtccattaagaaaatctctaatacttgtaaaaaatatatttcttgtccatgaaatgcatgttacttgagtattttatatatttaataaattacatgagttaggagcaccttctgaaaacttttttgctgaaaaggatatatgatgaaagaaacatttatgatgtaggtccccaaaggctggaagagggggtgataccaacgtccctgcctgcaggtaggacacagttgtactcccctttcctctgacttcagctactaaggtatgtgtgcgtttgcacgcacatgtatgtgcgttaagtaactttgagatccaccagcttaaggactggacatcgttccagaggtacaggtattagtgatttgacttagggaagaaagaatatgcaataacagggaaccatgcacatactggatctattgtattttgcgtgttgtttttaaagctgaaaaaatgcgcttgtttcggaactagatgacagtacctgtttgcaggtccacaaggaaaccttggaacaatgctatgctttttaagcgttttatgactgcattgttttcataatcactgaattctgtttataaatcagctgatttcattgacggatgccctcagggctctggagaattaggcgttttgctgcagaaatggttcagaatttcaaagacatcaacgtgagattgtactggaattgagttgtgataaaagtcctagggtgctttaaatctttaaatctggttatttgtttgtttgttttttgaggcagagtctcactctgtcgcctaggctagagtgtagtggcgtgatctcagctcactgcaacctccgcctcctgggttcaagcaattctcctgcctcagcctcccgagttgctgggattacaggcgcctgccactgcacccggctaatttttgtatttttagtagagacggggttttgccatgttggccaggctggtctcgaactcctgacctcaggtgatccgcccaccttggtctcccaaagtggtgggattaccggcgtgagccactgtgacctgctgtttttgtttttgagacatatttcatctatcatggttattaagtgttttgtttttttgcatttctcattggtgttttttgtttgtttgtttgtttttttgagatggagtctggctctgtcgcccaggctggagtgctcagctcactgcaacgtctgcctcccaagtttaagcaattctcctgcctcagcatcccgagtagctgggattacaggtgcccaccaccaccacgcctggctaattgttttatttttagtagagatgtggtttcaccatgttggccaggctggtttcgaactcctgacctcaagtgatctgcctgcctcggcctcccaaagtgctggaattacaggcgtgaaccaccacgcctggcctcattaggttttttttttttttctgagttgctgctacactactggtgttacagagtgaataaacataaaaattatattcacaactcagaccacattgtgggctgtggaggtgagaaataggaatcatctctaaatttaaggtcttctggctgagctcatttgcttagaatggctgaaggtttggttttcatgagatgaaatgccaacctcaagtggttctgggtttccagaccagtttttagtttgtttaacttgagagaattgatatgtcagctttagtttttgtgtgtaatttttggtgtttgcatctgttttcttctttgtgaatattgaattcgcaacataactttgttatatgaaatgatgctcatacacttgcgcagtgcattagaaagcctgccaggagcagtacttgtagatttccgtgtaccagcaggatgcctaatgccgaccatgattaatgctcatcagaatctatgtagacctccatttgtcctttgataagctgaaatatttgtgtctactttttaaaaaacctgttgcttctctttatggtaatactcagaaggcactcactgtgaagagaggagaaacaggaagtagaattttttactatctagattgatgcacctatctcccctctccagagaccaatgcatttaggccccagtaagaaatttagttgtaatgaaccataaagcagatgcagagtatatttgggaatataccttatctgactccacagcccaacccctttaagaggaaagagatggcacaatatattttgctttaagccttagactggtcttgacttcatattggaaccactgaattgcttcagctgtgaactggaatcctctcctgtctttgttgttgagtgatgacactcttaattaatcatttgcttatttgccatccaaatcaccctatataatctttcagaagtgtatctcagagaatgaccctaagtcggctgacctctgaagcctgtaccagaattgactttatttcttaagcgcacacttcctgtgctttcaaggggcagctgtctaggtttagtttctgggagtttgaggcacagaggtatgtaggggaatgggaaggccaaatggtaaaagcccctgggacgtggaatctgtgagtacactaaccttgaaagagattatgaaaacaaactttagagcattgttgaagcaccatctacataatttatatcaatgaagacagtaacttattaggaagacaggattattaaaattaaccattttcatctttctacaaaaataaaaatcaaatcaattttagttcagataattgtatgtgaagctttataagtgaaaatttgaagttagcaaaattatataaccttagttaattatattagtgtactcaaactaaatatagaataagattagctcatggaaacattgcatttttatctcagtcagtactgctcatatccacccagtagttagtttctagttacgttttgtaattttttgaatatcctggacatggttttagaaaagttagttgaaacaagatattgtatgctttcattatttcccagttcatctttaagcataataaaaacacagagtaagttgtcctttttgaattttctttcctttctaatatgtgtctggcacaacagaggaccaagcccagggatcattaatcccatttttctgcatggcgtttgctgtgagagaagtttgggctggattcgtagtttgctatctaagagtaaatgttcaaccttctctaatttcctgttttgtttgcttttccattcagtgttctatatttggacaacaaatatatttttctgtatgggtttctggtggcccagatgttcattggagtggaaattctttctgtccacaccactgagttgggcagttactggtgtttggctttctctatctcttggagttgacttagatacattgtgtattcaggttgggcactcatcccctttgcaagctctattactttgttccatttggctttgccataaatgtttgcccttggcttgccaagacgtcagctttaagagatatgtcatttaacttagaactcttgagtctgacttaaaattaagtcagttttcttaaacattgttattgaggtataaatgacatgccacaaaagtcacctctttgaggtgtaccattcagggatttttggtaaatttactgggttgtgtagagatcaccatgatgcagttttagaacattttcaattcccaataagatcgctcctactcggttctcacccatttctgctcccacctccagccacgggccaccatgaatatccttcgtgtctctatagattccccttttgtggatattttagagttgtgcttccaagaatgagtatctctgtgcttggtcgaacttcccggatggtgagacctgatttagtgactttgccttccgccccttcatccccaggagaggaaggtggggaaaggggaaagacggcaagtatagtagtataacaggcatcgtgcctcagtttcctcatctgtaaaatcaggataaccatggactagtttcaggctctaaatgtgaaactctgtaggaagtaattagctgggaatctggcatagaggaggagctcattgtttgcgtgttaacagtgggaaatagttaaggaggtgggaaaagagctacctgtagaaaggtggcctaagtccctggagagctgagcacaggaccccagggcacacacccccttatgcttcccctgtctttcatcttgaaagcacctgcctgtgaacctcaggcttggagggaatctggatgttttcccaggatctacctctgctctatggtcctcaatccaaggtagttttgaaaccgcctttgcaaaaattatatcaatgagaaaattataacagtatgttaagctaacccatcccccatcttgcctttcccttaatattcttgggctattgggccaggtgaactttggaggacttttaggctacggtttaaatgataataggccttgtcccaaactcaaaacttgccccaaactgtaacactaatgggaggccatcaggatgggggaggagaggagcctgattgctgctaaggcaaagacatgaaccattgccagattgtcaaatacgcagattcccagttactcccgcagataacatcactgttgtagaacctaagattggccttttgagatatcttttcaggtttttaaaattttcttttctctgaactacctttggggagattctagatcttttaaaaattccttaccaactctttggagatacctcctgcgttcatggttaatccatccccttagttaaggcttattgattgcacataggaagttccctttagtaaaaggttcaaaagctagaaatgtcctggctgaaatccggtaaaaagagattttaaaatgatttttcttttgagagctctgtagttagaaatcgacttaattaaagctgatatgtgtacagatactgttttaaagcccctgttctccctctgaaagcttctgtcaatggacttctgtcttgattcttcattcctgtctttctgtgtattcttctctgttatgtagtgtttatataaaacagctctaaataattggcgtaggccaggcgcagtggctcatgcctataatcctagcactttgggaggccagggcgaggtcaggagttcgagaccagcctgaccaacatggtgaaaccccatctctactaaaaatacaaaaattagccgggtgtggtagcacacgcctgtaatcccagctactcaggaggctgaggcaagagaatcgcttgaacctgggaggcggaggttgcagtgagctgagatcacgccactgcactccagtctgggcaactgagtgagactctgtctcaaaaataaaataaaataaaattggcttaaagaaaaataagcacttaaacattgtcagaaaaatggaaactttaatggcttttacatcacatgactctgatctttcaaaaataaggacagtttaaagattatttgtaaagtaaaataaaaatgtcttcaaagttaacacactttgtctaaattaggcaggtcagatactctttgctggatgttttaaggtcataaactgcttctgtgacttttaataattgtttgacttgtctgtcttacagccattagattctaggtaaggtctggggacacatggagttagccggctcccctggctaggctgggaagaatcatgggttctgtagttttatacatggttaaaattgcttatttaccaggtttttcaccaaaaataaaagttgctgaaagttaagattgtaacacgtataattgagactactggagaaacagttttacatgcaaggcgtagaaggaaagtagaatgtgtgtgtgtgtgtgtgtgtgtgtgtttgagatggagttttgctcttgttgcccaggctggagtgcaatggcatgatctcggctcaccgcaacctccgcctcccgggttcaagcgattcttctgcttcagcctccccccggcgtagctgagattaaggacatgcgccaccacctccggctaattttgtatttttagtagagacagggtttctccatgttggtcaagctggtctcgaactcctgacctcaggtgatctacccgcctcggcctcccaaagtgctgggattataggcgtgagccactgcacctggcgggaaagtagaatgtgtcttgtgggaggctataagaaagcatgggaatatggtttttgtaaaagggaatataattttgtctggttcggaggattttaaggatcatcttaaaagagtaatgggacaaaactgaaagtttaagcaagttgaaaaaggtttgtaaagggttcatcttgtaaaggaagttctgtgggtatgagcaagttggctaagacttgaaggggattatttagtttttctgtaggttgaatattttttgtttgacttttgaatgaatgacagaaaaacgaggagagaggagcctcatactgtctttattttgtcctgtttggaaagttgagtttcccctctatcagtgagtgaagatttttgccttttaaaaattcttgagttattatggctaaataaatgacttctagtgacttgggattttattttgtaatatcaagggtctaaacatttgatatttgacaaaactttccaaagtcaaaatctaaattaagccacccccccccccgcccttattttaatctggttaaccttccagatattaaatactgtaaagtccaaaagagacatatttggcttatttgatatattaaaactataacagtaagcattgtcaggtatgcaatagtgtttggctttctttggactgtatttgtatgaatgtgttgttagtatgtgtttcagaattgtataagatttcctgtaattctgatatgttttagtatatgttatcagtaataattatgattgttaagttattgtatgccacagagatgatcagaccttaactgtggctgttctgaaacttttgtcatccacaattgttttactttggttattttcagggtggttttataatcagctataggactgtgacagttttctgataactttggagattgtgacattaaaatagacgaaaaagcttccaaggctcccattaagagctaatgtattcatggatatcgagcagaacaggagttaattacatggactgaagtaatggaagaccgaaataaactttttctggcttttcgtttgaaacattgctcattcttttgtttttcagagtccagaaaaccttttttttcttttgagctatttatagcttttaacaattggataaagtatgctcttgtgaacaaaatctgaagcacatttctctctctacctgatttctctagaatttgaaaactgtttgcaagtatacttaatttatgatgttatagttgtttgttaaatacaaatctgttttcttttgtagcaggacacaattggagacactggttattttaccaaagctttgattggaatggcatactttcagattgctttaaggaatcaaagttgacttacagagccaataaaagccccttgggtaagctggcctcataccttgtctacacagtccctggacaggttcctaagtaaagaatgtcactttctgacaggtccaggagctccaagttatcttgagcccttgaggtgaggaattcacccaattaatacaagtatttgcaggcacagataaatccgtggctgggctaaatgctttgaagtctaatgtgagatttcttagggaataaagttgcagcaaagccaattttaaaaaggagcatatatggcaaataattgttctagctgaccttatgcaaacactcgggccaggtatagtaagaataaaacttattttgcacataaattagtcctaatgtgatttgtctttagtaaaaatagggactggagagagaaattatgtttcagaaaaaaactatagaacacctgttgttagaatctagtcttgttcactatttttgaatttttattattttctgtcatttggactgaatcgtgaattctttctggactacaagtcccaaactaatgctttcaaatttttctttcatttctaacttggcctcaataaaattgctactacctctttcctgaggtcctataagctgaagcttattatgagagaaaaacatgtcagattgccaccaccttcctcgtctataactaaagatgttttgagtctaatgtctggataaattgtgcccagtgttaatctttgttttttttccgtgtctatggaaatgcctcttacagaagcttagcccatctgcagtgccacctcctgatatgggaaacagctgtttaactgatctagtcttaggacttggacactgactaaaaagatatgggacaatatatttaaattcactctttcctgtttatcccagtctctctttctaacaacatatagtctactgttgacttaagtgttgtactagaactgtgagtaagaacattaacatctttgtcatacacccgtgagtacatgcaggtagctgcacggtggtgagctcactcctattcccctgggaccaacccctgcaactatgccccctgtcagcaggaagaagccagagtgatggtcaccctttttctatctctatagccagcaccttaagaataaggtgtatgaaagccaaagggggtattgaaaccacctttgcaaaagttatatcagtgagagaatgatgacagtgaaagagatctgagctaatccaccccccatcttgcctttctcttaattattcatttcccttaattattgcatttcccttagttattccatctcccatgtggtgtggctggccttgtgtctgttaaactctttctctactaaaatgcccatggtctttatgcagccggcaggaagaacccctcaggcggttacagttttgctcccaggggacagttttggttgttataaatgaggaaggtgtgctcttggcatctagcaggtagaggccagggctggcctcctgaagtgcagaggaaggtcccctcctctttcaagagagttatccagccccaaaaggtcagcattgcagaaattaagaaaccctgacttagaagctttgcacctcgtggtagctgtaaatgaggtatttacatcctccatgaagacgtaaggaagttgaaggaataaaaatctcatggggctttgaaagcaatgcaagcatcttttagttttcatacattccatggaagtagggatttttttctaaagcaaaaagaccaacaagactttggagctcagtttagaagaaaaaagtgactttcaaaccctttagaagtattcatttacaaatgaacaatgaaatgactgtgtagatggagaaaccctgagcgccccttggctttgatctggtggtcacgttcatccgtgtctgttccctgaagaaccagtgcccacatttgcctgccttctttacctaactccccccaacaagagctgaccctcctcccatcttctcgcctggttggtctttttcctccctccccctgaagcctgcctgcctctgctttccaccctccgacaagccctgatctgtgctctgaacaaactcctatgcgggtctctttgaagtctttttgcctgcccctaagtgcatccctcccacccccacccaggtgatactgaatctatgtgaatttgtggagttctcccttccttcccctctggcagaatcaccaggattcagtctagagtacaacattatagatgttttctagcacttttcagctgtccatacgctaatatgtagtcttgggtctttatccgaatggagtcctattatatttgtttcacaccatctgctttccttatttttgtatctttactgaggtatattgaagtacagtaagctagacttgtatgaagtgtgcagttttaatctgttttttcttttttatttctttgtttgtttacatacattttttagagacaaggtctcactatgttgcccaggctggtctcaatctcctgggctcaagcaatcttcctgcctcagcctcctgagtagttgggactataggcgcatgccaccacacccggttaattttttattttttgtagagatgagggctccctatgttgcccaggctggtctcaaactcctgggctcaagtgatcctcctgccttggccttccaaagtgctaggattactacgggtgtgagccaccgtgcctggctcgttttttcatacacacacacacacacacccatatttgtgaaaccagcaccacagtcaaagaatatttccatcactctccaaagtttacttgtgcttttttgtaatgtctctccccctccctctacccctttcccaggcagccattggtgggcagtctgtgactattgcattttctagcaatttatattactgaaatcatatggtatgtactcattattttgcctggcgtctctccctcagcatcatgattttggggcttcatgttgttgcacatgtcactaactcattcctctattgctgcgtaggattccttcctgtatggatgcactatggtttgtgtatccattcaccagttgttgaatgtttgggttgtttgttttttattgtgacaattatgaataatgctgctgtaaatgtttacatggctgtacagtggttctcaaacttcatcatgcatcggaaccacctgcagagcttgttaaaacacagagcatccaggcacggtggctcatgcctggaattccagcaccttggaaggctgaggcaggaggatagcttgaaccgagaagttcgagaccagcctgggcaatgtagagagaccctggcactaaaaaaaaaaaaaaaaaaaaaaaaattagccaggtattgtgtgcacttgtagtcccagcttctcgagaggctgcagtgggacaatcacttgagtccaggagtttgaggctgcagtgagctgtgattgtgccactgcactccagcctgggtgatagagcacaagaccctgttgcataaatactccccccaaaaccccagaaaaaccaacacacagagtggcaggccccatccccagagtttgtgattcattgaattaggggctgggttaagactctgcctttctaatgggctctcagctgatgctggtgccaatggttcaaggaccacatagacttcgagggctgctgccttaaaggaagtctttgtaaattatgatagttaatcgtttgttagttgttccaggtatttctcttctagaccattccttgccatgtaatgttgcttatggtttgaagcatcaagctcgcatttttgtgtagtcgaacatgtcagtcttttctttgggcttctgggcatggcttccttccagcaaggggcagataccaagaataacttggagtaggtgaggcaggttttgatgttagcaaaactcaaaccatgacactcccccaaatgggagtctgccctcattgggcctaattgtgccctctgctgcagatgctgggatggccttctgatgggatggccgggctgtgttgtcagcacccgcccacatgagacgagtttgtagctgtgcctggtgccaagagctctgaggtgctactatgccccctggaacctttgggcaaagcatagctagtcatcaggcttgcctttcacaggcaaaccaaatccatcctttcttcatccccctgccctgccaaaatcaaccagtctcaaatcaattcacgaaagggggccaatttgcctttcgggtgtctgatctaacaagccttggagcagctaggaagctaccagaagatgtgtatgatcaatgtatttgttatttattttattttatttttttaagtttggggaaaggtaatacttttggtcaaccatctgaagggactccctcctctaggccagggcactccatagttaacctgaaaaactggttcagggcatgacaggaagggggtttgaacatgcttcattatgccctcctcccttttggaattcatgaacagccgacagcatttaacacagaccttaagtctgataagaaacagttacaatctattttctctgaagcctgctacctggaggcatcatctgcgtgataaaacctaggtctctacaaccccttatggtacctggacatttttttctattgataatagcttttttttttttattattgagacaagtgctgttgcccaggttggagtgtgatggcatgatcacagctcactgtagccttgacctcctgggctcaagcgatcctcccacctccgcctctctagcagctaggactacaggtgtgtgccaccacacctggttaatttttgtattttttgtaaagacggtgttttgccatgttgcctaggctggtctcgagctcctggactcaagcaatctgcctgccttggcctctcagagtacagcgattataagcatgagctaccaggccttgccgataataactctttcaaccagttgccaatcagaagaattttatcccagaacacacaccccccccccacgcccccgccgcctcaagtcttcccacctttctggaccaaaccaatctatatcttaaatgtattttgatatctcatgtctccctaaaatgtataaaaccaagctatgccccaaccgccttgggtacatgttctcaggatctcctgagggccatgtcacgggccatggtcactcatattcagctcagaataaatctcttcaaatgttttgcagtttgacttttttcattgacagagagcagctttaaattactgtggactctttgttgcaaaagcatcttcttgaatttgataataaagccctactcttccagtttgtccctgagtgcattctgcaggtacctccggtcaccgcttcttatctttgctgttgacctcagttcattcctttcagattcttcactcaggagaagtcgtggaacagattcctggaggattccaggctctgtaaggaggcttatctccttaggatggttaaattttggatttgcagtgacttgtaatcattggctaatatcctagtttcttcttctcttttttaatgacaactttactgagcatacacacaactcattcctctaaagtgtgtaattcaggaatttcctagtatttttacaaagttgcacaaccatcaccactgtctaatttttgaacattttcatcactcccaaaggagaccctgtacctgttaagacatcactgccccttccccttctccccagcccccctggcaaccctgaatctggtttctgcctctatggatttatctattctggacatttcatagatacagaatcatgtgatgtgtgaccttttgcgcctggattcttacttcatatttctgagtttcatccatgttgtagtatgtgttgttctagtttcttgtaaatgttctgtcaaaaccccaggtgattaaggaaggtggaacaatgttctgagataagtcagccagagacacaggctgctcctccctccaattacatttaaaatggaaaatcgttcacaaatggaacattgttcataaaattgtttatagttcagcttctattctagcatgaacggtaattttctctttcgcatttgctgtagttcctccaaatttctcccactttcctatacctaaaggtcaacgtagaaaacaattttcgtcagctagagctgggcctgcaggtctctcttgtgttgcatcttttgggtggagtcagaaggtcctttcttggtgtaagagttaggaagcttgcatttcccaaaggggttgtgtggtgttccttccagagctgaggttgtgggattccaagcagcaagacttaggctgttttctacggcgtccccaaagtcacaaccctgactgatgcaggaacagaatcataaggttgtttacttttctgaatttatcaaaccttttgtctgtgtttgaccaaaattacttttcccgggttgggttggagaatatggagggtgattttctgaaaccattcatgggacatgattttctggggcatctgtacctgcaatgaagggcttactgataagactgaaggccattgtactttactggttggtgttataattgatcatattcatttcttgtcctactgtgacaagtgactgcacatttactggcttaaacaaaaactattatcttacggttctgaaggccagaagtctgaaatgggtctcactgtgctaaaatcaaggtttagcagagccacaactttcctggaagctctaggggagaattggcttccttgccttttccagctcctggagactggccgcattcctgagcttgtggccccttcctccatctgcagaggagcagcgtagcacctctctgactgtccttccataggcatatctctctgagaccatagctgggaaaggctgtccacttttccgggctcctgtgattacattgggcccatccggaagatccagaataatccccacatctcaagagacttaatttaatcacatttgtaaagtcccttttaccatataaggaaacatattctcaggtcccagggattcaggcatgagcatctttgggggccattattctgcctactacattgtcagtcttcaaggacagacttacttcctttgtttctgtctcttaatttgctcctctgaagcctgcaagattcataggcttatgtaacgtttgtgttttgtctctcgaataattgagaaatctggtactgttgagccatttggtttgtattgctcactcactgagtcgattgattggttggttgattgagtgattaatagagacagtctcattttgttgcccaggctggtctcaaactcctggtctcaagcgatcctccctccttggcctcccaaagtgctgggattgcaggtttgagccaccatgcttgccctcagtattgattccctctgaatgagccaggatttgctttccattttggagagcccctagattgctgaacagctcagagacacacttgtgtattgaggtcctctttcctgccactcttggttttggactttatcagggactctgccagagctacttttctggacttggagtctcagagtctgtgtcagctgtgggtaaggaatgagaccaccatgaagcaagcagaggtagcgggtggggcctggcttccaggactttgcagatgctgtgtgtggatttctggggcctgaatcaagagcccctgggtttgtggcttcacagaatggtggaggaagactggtggagttaagggacagaagactcaacaataattagcttgttaatcagcattttggctcaaaaatagtttgggagtatactggtcagctttctgccatgctaatgttgcataacaaacagcccccaaattcagaggcttaaatcgtttctttcttgctcactagtcatggttagctgtgtctctcctgggcttatatgggaataggaaggcctggtcaggttctgggctaggcttagggttgaaatgatgtgtctcctcatcaggggaccctggggcatgttgtttgtgcctctcccatcaggtataggaagccaagataaatcatgcaggcacatttaaagtctctgtttgtcactacccctaacatcccattgaccaaaacaagtcccatggtgaggtccagcctccacgggttggggagggctattctagtctgaaagccctgaaaagtcacatggcaaagggagcagccatagacttccactatgggaggatggaagagttagcattgcagtgcctctgccatgtttgtgggtggaagggaaggtgatccctgtggaagagactgtggatacatccagtcataccctagaaaatcagctctataggtggatttttgaagcactgtgtgcttgttatctttttattattactttatttttgagacaggatctcactgtcacccaaactcgagtgcaatggtgagatcatggctcactggtgcttctttcttctgggctcaagtctcctcccgcctcagcctcccaagtagctgggaatacaggtgcacactcaccacattcagctactttttaaacattttttttgtagagacagagtctcatcatgttgtccagactagtcttgaactcctgggctcaagcagtcctcccacctcggcctcccaaagtgcagggattacaggtgtgagccactgcacctagccagggtgcttgttaaacctgcagcttccttgattccatcttagagccctgttctcacctgaggagaggggattgtgccccttggggaacatttgacaatgtcgggaaacacttttgcgtttcacagctgggtgggggttgctcctggcatcttgtgggcagaccccaggggttccactaagcactgtaatgtgcacaggacagcccccctcaaagaattatctggcccaacaaatgtcagttctgctgaggccaagaaaccctgcacaaacaggcaattttaggtgattttcatgcactttatagtttgagaaccatgtcttgcaagactgttccaactgggaaggggaattggtgattctttccatataagtagacacggacacatctaggaaggaaggtttgatatctcgcagatagttgtgtggagaggcgaattcaaacccaagggtcttagttagatctattacttctgtaattaaaaaatatgttctgctcatattgtattaattctttgttgtattaagtatttactcttgctgtttattagtagcttaataaatggaccgtttatttggtgtgggaagaaatctatgttttattagatttctattatgagcttattttttttctaagtggccttttgccagctgtttcttctgtcctgttattcctgctcaccagcaagattataaattcttaaaaaatttgtttttaattttttttttgagaggggatctcactctatcacccaggctggagtgcagtggctcaatcatagctcattgcagccttgaacttctgggctaaagcaatcctcctgcctcagcctcttgagtagcttgggactataggtgcatgccaccatgctctgctagtttttaaattgtttttgtagagatggggtctcactgttgttgcgcaggctggtcttgaactctagggctcaagcaatcctcctgcctaggccttccaaagtattgggattacaggtgtgtgccactgcaccaccgcatcaccgcacttggccagtatatttatatatatatatatatatatatatatatatattttttttttttttttctttgagacagagtctcactgtgtcatgcaggctggagtgtagtggcatgatctcggctcactgcagcctcgacctcccaggctcaagtgattttcccgcctcagccacccgagtagctgagactacaggtgcataccaccacacccagctagtggccagtaagttcttaatagcagtgatcacgctttatattttgtttctactctgcacagtactcagcatacgataatgatcagtcagttgctaatggtatcaattgcaatgtgagttgcgctctgtggttaaagactcatttatgaggtatccgtggaccagccttttatactttgctataaatcctgtttctaggcttttggggctgaatggttggcatattgatgctcggtttctgtgtggcaattaggagaaaaggtccttgtcactggcaagctgacagcctcctttcttctcctaccctcaagttgttttggtgattgaaatgtttcagatattaaaaaaaaatcaagaattgcttgctgataggacaacagaagtacagttcagggagttaaagcttctccattccccacctcaattgtacacagcaagcatggacagatttccttgtagaaagcatgcaagcagcatttctatggaggatgctgtgtcacctgaaatttgctatgctcagatcagccaagtattgcctctgggggctaccagcaagttatagaaataactttgttatgaaatacttctttaagggggtgttagtattgattcactgaagtggttctccttgtgtacatggagtagttgtgagacgaaggtttcttttcttcctggctccccatgtgggaaggacgcttagtggtttgtgggatgcagggagaggaacagagtccatccttcagttgctctttttactaatttattaacttgcctctcatccccttggctgttaagacactaagctggtgtgtctgacaagcagatgacctaaaaattcacgcgtagtaaaagggaagatgaaaatagaagtatatgaactaaattaggaggaggacttggcttcattaaaaaaatgagaaagccatgttgtgctttttttaactgccacttttccaagtgcaggactaacagtttcagatgtcattatgctaccagtcttggtaatttctaatcatgttttgtctaaagaatatttacattaaaatgagccagcctctttaaagtcacattttagtagtgagaaaaccaatgtccgtttttggaaagggagcccttacctcagctggtgtgagcgttttgtggaggtctgcggtgtttgtgacttgtgccagaggccttgagctagaggcaacataagaaggaatcaaacttccctttctgttcggtatgcctctgtaccaagacgttttgttgattgattcatggcacggtgatacagggtgcatggtatcagatgcagggagtggaatattgttgagattggggctagagggtgtgtgtgtgtgtgtgtgtgtgtgtgtgtgtgtgtgtgtgtgtgtgtgtgtgtgtgtgtaggggaggaaggaatggaaggatgaaaccatttgggaatgtgctggaagacatgcttttgaggacaagcaatgcgattttggcattggctgggtttctgagccagtgatgaatgtagtgcattgctatgtgactgggagtgtgatagagagatattccgctggttatttccctccacctgcttcttatcagtgccatagggcagagtctcaattccacttgccagaatgctttctaggaactctttatgctcaatggaggtgatgttttcccacttgctatgctgtgccttagggaacaggaactggtattatcacataagcaatctctaagtcccttggaagattgtctcattcatcaagagggagaggattctgattttcctgcctggctcctccaggaagtctaacttcttgcaggggacctgttctctcggcccacttgtacagcatgtataaaaggaaatgaagacttttggggatttgttgattcacttgtttggaaattggggttatgtaagcccaatttgagttccaggactcatctatgattgcctggattaaatcaaaggacacccatgtaggctggacgtgatggctcatgcctataacccaagcactttgggaagctgaggcgggcggattgcttggacccgtgagttggagaccagcctgggcaagatggtgacattccatctctactaaaaatacagaaaattagccaggcgtggtggtatgttcctggtcccagctacttgggaggctggggtgggaggatcacctgaacctgggaagtcgaggctgcagtgagctgatatcctgagatcatgccactgcacttcagcctgggcaactggagtgagatcttgtctcaaaaacaaaacaaaacaaaaaaaaccaaaaaacaacctgcgtaattgtagatttttgttgttgtttgatatactgtctcttttcctggaaagaaccctctcgtgggaacagaaatgttgaatttagtcctgatgctgtccctaaccaccccgtgacactggtcccaggaaaatataggaattgtctctctttttctgtcatctcagagcttgagacaaatgttctctgaggttgttttagcaccacactgtgattcatcttcgagactgttcacagcccttgatctgaattgatggagctgtgggggatcataccgccactgccagtgctgagagctgcatgtggtgcggtccagtggctacagcgttgtctttgggatcttcacttggcaccacagcggatttgtataattattatgttgactggaacttagagtgactcaactgccttgaacaggaaccaagaaagagaggaaccaaattccagaagagaatttgccagaacattccagcatattccatactctagggttgtcttatagggtctgagggtacttcttggttatctactcatgtgcgtctgacataattaaaggccgacttagaccctatcagagaaaatcaagttcagacacttagtctaaatggaagtaaggaaaacgattacctttatctcattatcttagttctctttggaagatatataagcttgaaccatggtgacaggtgttgcctttaaacatggtgacaggtgttttcctttaaagtccttggcaaatcaactcatagacttcttcaacttcaaaaaaaaagtttttttaaaaaatattttaaaaatatttaacttgaggatcttcattgaaaattggtcatctttcgtgaatttgcttaagtaggctttgatctctttttaaaggattccttcctgcctgatacatttggtccttttagaattcgggctagaacaattctccatgaaggtggacgtgttaaaatctatttggttcattgttaggatcactcacattacaagagaaatttcggtcttgagtttttgtttttgcttatttgctttcttggaaatgtttccacatcaggtcttagaggagttgtaaaacaggaaggaggagttgacatgctgtttcataaccaatgcttgcttctcgccttggatactaacattttttccatccatttcccacataaaacatggagacaaacaccagagctgctcctgagaggtgctgagtcataggaattgaagggggctgttgggccctcgtgtgtgggatgggctcaagagctatcagtctacagagggaaaggttcatctctgtccctcattgcctgcagtttctctttggccctggctttttccgttcacagctgccctcgacgttcattttaatcaaatttcacctgcataaaagggctatgggcagagagtcttctctgtgatggagcgcagctatcctacaagtatgtagccctgatttagtagagaagaggcaggaattgtcgagggcggaggagcaggagaaatggtgcacaagggagaggggataatgacaggtcattcagggatgtctacggaatgtgaaaatgcagcaagatgggtttcggtttctttttttttaggtccgacagagattcctgggatagctgcatcttcatgttgtacacgcatacacttgattcccattattcactggagctatgttctgtaaagtcgctgagactttatagaaagcatcaccccagggaaaatacacagtgaggcttctgcgaacctctggtcacaatgttgttgtcaagcagtcagtgcataactttgttgtatgtatttctattgtgtgtttctgttggttcctttacattgcactcacgccaacagcactgtgactcacgcctggccgaacctcatctaacgcacgtattttccccataagacgcatcccagccttgtgcttcaggacatgagacagcactgcagcatctgggggccattttaagcagcaaagtcacccagaaactacaacatttcaaaaaactggcactgtgaatagactgcgaaaaggacacttgtttacggagtgagagccttgttcaccctcagctgggaacatgtgcatttggtgacacagccacacgctgcatgtttgagaatgaccatgaaagcgctgcaggtactgattttggagctacaaataaatgttagccaataggcaaattcacagacacggaatccgtaaataacaaggcttggctgtgtgtgtatacatagtgtagtgttgatagtgtgtatacacaatacacattgatattttgggagagattttgaagaagtcaccatgaaagccagtgtgtccgtttggccctctggaaagcgtgcggtgaggaggagtcagggtacaagtgtttaaattggggacatggcctgaggagatgaaagagaggtggggactgagtagggaaagctccacaccacaatgcataactgataaggttttggccaacaagccagagaaccctagagcaaagagtgccccttgcttacagccagagggccttgctcagtgaatatagggggctaggagtggggaggcatctccaaaggagcatcgtggatttgcaactctgtctttctggaaaggatatgagagtcttgccctctcccccagggctgacacagttgtaaaccaaacttttgacttcagttgtacatatcaattattttgcacccacattagattgaaccaaatgacactggctcttttaaattaaaagtggtcaaatgctggcagcctcttagggttcaattcaatggaatcttttaaaggtgcaataatgctgtttgaaatgaggagaacgcctgtgttttgtttgctgagagaaatccactatctctcatccagaagatgattagacccataatggaagccagtcagtggcatgaggaatcatggagatgattctcacctggttgattggatcagacgttcctagcccgaatgagggtggaaagggaaccaagagatgaagtggattgttgggtttatgagaggacggtggttgtctgtctatagttaaggttgtttaaactcatgaccatgagaatgagctttttctggataactctttccttttccttctgatttttgagagtgctgaaaactcaagtcctgtatttaaaaattccatcgttgaaaacatgtttcaaggacagatgacacacttatgattatagcatctgaagtgatgggaatattaaataacctttggttggacatgtaaccatcagggctccacttggtcttaaaaccaaacacacacagttcttgtcgttaaagatatccatggcctggcacagtggctcacgcctgtaatcctaacactttggaaagccgaggcgaggggttaacttgagcccaggggtttgagaccagcctgggcaacatggtgaaaccttgtctctacaaaaaatacaaaaattagctgggtgtggtgttgtgtgcctgtagtcccagctactagggaggctgaggcaggaaaatcacctgaacccaggaggtggaggttgcagtcaggcaccatcctgcgattgcactccagcctgggagacacagccagactccatctcaaaaaaaaaaaaaaaaaaaaaaagacttacacagagaaagcctgaagcccacaagagcaattagcaaaaggaaccctgacataacaaatacggtggtgtcattagcaaccaggtagttaagctcaggggttgctatgtgtcataaacttgaaagctacattggccacgagtaacacaaatgtaggtgctaatcacagatagttggtgggcatttcaaactttctcttcatatctatggatacccaaaacagtgtgcttccatttagaaggcttccattgggaggctgagacaggaggattgcttgagtccaggagatcgagattagcgtgttcctccctccctccctccctccctccctccctccctctctctctccctccctctctccgtctcttcctccctccctctcgtttctttcttttttcttttctttctctctctctctgtctccctctctctccctctccctccctccctcccctccttcctcctcctctctttcttttgaggtggggtctcgctaagtttcccaggctggtctggaactcctgggctcaagtgatcctcctgccccagcctcccaaagtgctgggattacaagcatgcatgagccactatgccaggcctattttccctttcctgctatttcctcccagctaacgcgcttttaaaatttgatacaaattaatttttctttttttgtcttttgttcaaataatgatttgatttctgttctctgtctgggtcgcttcaataacatggatacctacacatagttttatcagtaaaggtcattgacataatcagtgtgttgtgagaacaaagataggccctcatttaagctgctccattactcattttataagtcagagaaggaaggggacagcgtcctctgttttcagatggctattgaagtgagtcagagtgacggtgagcagcatgcattgaattctagctggaaagagggtttttaggcctgcgtttgagcttgccctgaatgaataaggctggaaacctataggccctggagaacattaatgaggaatctgctttccctgacagctccttgataaacgaaatgatggatgtgcagcgtgcagccctgagcaaaggcctggcagctctgtggctgagccctagagggctgagctgggccagggctcccagtagtttgttcaggagcactgagagccacagcaggtgctgatccagctcttgccttcttcgcgagtatctgacaagtctgcagagaccgcaggagcctggctactccttgagttcactgtcttggagcaagcctgtgggggaatcacatgcccccccactctagtgcccattggggacatggaggagggagtttccctatttgcagttaggttttgcgtgctgtccgcgagcttggtttcccctttgggttgcacagtgctgagatctgagcccaaggcagttgggacattaatgatgagacagaggaggctttgctgtgttccacatctatcaggctgctttgcccagggagacgccccccttgcttggggtcttgggcttgggtaggggttctggaatgtctcccctccagcaggctctgcctccttggcttccttgattcagagagcagtgcagtggctttgttgaggagcagcccctgtggaggcgctcatgggtgacaggctgtggctgaatagtggacagccctggtcactgacattaacatggtgcaatagagccttcttatgtgttccttggttcccactgccctttcatggtcgggtgtcctgattgtctgtggctagactatgccaacgtgatcagtgtccttcccagaacccctgaaagagggtcatagattgagatgtctgtcaccacccctgtccattgcagagtcacatacatgctagagaccagctcgcccttgatgcgacctgaggacctcgcccgctagtcattacagggaggggaaagacaataaaaagatgaaagagagtgctgtccctggtaatggaagttactcatcattgtaccagtgggcagccacatagggataggtcggaagagaaaggggaaagagtgaataaaaaacgctgatgtttgtgaggccgagagaggaacagaactattactgctggtcaagggggccatccacttaaaatgttcacatcctgtttcagccacaagctggccaagatcatcacataaagggacaaacgttggccccagaaagaacgcatggtcatcttgagtcaaggctgtctcatttgatgtcagaattcttaagagctgctctggctaggtgcagtggctcatgcctgtaatcccagcactttgggaggctgaggcgggtggatcacctgaggtcaggagttcgagaccagcttggccaacatggtgaaaccctgtctctactaaaaatacaaaaattagccggacgtggtggcaggcacctataaccccagctacttgggaagctgaggcaggagactctcatttgaacctgggaggtggaggttgcagtgagctgagatcaggccattgcactccagcctgggcaacaagagcaaaatcctgtctccaaaaaaaaaaaagaactgctcttggctgggtgtggtggctcacacctgtgatcccagtgctttgggaggctgagacgggaggattgcttgagcccaggagttcgagattagcatgggcaacataacaagaccccatctctttaaaaaattagccaggcatggtggtgtatgcctgtggtcccagcaacatgggaggctgaagcaggaggatcacttgagctcaggagttggaggctgcagcgagccatgatggcaccactgcactacagcctggacagcaaaggaagaccctgtctcaaaaaaaaaaaaaaaaaaaagcaagaaaaaaaaagcatccaggtgtggtggctcacacctataattccagcactttgggaggccgaggcaggcagatcacctgaggtcaggagttcaagcccagcctggccaacatggtgaaaccccgtctctactaaaaatacaaaatattagctggatgtggtggcgggttcctgtaatcccagctactcgggaggctgaggcaggagcatcgctcaaacccaggaggtggaggttgcaatgagccgagactgcgccattgcactctagcctgagcaacaagagcaagactccgtctcaaacaaacaaaaaaaactactctccaaacagaacctgcacctacccaattgtggtgggtgcccctcctggggctcctgcagtagcggtggtgtgggaattgagaatcttgcaagtgctatgagggagctgagacactgagtgtggcagggccatgtgcccagagcatgcacaacccatcctaacgtctgccggggaaggtgggggatttctgtgcattgcttttcaaccagaaaggtaatttttgttccccaggggacactcggcaatgtctggagacagttttggttgtgacactgggttaaggagtgctactgtcatctaatggatggagagcagggatactgctgaacatcccacagtgcacagggcggcctcacaacaaccaagaccacctggcctcaaatgtcagtagggctaacatccagaagctctgcgagtctgtgggaagccctggatgccccaatcctctttcattttcttctcaccacgtaggacagtttagctggacagtacacaggactcattcaaggggtcatgagaggagacctcatagcataagggtcaagtacaaggactttgcagtcagactgacgtgggtttcagtccctacccatcctagtggtgtgaccgagagcaagttgggcatagtgacatctgtcttgattgactttggagtttgacaggcagtacatgcaaagttctctattcccatgtcactcagagtgagtgtgcaaaacatactattgttggcatccatcgtcataagagtcactgtgaacatgggtgagcttagcaccttgtggcacggggctgtggtgagggactcagacagctttatgattgagtttgggcctcagcgagatggcaaagctatgcttctcttgctccttggaccatggtgacctgtgaggacccctgggggctgccttctccactgttgcagttcagggagctaaggccaaaggctactgcagtggtggactctggggtccccctggtgacaaggaagggactttgagctttggaatgccctgggctgagtcttgccacctgcaggtttgtgaacctcatcatgccttgtttttagcacaacaaaatgggataatagtgactttattattgatatactattatgctgttttcaggtatgtgacactgctgctattttactgtttcttccagatttccgtgagggtggaagaaaatcataccatatcagatgcctcgcagagcaccaggcccaccgtgaaaggtacagcaaattttacttccctcttcttgcctcgttggaaattctttcctgtgagatttcctcccctccgccctccgcgccttctgccatagcctatagcctcctctgggagttcttggataattttgttgccttatacctttgcaatttccagtatggtagccatgcgccacatgtggctgtggagtgcttgaaatgtggccagtctagattgagatgccttgtagaagtataaaatacacactggatttcaaagacttagttcaaaaagaaagaaagcaaggtatcttattgataatgtaatacagtttacatgttgaaatgatcacttggatacgtggagtaaaatagaatgtattattaaatgtaacttcacctgttttcttttgacatttttttgtggacccagaaaattgatagacaggtggatttccttcacacttacacacttgtcttgctcaagaccagccctgcttcctcactggctgctcagtcaaatgcctcctccagtttaagctgtccatcacggggccacccattatgtgtccatctcatcttctctgctcagtgcctgtgcaggcagctggtgttcctgctcctcccgcccagctttgcttatgatgctagtcttgagtgcaggctgctgagcttctcacctttcttcccatacatgtagaacctctcctccagaaacatggggtacttaccagctggcaaggagcagagctggggttcacattcatttctgtcttgctccaaatccatgtccctaatagattactgtctccaattgctttgtggatgtaaacacatagtaagttcctagagagcagggaccatttttatttctttcatctctgctgttcaagacctttctaaagcttttttgaaagaattaagatttctagtctcttgcccttccactttctgctatgtgaagacacagtgttcctgccctctgccctctggatgctacagcaacaaggtgccatgttggaaggaagcagagaacatccctcaccaaataatcaatcctgctggtgccttaattgtgaacttctcagcctgcagaactcacgaaggtcatcaccatgtaggctgattgatcttggacttccaagcctccagaactcaaatcagtgaatttaaaaacattttatggagggcggggccaagatggccaactagaagccacggtgttgggaggctgctatcagaaaagaccataataagcgtgtgaatccttcatcagcaaccaaggtatctgggttctctcatcaaaattgactagaaggctggcgtgacccacagagagaaggaagaacagtgtggtgtggcggcccacctgagagtcacatgggaaagggaaccccctcactccagataaggcaggaggtgagtgagcacgctacccagccggggaaactgcttttccacagaactgtgaaacccacggattggaagatctcactcgtgaacccacgccaccagggcctcgtgtcccagccccagaacacacagattcttacagcctctcagctggaatccgcttaagcttaccaaactcctcggggaggggtgaccagtaccagctgcagctgcctgctgtctaagccctttgaactcctgcagggaggggcagcagccagcactggcaactgcctaacatgctaagctccctggacagggggaagggtggcacccatttctgtagctacaggctacgcttttcccctgctagagccagggaggctggacagcttggtcccaagacttgtccccacagcccaacacactggctgtggcagtctgcggctagagtgcctcttcaggcccaatcccaacccatcctttcttagttggggtgtgtgtggggcggggcgcttccctgctggatctccagtaactccagccagaggctaagggacagaatttggatctcctgggcctcagcccataggggaggggtggccgcagtctctgctgaccagcagatttagcttttcctcctggtagttccaaggaatctggacagcccagatgagtgggtttcccccaagcaaaacacaccctctccaccaagggacagagtgctccattaaacgggtcctgctccctgtgtcacccaactgggtgagacccttcaacagggcttgtcagataccctctgcaggagtgatcctactggcatcaggttggtgccccttgaggtcagaggtcccagaagaaggagtaggcacccatctttgctgctctccagcatccttaatgacatctccaggcatgggagcgaatcagatgaataaggcctgaaggtgaaccaccagcaaactgcagcagccctacagaagagggactggactactgaaagaaaaacaagcagaaagtgacaacaacagcatcaacaacaacaatcaaataaaaggtccccacaaaaatctcatccaagggtagcagcctcaaagactgaaactagacaaactcatgaagatgagaaagaatgaaaaaatgctgaaaacccaaaaggccagagtacctcttctcctccaaatgattacaacatctctccatcaagggcacagaactggacggaggatcagatggatgaattgacagaagtaggcttcagaagatgggttataaaaaactacaatgagctaaaggagcatgttctaacctaattcaaagaagctaagaaccttgataaaaggttagaggaattgctaactagaataaccagtttagagaggaacataagcaacctgatggagctgaaaaacacagcacgagaactttgtgaagcacacacaagtatcgtgaagcataaacaagtatcaacagctgaatcgaccaagtaggagaaaggatatcagagtttgaagaccaccttactgaaataagacatgcagacaagaatagagaaaaaagaatgaacaaagcctaccagaaatatgggacctcataaaaagactgaacctacgattgagtggagtaccagaaggaggtggggagaatggaaacaagctggaaaacacacttcagggtattatccaggagaacttccccagactaccaagacaggccaacctgcaaattcaggaaatactgggaacaccattaagatactctatgagacgatcaaccccaagacacataatcatcagattttccaaggtcgaaatgaaggataaaactaagggcagccagagagaaaggctaggtcacctacaaagggaagcccatcagactgacaatggacttctcagcagaaactctacaagccagaagagattgggggccaatattcaacattcttaaagaaaagaattttcaacccagaattttatatctagccaaactaagctttctataaaatcctttccagacaagcaaatgctgagggattttgttaccactaggcctgccctgcaatgtctcctgaaagaagcactaaatatggtaaggaaaaactggtactagccactgcaaaaacacatgaaaatataaagaccaatgacactacaaagaaactgcatcaactaatgtacaaaataaccaaatagcatcatgatgacaggatcaaattcacacataacaatattaaccttaaatgtaaatgggctaaatgccccaattaaaagacacagactagcaaattggataaggagtcaagactcattggtgtgctgtattcaggagacccatcttacatgcagagacacacacaggctcaaaataaagggatggaggaaaatttaccaagcaaatggaaagcaaagaaaaaaagcaggagttgcaatcctagtctctgacaaaacagactttaaaccagcaaaaataaaaacagacaaagaagggcattacataatggtaaagggaacaattcaacaagaagaactaactattctaaatgtatatatatgcacccaatacaggagcacccagattcataaaataagttcttagagacctgcaaagagacttagactcccacacaataatagggggagactttaacaccccactgtcagtattaggtcagtgagacagaaaattaacaaggatattcaggactcgaactcagatctggatcaagtggacttagtagaagtctacagaactctctaccccaaatcaacagaatatacattcttctcagtgccacatggcacttattctaaaatcaaccacacaattggaagtaaaacactcctcagcaaatggaaaagaactgaaatcatgacagacagtctctcagaccacagtgcaatcacattagaactcaggattaagaaactcattcaaaaccacataatttcgtggaaattgaacaacttgctcctggatgactcctgggtaaataatgacattaaggcagaaatctagtatttctttgaaaccaatgagaacaaagagataatgtaccagaatttctgggacacagctaaagcagtgttaatagggaaattttgcactaaatgcccacatcagaaagctaaaaagatctcaaatcagcaccctaacatcacaattaaaagagctagagaggcaagagcaaactaatccaaaagctggcggaaggtaagaaataactaatatcagagaagaatcgaaggcgatagagacgcaaaaaagccctccaaaaaatcattgaatccaggagctggttttttgaaaaaattaacaaaatagatagactgctagctagactaatagagaagaatcaaatagacaataaaaaatgataaaggggatattaccactgaccctacagaaatacaaactactatcagagaatactataaacacctctatgcaaataaattagaaaatctagaagaaatgaataaattcctgcacgcatacaccctaccaagactaaaccaggaagaagttgaatctctgaatagaccaataagctctgaaattgaggcagtaattaatagcctagcaaccaaaaaaagcccaggaccaaatggattcacagctgaattctaccagaaatacagaggagctggtaccactccttcagaaattattccaaacatttgaaaaggaaggactcctccctaactcattttatgaagccagcatcatcccaatacccaaacctggaagagacacagccaatatcatactaaatgggcaaaagctggaagcattccctttgaaaactggtacaaaacaaggatgccctctctcaccactcctattcaacatagtattggaagttctggccagggcagtcaggcaagagaaagaaagaaagggtattcaaataggaagagaggaagtcaagttgtctctgtttgcagatgatgtgattttgtatttagaaaaccctatcatctcagcccaaaaacttcttgaactgacaagcagcttcagtgaagtctcaggatacaaaatcaatgtgcaaaaatcacaagcattcctttacaccaacagtaggcaggcagagagacaaatcatgagtgaactcccatagacaattgccacaaagagaataaaatacctaggaatacaagtaacaagggatgtgaaggacctcttcaaggataactacaaatcactgctcaaggaaataagagaggacacaaacaaatggaaaaacattccatgctcatggataggaagaatcagtatcatgaaaagggccatattgcccaaagtactttatacattcaatgttgttcctgtcaaactaccattgacattcttcacagaattaggaaaacctattttaaatttcatatggaatcaaagaagatcccacgtagccaagacaatcctaagcaaaaagaacaaagctggaggcatcatgctacctgacttcaaactatactacaaggttacattaacaaaaacagcatggtatgggtaccaaaacagacatatagaccagtggaccagaacagagacctcagaaataacaccatacatctgtaaccatctgatcttcgacaaatctgccgaaaacaagcaatggggaaaggatctccttattcagtaaatggtgctgggaaaactggctagccatatgctgaaaactgaaactggaccccttccttacaccttatacaaaaattaattcaagatagattaaagacttaaatgtaaaacccaaaaccataaaaaccctagaagataacctaagcaataccattcatgacataggcatgggctaagagttcatgactaaaacaccaaaagcaattgcaacaaaagccaaaattgacaaatgggatctaattcaactaaagagcttctgctcagtaaaagaaactatgatcagagtgaacaggcaacctacagagtgggagaaaacttctgcaatctacccatctgacaaaggtctaatatccagaatttgcaaggaacttaaacatatttacaagaaaaaaacaaccccatcaaaaagtgggcaaaggatatgaacagacacttctcaaaagaagacatttacacagccaacaagcatggtaaaaagctcaacatcactgatcatcagagaaatgcaaatcaaaacctcaatgagataccatctcatgccagtcagatggcgattattgaaaggtcagaaaacaatagttgctggcaaggctgtggggaaataggaatgcttttacactgttggtgggaatgtaaattagttcaaccattgtggaagacagtatggcgattcctcaaggatctagaaccagaaataccatttgacccagtaatcccatttctggatatatacccaaagtaatgtaaatcattctgctataaagatgcatgcacgtgtatgtttcttatagcactatttacaatagcaaagacatggaaccaacccaaatggccatcagtgatagactggataaagaaaatgtggcacatatacatcatggaatactatgcagccataaaaaggaatgagatcatgtcctttgcagggacatggatgaagctggaagccatcatcctcagcaaactagcacagaaacaaaaccaaacaccgcatattctcactcataagggggagttgaacattgagaacacatagacacagagaggggaacaacacacaccagggcctgttggggagtggggatgagaggagggaactatgagggtcagtagggatggtgctactaattaggtagtagggtgctgcagcaaaccaccatgacacacatacacctgtataactaacctgcacgttctgcgcatgtatcctgttttttttgttttttttttgtttttttagaaaaagccgggtgcggtggctcacacctgtaatcccagcactttgggaggccaaggcggacggatcacaaggtcaggagatcgaaatcatcctggctaacatggtgaaacaccgtctctactaaaaaaaaatacaaaaaattagccgggcgtggtggcgggcacctgtagtcccagctactcgggaggctgaggcaggagaatggcatgaacccgggaggtggaggttgcagtgagctgaggcgacaaagcgagactctgtctcaaaaaaaaaaaaaaaaaaaagatttctagtacattgcctaaaagaacccttggatgaagtcagacacatgggtagtatgagaccccagatagcatcattttgtatgtacagaatcgcttttttttttttttttttttgagtcaggttctcactctgtcacccaggctggagtgttagttatgtggtcatggctcactggagccttgatctcgtgggctcaagtgatcctcttgcctcaacctcccaagtagctgggattacaggcacacgccaccatgcctggctaatttttgtattttttgtagagatggggttttaccatgttgcccaggctggtctcgaactcctgggctcacgcgatcagcccacctcggcctttcaaaatgctaggtttacaggtatgagccactgtgcctggtctagaattgcttttagtggatgattttttgctgtcactgttaatggcgtgcattttctgagttatcagagatggccctgcatgctgcgagtctgtgttgactgtactgttggctgtgtgtgtggagggcaggaaagtgccgtccttgctgtaacttgtgttattaatgatatggacactgtgagttgcttctagagagctacacctcacttctgtgtcagcaaatgaaggcccaggaactgacagcgttccctctagctttaattgcggtataatcaccacaccctaacattctcctgttttacctttggcaacatctagagtttggttgtcacagctgatggggtgggggtgctatggcattgggtgggtagaggccaaggatgctgctgggcatcctacactgcccaggacagccccccacaaattatccagccctaaatgtctacagtgccacaggtaagaaatcctggaccgtagggtagacagatttgactggagtggagaaattgtatcctggggtaagtgggatttggattgcagttagtgcagagcttgtgtgtgtggaacgccttggacactggactaatccaagaagttgggtggggaggaggggggctttttctttaggtcctggaaaccattaaaaacctttgaacaggtgctttagaaagacaaaactggcatctgtctgaaggatggattacaacaggcaccagcagactgtggcccacggggccgtgtccagacttggcacacaaccatgcccattcattcatgggttgtctctggctgctgtgatggttaactttatgtgtcatcttggctaggccatagtattcagatatttggtcaggtacttaggaatgttgttgtgaaggtattttttagatgaaataaacacatcagtagactttgagtaaggcagatgacttccataatgtgggtggacctcatccaatcagttgaaggccttaagaaaaagactgaggtccgccaaagaggagggaattctaccagtatcctgcctttggatttgagactgtgacatctgcgctttcctgggtctctggcctgctctggaaagtttgggcttgccggcctccacaattgtgtgaaccagttccttagaatctgtccatctgtccgtccatccatccatccatccatccacgcacgcacacataaacaaaccctattggcactgtttctctggacagccctgactaacatcactgctttcttgccacagcagccaagttgaatacgtgcttgtaagtacagggattgtgtggcccacaaagtagaaaatatttactctctggccctttacagaaaaaaggccaagcattggatttggtaagtgaagtccttccatgaaactgagaagtgctgagtcagtactcaatgggagttaaaacagagaaactgtaaaagccaagagggctcaggatggtgataatcacggtctttcattcttttctcctgtgcacatttgacccgctggcatgcaggagatttaatctctctaatccagaatgtgttttagggaatggcttgcctggcttgtgggttgaaatgttctctcctcagatgtggctcctgcaatatcagctcacctgatgacaagaagtggaagccatgtaaccacctgagacgcaagttaattagggtttatcagaaagacaacctgaacccctgtgggatgtgctgtgggtgaagaaaagataccagtattctgtgattccaaataggagattttaaaaattctacccctggaggatgggttggcatttgtcttccaaacataggttaaatacgttttatttctgtctgttttgtacacattttaatcattttccagctcacaattacagttggtacttctcaattctcagtgaattgtgtagtggaattgtttgcaacatcatactttggaaatgacgttggcaattaaagttttggtccaagtttaataatgaagactatttgaaaggccaaaaccgatggatgcttttgagatgaaatagtcatttgggaagaaaatgagggcaggttgtctacttcttaacatttatctgtttttttttcttttttgagagggtcttgctctgttgcctgggttggcgtgcggtggcgcgatctcaggtcactgcagcctcaacctctggggctcaagtgattctcccacctcagcctcccaagtagttgggattacagacacatgccaccactcccagctagttttatttttttgtagagatggggtctccctatgttgcccaggcttgtctttaactcctggtctcaagtgatcctcctgcctcagcctcccaaagtgttgggattacagacatgagccaccttggattacaggcatgagtcaccacgcctggccttaacattgatcttgatgacactgaaatcgttgatgtgtgccaagggggttcctttttctaaatggaagctcactgttttgggtatccatgaattcatcatagatatgaagagaaagtttgaaatgcccaccagctgtctgtggtagcacctacatttgtgttactcatgaccaatgcagctttcaagtttatgacacgtggcaccccctgagcttaactacctggttgctaatgtctttggacatcactgtatttgttatgtcagggttccttttgctaattgctcttgtgggctttcagactttctctatgtacgtttttttgttttttggtttttttttgggagatggagtctctgttgcccaggctggagtgcagtggcgtgatccactgcaacctccacctcccgggttcaagtgtttctcctgcctcagcatccctagtagctgggactacaggcatgcgccaccacgcctggctaattttttgtagttttggtagagatggggtttcaccacgttggccaggctggtcttgaactcctgacctcaggtgatcctcccgcctcagcctcccaaagtgctgggattacaggcatgagccaccgcacccggccagtgtaagtcttttgaaacacagacacctagtgcctttcccgtgagtctttcagggaaagattgagttccgtgtcaggttggagttgctgatcaagcgactgactatacggcttcctagccccctttatttgaaaaaccagcgtggtcttcacttttcccttgagcctacaaccacagggtgcctgttcatgtatttccaggaccttatgcggctcctttgctctgcttattccgagaaccaagccttgggactgtgcattttgaatacaaatgaaggcacccggaggaagcccccagagtctcggcacagttgaggaaacaaacaaagcatgctacacgtgcaggaagatccctctttaattcctatgatgacctctctgcttttttattttttaagttaaaaggagtcaatgctttgggttttgttagactggacaaggtagcaagtcatattaaactaacccaggttgttgcttgagttttcactgaacttagactctactgacgagtatagtcaagcagaaattcccctcacgaggtggcctgatggtgtactccagtgggggggtgcagaagatttggagggatctgcttcccgactggggcaggttaacctctttctgccttagttacctctttgcatgtcctaagagcacctgcttatcagatccttaggaggattcactgaattcgtccacttggaatccacatggaaggctgcctggcatgtaggaggtacccagtaaattttagactcctgttatttttgccagttggattcaacagatgtttgttccctggactagtgtttctcacctgggggtgatctgcacctaggggacatttgacaaagtctggagacattttgggttgtcacagcttggggagggagtgttactggcatccagtgaatagtaaccaggtgtattagttttctgtcgctgtaaaggaatacctgagactgggtaatttagaggtttatttggcacatagttctacaggctgtacaggcatggtgccggcatctgcttggtttcttgggaggcctcagagcttttgctcatagcagaaggcaaagggagagcaggtgtctcacatggcaagagagggagcaagagacagagggaaggctaggctcttttaaacaaccagctcttgcatgaactgagggaactcactcagtaccagggggagggcaccaagccatggttcctccatgaaccaaacacctcccaccaggccccacctccagcagtgaggattaccccactacatttcactgtgagatttggaaagggaagacatccaaactatgtcaccaaagatgctgctaagcatcctaccgtgcacagagcagcccccataacagggttacctggcaccagagtgtcagtagtgttgaagttaggctacactgtagttcacttgcttattgtgtgtaggaagaccggaggccagttacctggcaataacaacaacaacatcaaaaccccctcaaacccaaaacaaaaaaaccccacatgacactgtgagtgttttttttttaatttgcaggagattgagtcttaatccagttgaagacctttatttccttgctagttacagagaggtttttcctggttcgttgcctgtgtttgttgcagttagtttttattgacctttctagggttcatgtgtgtcccttgggtttgccatgttttgttctccaaagccccaggagggttccccagtaacagagactgtgttagatttttaacattttcttttactttttgttttaaatgatttcttttgattaattacacactcacactgcgttgcaaacatagtgctgtcagatcccagtactgtgtcctttaccggctttccccaaggggagtggcttctcacaggatcatagagcaggaaaacccaggaaatccacgttggtgcaacacagttacctagccttggagcccttacttggatttcaccctttttgcgtgtactcatttgtgagttgcatgttaaagatgagagtcagtaatatatttccaaatgtcaacagaacataaattgagcagaagagtttataatgagatggaggattgagcagaagagctcatagcgagccagggcgaacaacctggcgaggagctccttgactttcttggaggccgaggtgggagcgttggtgacaacccccgggaaggcagatgttatcaggagttaaaatgtgatgtgtgtaccgctcatgtgtgtatggggtgtgctccttttgtttttgatgctgaaatgagacaaatcatttcccttttaagctccaggcagactgatggaggggggaaaaataacacccaacttactgcaacctgaaatcctttgccttggatccacttcctaagttcctatagtccttattttataaactgataaaacaacttttctctctcaagtgatgatcatcttgtgttttacactaattaagcccatatacacctccctttggaattccttcttctgatctgcttggcctgtttgccagttagtcgccttactaggagaatcaaaatgtaaactcataatagacaggaacccaacatcatcagcacaggatgtggcagaatgatttttctttcccacctcttgctgagaaggcaatgagattggaaatggcaaacaccccagagttctgtaactctgagtgtggaagaggaggtggcagcccttgacctcagtagcggagccagatcatcgaacatccccgtccaggaatctggacatgcactggtcaagaattcagcacaatttcctttggtctggggattgggaagctctttttgtgagtgaggcatggagtgaaattgcagaagcctgcgtgacttgtagaaaccgaagccaggctcgtttactgccttgcacaagggagatatgataagacagaatttatttgtgagtgtcgtcgatgccaaggagcctgtccaacatttatagaggcttttgggctaaacgaaaaagggtttgatctgtctgtggagacagaaagtagatgagtggttgcctaggactggggctttaggcgggtaagaggttgtcactgctaaagggtacagggttaatggaaattcttgaaattgtgctgatggtggctgcacaactctgcaggtactaaaagttgttgagttgtactcgaaatgggtccactgtatggcatgtgttttatatctcaataaacctgtcaaaaaagggtgcaggaccactgtttttgtacatgtcctcaaaatacttcctgtaatctagtgtggtcacagctggttcatgtgcacggacatagtgtcagtgtcattgtggagatagcagtttcagattcactggttccagaaaatgtgtccctgcctgttatctccgtgttgccacaattaagaaccaagggtccataacaagcagtgaaaccatggttcatatcagaggaagtggggtggtgtcatctcttttgtatttttctcttttctctcccccactgcctttgcccacttccttctccaaaataaaacaaaagagagaaagcaagagataagtggctgagctgaatgtggtccagccctttagaagaggggagtacacatactggagggaagataagcgaaaatacagcctttctcaagggccagcacagacggagataaagagagagccacaggcacactggccaagcatcagctcctcaagcatccatctcactattcagggtggggaaatacttgatacctcaagtcctctttatcatcgcagatgaaaactgacataggtgatttcctttcggagcatttagggagaatgcaagggaaattgacaacacacttggtgcaattgggtaaccagtctttgtgttgccctccaatgactcttgcttggaaatgattggaagcccatcgttttaagtcattggaacgactgtccccttcataaagcatgatgtagcaaaatgaaaagcatacttctggttaaaagtgtttttcaaaaaaagcttaccacattgaggaggtcatttcatatttcctgatattcagcaattttgctgtgagctttgtagagttgttctggtgcttagttcaaataagaaaggaattactgaaattgcacattaagttaaaaaaaaaatcagggttttgggtcctgagacttgttacctaaacatctgtcttgctattttgttacagcacaaagtaggaattgtaaaacatcttcgttataaactgagtactatacagtctctgggagagcagaagaaacgtggtaggaaggaaccacccagggtgggtaatgacagagtagagatagtcagatagggccggagacaaggccaggaaaggcgagaggaagagcctgcaggaacgagtttcttgcacgtttgagagctggacctgccaagagggtaaggccaacatctgtgtgtgttctttgaggaaatccgagtagcctgccctgcctttgaccctctgctctttgaactgtggattccttcccatacacctgtgcattctcagtgccgtggtcagatccccaaacagacaccaaaccccgacctccgaggcccaggcaggagcataacccagccccaaggggagataaagacagaaagaatcagtattatagcagggacctttttcaggaatctgccttctgcagggcagtgccctaggtgcattcaagccagcatagcaaatccacatcactagaaagactctttccgttttataacttgggaaactaaggccaaggcagtgacaaatgccaggtccccaaactctgaactgcagatctgcaagctgaatggtggcaggtgggccagtgggattttaaagccgtgtgcttttcagggcaccctggtgcttctccaaatgccggaagggtttccttgaaaattcatagcactactcagtcaggattctgcaggacagtgccctggggagtgcatgagtggatggttctgtgggtagaagccacgagctgaagatagttttacatgtttaaagagtaaagagactgggagcggcggctcatgcctgtaatcccaacactttgggaggctgaagtgggaggattacttgagcccaaggagttcaagaccagcctaggcaacatagcaagaccttgtctctaaaaataaataaaataaaataaaagccaggcatggtggcagtgctcctgtagccccagctatgcgggaggattgtttgagcccaggagttcgaggctgcagtgagccatgttcatgccaatgcactccagcctgggcaacagagccagatcctctctcaaaaaaaaaaaaaaaaaagaaaagaaaaaaacagtaccttgttgatacatggaaatgatgtgacattcagataaagttttactggagctccgccatgcccattcatggacatattttctatggttgctttttcacaacaaggggtgttgcaaccatggcaacagacactgtctgtcttgcgaagcctaagatatttgctctctggtcctctgcagaactagcgtgtagttctgagtgcttgaaggcacgtaccatcttggtggtgtgacttggactttcacctctcctgatcccttcttcatttccaccctactctcatcttgccttgcttgcagaagcctggtattttcataattcgagagtcacttacttcatgtgaagtcttgtcccagttaaagtgccaatagtcctgggagaggtaatacattaaaccttatcagttatttatacctcaggattggaagggattgttgctggctttgtcctataacagctgcgaccagaggacagagcctaagggctgttgcatgaaatgagggaggtgtgggtcacctctgtgcagggcatgagaagagaggaggctgggtcatctgaaagatgacctttgttcatggcctttttctgtatcctcctcagtcacccagaaattgggattgttggtgacaatcttttgggaattggtgttagcttcggagagccacttagcctgaagaccctccttactccgttatcatagaaccagagtggtagccacacaggcagactgtccatgctgacgtgtaaggcagggccttacacctcctacccatgtaggaggtggtggagctgggattttacatggacagccttctgctcccctggtgcttagctacattctagtgccttctgtgcaatgccagcttaacatacatatgaagtgtgctgacccaatctcctgcctttgcgttcactattttagatggttgtgtcaccttgagcctggactagggagataacacgtgaaggagatgccgcgtggtttctgtcttgtccatggtacgtggaacacattcccctcagtaacattatggttgagacatggaatgccacaatgtacagttgccaccatatggtatacttcatatatatacacatatatatttatttagtttattttaatttttttagagacagagtcttgctctggtgcctaggctggagtacagtggtgcagtcgtagctcactgcagcctcgatctcctgggctcagtgatcctcccactgcattgtcccaaagcgcttggattataggtgtaagccactgggcccggcctacttgtatatttttcattgcaaatgtacatttcagttacgttgtgggctttaaaaagcctttctaggctagttgggaatttgaccctattttttacagcatagtttctaggagaaaaacatttctgaggaagtaacaaaagaagacttgggctgtatcccatttttaatttagagagcactgtcatttgaaaatttcttctctcaacatgttttctttttgagacatgaagtaggcaggcaggatcttttttacagtggcgctggtgtctttgggaagcggcttccttggtttgcctttgctcattttctttcttgacttctccaggcattcagctgcaggcatgtacctctgctgctgggagagtggcaaggagagggggttggaggaacggggataaaaattagctagaattcaaaaacggcagtgacagcccagatgatttttcatgctaacctactttaaaagctgccagaataattgtggagtgggaaatctctcatttctcctgtcctactctgacaagatctaaaaataactttgaggagatgggcatgtggccctttgatctccttggcctggagtatttcttggtaggagcagagcttacaagaaggtgttcttcaatgagtgttctggcagtcggagttgtgggtggggctgattactgtaatcttccttcgtcattgaacgatttcatctgcccctggtttccattacttgctgctctaaatattcctctccccgcaccttccttttatgtagccacaaactggaatatgtgcatggaaaacccaaaggaggcaaatcccacttacactgcagaactttggtgctggatttagcggctatttaccaagcacctcctcttccagaataagtagcacagatctttgaccgccccccgccccccaccgagggactgtggtctagttggaagacacaaggcagaggtgtaaaaagggaactctggagataggaattggaaatggggctgagagctgaagagatggcctggggctagagaccagggagatgggaggagggggagttccttggaagagtgtgcccctaagagatcctgaagagtgagcagagattgatgagaggcgagaggagacctagagttatcagggctgcagaggtgtccttggcacatagaggccatagtatccacgttggcttccagggtaggggcagtgcatctgcggctggctgaagatggaataaatgggatagtggctaaaaagatgggggtattgggggaacacctctccttggagtggtcctccttgcagataaggggagacgtagaacagcacttgacagggaagctggtgtgggggaaggatttttttacactaggggagacttgtggttgagttaaacaggttctagaggccaggcatggtggctcatgtctgtaatcccagcactttgggaggccaagttaggaggattgctcgagcccaggagttggagaccagcctgggtagcagcagcatagagagaccctgtttttacaaaaaatacaaaaattagctggacatagtagcatgcacctgtaatcccagctgctcgggaggctgaggtgggaggataacttgaccccaggagttggaggatgcagtgagctgcagttgtgccactgcgcaccggcctgggtgacagagggagaccttgtttctaaggggaacaaaaaaagaagttaaagagataagataaagaatggggggaggggacgtattttttgcaggagggaaattttgagggtttttagccttggaaaaggagcagaacagatgggaaggtcgtaaacgtggaacctttggaagcagaaaggaagatgatttctcttaaaaagttttgcctagagatgactaatgtgaaggtcttggtgttttaagggagcagggaaagccagaggtggtgggtccggtagatgcaggaactgacccaggctttcagattgtacactggggagcagagagtgcgtgcttgggggtggggaggctgctggccagggctgaccttcctcccatgacccctgcgtagaatcagagtagcctcatttagtgtacttgagtcaaggccttctgtttaagagcttatttgaactcattacagtcatcgcttggtatccttgggggattggttccaggacctcctgcggatacccaaatgattgcacactcaaatcctgtagtcctctcagcaaaacctgctgataggaaaagtcagccctctgtgtctatgggttttgcatccccagatactgtattttccatctgaatttggttgtgaatgcagaacctgcccataaggagggccaattgtatttattgaaaaaaatccgtgttgttcaagggtcagttatagtttgaactacaaaaagcaagcaaccaaacaaaacccccaaaaaccaaagctttaattggttaagtcagagcagactaaaaaggactacatgcccagtggaactttctgtgtagtctagtagccatatctggctatgaagcacctgaaatgtggctcatgcaacagaggaattgaattttaaattttattccttttaaatatttatttttgtctttcttcgtttcttttttttttttttttttccctgagatggggtctcgctttgtcacccaggctgaagtgcagggtcgcgatcactgctcactgcagccttgacctcttgggctcaagcgatcctcccacttcagcctcccaagtagctggggccacaggcatgagctactttgcccggctaattttttaacttttgtagagatgggggtctcgccatgttgcccaggctggtctcaaactcttggtctcaagcaatgcttccacctcggcctcccaaagtgctaggattacaggtgttgagccacaatgcccagcctaaatatgtatttcagtagctccatatggggaggtgtcttggacagagcaggttagcccgtgagactctctggtccttgagtgagagggaaggatgagggcttgcagatgatcccagtgggctggttctggaagcgaaacctgcaggccccatggcttggggaaggctgaccatagcaggtgggaggagctctctgaaggccgaggctgagcactggtggagaacagggcccgtgctcacgtatcccacaccccagaacttggtgtgctggattccagccttgtgtgtttctcattatgactatgtaaatgccaggagggttgggactgtgtgatttttcttcttgcttggatgctcgagagttcttcattaattagtgaaggaaagctggctctaaggagaagcagttgaagtggagttcattgcccccacttctctgcagcaggaatgccttgtccctcctgcctcggttgaactcactttctcaggctcccacctttgaatggaggcccttgtcaggctctccatccccagcgactctgttgacatttccccatgggaaaggaaaagaccatctgaaagtttccatctgtgtgcaaggttttctgaacatgttgacaacatgggtttaattttgtgaggtcagcaagagttcttgtggtttgggatttagtaaaaactgtaggctttgtatgggaagaaaatctctctcacctctgtcttctattcttcattctctacacagactctccacttgtctttagcactaaaaacacaaactaagcattatgttttaaaaaaaacccaaaccccaagtccagtagctgattgccctgctttagcttttctccctcgttgtcattcttcaaagaaagactccactcctttcagctgtcaccctttcaccctgatcaccgcatgcagtctggcctctgccccgcttgaaagaagcactcttcccagggcacccgggaactcggaactgtgaacccccagagtctgcccagcccctctgtccctgccttttgagcaacagcgactggtgccacaacctggggtgcccctttccctgggcagcattacccacactgggccaccgtgggccaagtcacccacactgggccaggtcacccacactggaccatatgaggccacgccactcacactgggtcatgtcacccaccccaggccacactgggccatgtcacccacacttggcagggtcctgtctttctccactctggtgtctcctttatcttgatgctcaagactctctcaaaacaccagtggttcagcacagtgtggggacagagacttcagcgaggcgcccccagccccacccttgacgggaaataagcgcaaactccttgtgcctgagactcaaagggtcgtgtgcctttattggcccccttgccttacaccagtgttcttaacctttctgtgtgtgtgcgtggctctctgtagtcatcgagtgaagccgcagaggtctcagaatcacattctaaaataaaagtagaatcataaaggaagcgattaaaagtgcaattgtcaaaatatcaaaaacatgatttgttgaatagtgcttttttcttttctttttattggtaaaatacatgtaatataaaatttagtcattttaaccttttttttttttttttttttttttttagacagagtctcactctgttgcccaggctggagtgcagtggcacgatcttcactcactgcaacctccacctcccaggttcaagcaattctcctgcctcagcctcctgagtagctgggattacaggcacacgccaccacacccagctaatttttgtatttttagtagagacagggtttcaccatgttggccaggctggtctcaaactcctgacctcaggtgatccacccaccttggcctcccgaagtgctgggattacaggcgtgagccagtgtgcccggcctattttaaccatttttaagtgtacagttcagtaacagcaagtacattcatactctgcacagccaacctccagaactccttttgtctcgtagtcctgaaactccatacataactacccactcatttccccattcccagccccagcacccacccaactttctgtttctgtgtgcttcacagctctgggacctcagatacgtggaatcctacactatgtgtctttttgtgactggcttatttcactcagcgtactgtcctccaggttcgtccacatggtagcatgtgtcagaatgtctttcctttttaaggctgagtgctgttccattgtatggataggtcactttattcctgtaactgtagatggatacctgggttgcttccaccttttgactgttgtgaataatgctgctacaaacttgcctgcacaaatatttccttaagatcctgctttcagttctttgatgtgtgctttctaaaccttttttattttttccttttgttttgagacagggtttcactctgtcccccaggctggagtgcagtggcacgatcgtgactcagtgtagccttgatctcctgggctcaagcgatcctcctgcctcagtctatcaagtagcttggactacaggcacatgccaccatgcccagctaatttttgtatttttggtggagatgaggtcttggtatgttgctcaggttggtcttgaactcctgggctccagcaatcacctgtccttggagggagttggcaatggaagtgggttggctgttggagcccattagaatattccagagggatgatggttccttggaccagggtgtggtcaaggagctggagagatgggagtcagttacagacaagacagtgggatttattgggattcttgatttctctcagtggtgagaaatttcgtctttccacacaccttccatggaaacccggaacaccatgggtcccccgtaggcagtcttaagaggatagctgtttttgttctccttccaaattcccattagacttgaggtcagagtcacactttacttgttttgaatatttaaagtagtatacctaatagctcaatagactgtatgcttttatttttattttttgagcctgccttcctaggtatttggacaaatttctccataagagaagtgaacacgtaactctaacttgtaatagcaaataccgcgggaacactgggagccacatattaagatgttattagaccttccctggagtatccaaatggtctataattgcttaataaggagaagtttttgctgagatttacatgatagagatttgctttttaaaaagaaattatccagatttgaatggaaaaattgcatagtctcctgagtgttgttttgcctttgactttgtactgtttaagaactgattatgagcaggaggaaataactcacttcagctgtaatataaatgtgcattggtatttaagcatatgtgacacataaaacaataccaacttggccagaatttaaatgtttatgtaaattacatttttggacaggcactttcctctattttgcagagaaaataattttttcccaaagagattttgtgtttaaaaaaaaaacccctaatactactattaggagtgttagatgccttcgatgtggttttctttcctctttttgcctgaaaggcttgagtgctgaagcatctagcgctattcttgtgtccgggaacgttcctgcctcatttttgtttctagtcttgtttctttctgtgtcagaaataagactaatgcgtgcagctgcacctatagttcaagatgaaggggtctgtgtgagagagagaacgtctgtgcatgtgtgtatgtgtgtgagtgtgtgtgtgagagagaggagagacgggcgggggaggggagagagagagaaaagagagagagagaaaaaaaaacacagcctctttgtaatacctggttgactcagtgaagtctggctctctgagctttactgaattcctccttacttattttggggccggaggtggagatgagttcaaaagtagataaaatttgcctgttacctaaatgagcagaatagattgcgcataatcttttctagatgaagcctgtgtttttggcattctgctctcaagtcctctgagctgatctgagagtgaactggagtgttaagttgagagagatgttgatgactctggtgtggtcttttcctttcggagaagtggaggtgaaacgacttgcccggggtccctgggaagcagagcttgtgccaagatgtaatttttcggttctaagccctgtggtttttcttctgcagcaaggtgggtaccctttttctgtaagggaccagagagtatggattttaggattttggggccagtcttggcaactattcacctctgcaactcagccacattgtgagaaggcagccctgcacattgcataaacaaacaaatgtggctgtattccaataaaactccatttatggccactgacttttgaatttcatagaatattctgtaagcatgtgtcagcagcttcccctgtgcaggtccatgctcagaggtagtcgcgttggggaaagttgctttctgccctcctggagttgatagacttgtggggaggcagatactggaaagcagccacagacacaccaaaggggggagtcagtcccctgtcatgggaattgtgatggggagcgccctcccctgtgcatttagaaaggccccgccacacggaaccactgggaagctgaggcttggagattgcgtgggatttgagatgagccaggcgtgggcagggagatcgcacaggggaaaggaggatcgccgtggatcacacaggacaaaggaggtcctgacctgtccacccccaaagccctttgcttccctagcccacgttggtgtagggtgggccgagagggggcgcagtgtgaggagtgactgtagctgcagctcagcagcgtctcaggagaagccagctgtctctactcaccacgggagtttatttccagtgtgggagagggactcttgagagagaaggacaagatgcccgtttgccctacagattcctttgaggaaaattcctataggggtctcgtctctgttgtatttattgtagtacgacctttttttaagtgattcaccataatctctctaggccgtatttaggcactgaccctaaatgtgcgttaaaaaaaaaggtttgggatattttggtttatttatttgtgtgtatgtatatagttgttaaattggtgtccttggggtgggggttgatcggtggaaccttatcttctctgctttcttgctccaccccatattttggtttgtttttgttagaggtcggcaaaccttttgttgtcaatggccagataataaatattttgtggtttttaaaccctgtagtctctgggtgttatatggcaaaagcagccattgacaacatgtgagtgactgagtgtgtttatttatgggcactgaggtgctgggatcccatattcacactgttccgccaccatcaccgccattcataactcccaaactttttctttttcttggtggaggagtggagcagggtcttgctctgttgctcaggctggagtgcatcacggctccctacagccttaacgatcctcccatgtcagcctcccgagtagctgggaccacaggtgcgcatcaccacgccaggctgattttttaacttttctgtagagacgtggtctccttaggttgcccaggctggcatcaaactcctggcctcaagcattccacccactcctgcctcccaaagtgttgggattacaggtgggagccaccgtgcccagcctcagaaatttttcattatcccaacccgaaacctggtccccatgaaacagtaactccccattctcccttcccccgcagcccctggcacccaccgttctattttctgtgtctgtggatttgactagtctgaggtgcctcatgtcagtggagtcatgctctgtttgtccttttgtgtctggcttttttcacttagcataatgtccttgaggttctcccatgttgtagcctgtgtcaggacatttgcagctcagttcatttccgaggaattgtcctatatgcagggggtcttaggaacacaggtaacttcacttcccatttgaagagcgaggagttctcccgaggccctgaacaggaatagagactgtgaggcattggcgtttggaaggaagtgtctctgaaatagaaacgactgtcagatgaagagggacagttcagtatggtacccgggcctgcctttccagacgtccccagcctctttgcctagttcccactctgggcccctgggcaggtgacccgcagctgcacatgggtttcctgggaagccacagtgctgaggatcttgggagagaggctcaggatcagagtctggggagtgcaggagcttgcggggggagggggtggggtcagtgggggcggggggtgctgctttggggattgggaggagtggactggggcggggtcacagagtctttagctgaacccatgggtgctctgggtctcggcttgtcctgactcaagtcaaggggcccaggcctttgtaaaggtccacattgcccattcactggggcctggctttgggtgagggtggcagctggagatggggggaagccctgaacgggaatcttggccacacactgctatatccgcgacaccaaattctatcccacctgttgttggctgttctggaaaccagcactgaaaaatacggagtggaaaagttttctgattttttttttcctgctttgtttgggttttttggaaaacaatttcaaaattagcatatggcttgttaaaattaaatcacaaaggaagtgcctatggtaacgttttgatcaggctctaggtctgtgtgaaccacggcccatatttgaaaatccagctttattgggacatagccatgcccattgctttctgtgtcctctgtggctgctttagtgtgccaccagggcagacttgggtgggttgcagcagagatggcatggccctcaaggtccaagatgtttactctcttgccggtcctctgttatctctggtctttgtggttgccacagttttcttggatccaggagttaaaggcagtcctgagggatgatggcctcatctccgcagttgcctggaatgctgaatttcagacgtgctaaaggaggggttgcagacattgtgtggaatgcattcagaccccagatgtgggtgcaggaaggcaggcatggcacagccaggtagagactggtttccaggcccaagcagccttcagcagctgtgcgccttgtttctgatgttgtttgggagtaagaataatgtagacatggggggtcatgaggctcagggtaaaaacttcaaggaaacctccatggcatggttgggcgcagtgactcatgcctgtaaccccagcactgtggaatgccaaggtggaaggatcgcttgaggccaagagttggagaccagcctgggcaacataaggagaccctgtctctaccaaaaaaaaaaaaaaaaaatgaccaggtatggtggcgcacacctgtggtcccagctactcaggaggctgaggcgggagcctgggaggttgaggctgcagtgagctgtgattgcaccatggcactccagcctggaccacagagcaagaccctgtctcaaagaaagaaagagagagatagaaagagagaaagaaacctccatggcagatgcatggaggaatgggttaatatctagaaatacgctgagtggtggagtaaagaaaacccacaatagaatacctgatgaatgtggggaaagcacttctgagctcctctagttttagaagacctaaaaagacgatttaaaaaaacaaacaggagagccctgttattgttgatgtcttccaaaacgaacgtgcatttataagccaggtggcattttaatgtcacgagggggtccattctcccatctgtctcctttgcttttgttagagtcagtagcttctaggtctgcttgacattggagaggatactgaatgcagaaaattttgtttaattataatgatttgattttttccttctgtattcaagtttgcctgcttctaatgaattggcagaaatgaagagcttgctcagattttgccaggaccatttaaaagcaattaaaatcaatttagttattaaatttgaaattattgtctggctaaatgatagtttaaaattcaatttatactggcacttactttttaatgaacagaccacatcacacatttttatgttctcaaattatctgtggctttaaagctgtaaaaaaaggtgctcttttaaaaaagccctgcatgtttcctttttcctctctacttccgctaaaatatttacatgtttcttttaaaataaggtgagaaaatccccttgacttctcaattttaagaaactatacttatcttttcatcacaaatgttcatttatctgtgttgaagtcaacccaagaaatcttaaaatataacggaaagaaaatgtttctggattttttcccgagaatacatatacttttaaatggcacgttttacccattgactttaattcctccctccctccattacatttttagatgtgttcaatgaaacgtagtcctccccctttaaaaaaatggaccgagcatcacgtgtgaggctgcaaagaggctccctgccaaagcatcttatctgccgctggtaaagccccgcccctccgtcagcagctaacccttgagcgggatgtgtgcttgtgccgggtgcattgcattaagagaatgcaactgaatagagaaggatcaggaccttttgtgcagaggtggggagtgttaaaaagggggaggcctgggtgggagggtggagttagtgggagatgggtatgcttagtgcttaaattccctgcattccctaacacgaatttaagaaactcacacagtaaatgagtcagggagagggagagacagggagagagggaggggagagggagagttcctttcattcatgacaggatgaactttgcatgcttcagaacaatttacatttttccttatttctaggtacttttttgaactaagaacctggagggtgtgtgtgtgtgtgtgtgtgtgtgtgtgtgtgtgtgtgtgtgtgtgttggtgtgtgttggtggtggggtttttttgccttatatttcataaatatttcttggttgattaaatgtcaataatcgctcatttctggtttgtaaagctgttacctgatccttgaataccacgaatattttgtacattctaaataattgagagaaaataacaacgacaacaaaaagacacaaataaaaagcatctccgcttatttaagaagagtagatctgtgcggggcgctgtggctcatgtctgtaataccagcactttgggaggccgaggcgggaggatcccttgagtccaggagttcgagaccagcctgggcaacataatgagaggctcttttttttttctttttgagacacggtctcattctgtcgcccagactggagtacagtggcactatctcagctcaccgcaacctccacctcctgggttcaagtgattctcctgcctcagtccccctagtagctgggattatgggcgcgcaccactaccacccggctaatttttgtatttttagtagaggtggggtttcgccatgttggccaggctggtctcgaattcctgaccttaaatgatccacaccctccttggcctcccaaagtgctgggattacaggtgtgagccaccacactggggcgcaagagcacgtcttttaaaatcagtgctgtctgtggggtgggaggggaggagaagtagatctggccatgctgaaaggttcgtgcagtggcctcctgagctgcgcacatgcttctggagctttgggtggacatttagtctgcatgtggatctctgtccaagcctgcactgggagcccctgccccaggaagcgaaggctgcatttcttttatgtcaattaacagatttctgccccaccctggacatctgagcgttaactgatttgtaagggaggggtgagggagggtaaaattacaattctatatcttaacattgggggtgaagcatttttaccctagaggaattctatccaaacacattaaacactcttaataagggacaaagggttgggacgtagcggttagggggcaagcccatgagcctcactccttgtgctctctctccaggaattggagagggaatccttttgcttagcattcccacgcctcccacgggcctggcactgggcccgcgggcttgccttagtctcctgggctgccctaacgcagcaccacgtgccgggcggctgtaacagcagcccgtaattctcccacagtcctggaggttctaagtcccagatcgaggggtcagcagggttggttcctccctaggcctctctcctgggcttgtagatactgtcttctccctgggtcctaacaaggtcatccctctgtgtgtgtctgtgtcccctcatctctagtcctgttggattagggcccgtcctaatgacctcattttaccttagttacctcttgaatggccctaactccaaatgaacagtcacattctgaggtcctggggcttaaggcttcagcatatgagttgggagtagggatgtaatatgcctaatgtccagaacaggaaaatccatagaggcagaaagtgggttcctgcttgccagggctggggacgggcagtgtggggtgactgctagccagcacagggtttcttctggaagtgatgaaagtgttctggaattagacagcggttgcaaaattctgaatgtattaaaaaccactgaattgtacattttgaaagagtgaatttcatggtatgtgaattatatctcagtaaagttgttataaacaaaaactgtgagggtaagaggtaaaaggaagggagttgaaagcagcatcaggtgtgaacagcccataattcagcccatagacgagcgcgaactcctagcacagctgtctgttgaagatgtgcgtgaatgcttgctttccgcacccttcggcctgcttttctctactctccaatttcatcatacattctcttccttcctccccctccccactttttcaaaacgtttcttctagtccttacttgtggctacacaaaattccataaacataatgctgcagttcaaagaagtgttctgatggtagggagataacttaggaaaatattttacctttggggaagttttggtttccttctgagtgaaaaccctccatgaaagagaaacttaaatgcagttttcaaatgctcctgagacattcccagccttttctttgtggagaagtgaaggcaggacaatttccaaggcaaagagggacctatcgcagacagcagaccccaagtaaagaaaggcacagtgatggtgggtattcgtgcagtgttttgaaaatgtggaggtcagggatgctagcttaccaggccagcatgatcaagttacgagaaatggagaccaggacactacctctgctgggtgtgctgctccgggctccttcgaaaggggaagcagctggtggacttccttgggctgtggttaaatggggctcccataggtgccatgaaggctctgcagagccagggatgcttgcaccctggagagaccttgctccaggagctcaggagctggtaggggtggtgacagtgaagcaccggcttgccgtgcccagtgcttgggcagtgctgagctccgagggaggaacccagaaccatgcgggagcaagggagggaggcaggcgaggagaagggttgcccaggagcctgcaggtcgggtcggtgttgtatcaaattgtcttttcctgctttgctgtctgatcccactaaagactagccagagagatgtggaggtgaaaaatggtggacagccatttttctccctttcactgtgtctacaatgtctgtttcatatcaacagcaacatctgtgcaggcatcctaatgagtataaataatgtcttcagaaaactgggtttgtgaggctcctgtcatctgaatttctttcatcatttaagtgatgattttttactcattgacatacagttgttatttagtggccacgtattattcgtatagggttctttatgtgctttctgtgtacatttgttttcgtgctcatcgtatttcagtgtggcttatatataataagatgcacctgttcttagctattgtggacttttttttaaaaaaaggtttatagagatatgattcacataccaaacacccatttaagtgcctaattcaacagttcttaataccctaatttaaaaaaaaaatacagtgttgagtattttccttttctcgtttttcactaaagtagactcaggattggggttatctgtcagtcccttggtttgattcttggctgccagtgtttactggggacggatgttggtacctcccttaataggatattgttacagcattttacaaattctggttaaaaaaagtcccacatgagatctcccctcttcccccctctctgagtgtaggcattgtcagctgcagttgtccagcatctccaggactcttttcatttgcgggatggaaacaatgtaccctctgaacaactcctccctgtttctcctccctccagctcctggcaaccactattccactccctgcttctttgaatttcacaacttgaggtagcttgtgtaagtggaattattttaaaagctggttcatgttaaagtgcttagaacagagcttggtgagcatccggtcaacagtaagtacttttattattctttttatattactctttttttttaaagaggccagacacatgggcttctgtcttttcacagcttgggatctgtgcagacccaggcttccagaagccatcccacttgaattcttactcccttttcccctaaaaagaagctctgaaatcctaattgtcaagaaggctttgcctgctgtgcatgcctgagtaatgttatttttgtcattatttgagagacagagaggaagcttccagtcccctgtaaggaaacgaaatcatcgtgcacagatgtggttctgtttatagagggaaggaaatggaggtgaagagtgtgtgtggcttgcagccaggcttgcgagtgtgcagaggaataaacttttttgcctccagagttttaactggaaatgtgtctgaattctacctcctgggcacactggcctgaggtctcccctgcatacctgatcgtgaaagtcttcgggtgtgtttgtaaacacgcagcccccctgatgtgagagtcagcacaaacttctaaagatgcgatgatgaattctatcagagaagtctttctggttttgtgaaaataaccttgcactctttaattatatccaaatgatcaaatctggctctgatgtcttgtcaaaattaatgttaaaggacagtgccctttatattttacttgtctgggtataaacatcctagtctttaaagttgagtctgtaggactacctctctacttgattactctgaaaagagtgtatagagtgagtttttaaaatggaattagtgtgcatacgaggaacagagtgacatttaacaaatccttcaatagatagtgctggtatgaggattggtgaaactagaggtagggaatgagcatttttggttctgtatcatattcccaagacattttcaaatgattcaccctttgccatcagaatggtttgaaatcgatcagcctgaatccactaatgtgggctgcggcacatgaattttaacactagaagcacacggttgtgctgtgtttcaaatgaactctggccatttgaagtgagcaggcataggcagtcttctgtcctgtgataacctcagtacatatcctttctgttttttaaagtaccttacaagctgctgcattacagtcgttattattgggccattacaaaaagctgtccaattttaagtgtcttggataattcttgtttgccccagcatcagaattgagcatttttttttttttttagatggagtcttgctctgtcaccaggctggaatgcagtggcgtgatctcggctcactgcaacctccacctcccgggttcaagcgattcttctgcgtcagcctccggagtagctgggactacaggcatgcaccacgatgcccagctaatttttgtattttttagtagagatgaggtttcaccatgtgggccagcatggtctcgatctcttgaccttgtgatctgcctgccttggcctccgaaagtgctgggattacaggagtgagccattgtgcctggccaaaattgagcacttttatcatgtagtattcatgtcttactggcaatgccctgtaaagttaaataagttacatttgtcttgcacaggtaataattatgaggtaatttccacagaatccaagggcctcattgactttgctataaaatcaaaacagtgaattctgataagactagacgcatgttactcttaaattgggctgtctcctggccactgttgtgcctttaacctcagcagaaggggagctgggctgcagagtgaaattacccggaggtcaaatattgctaatttgacttttatcatagagacattttctcctctcgcaccaaggcagtggctttaatccctctttcagtggtgagacaggtgcaaagcgtttacaaaaggctttctcttgttttgaatgcgccaagaaagatttccaggccgttaagttaccaatccttctttttaagtcttgaagcaattactgtaaggtcaatccactaatttcctttcagagttaccaaagacctctcatgtaatcatttggtacttgttgccatgtagccagtatcactgagtgcttttactgtgagcaaagcacaatgcatcgggcagggagggatccaaagggatcttggtttttacctttgagccatctgtggtcttgagtgatctacgtgcattagcaattaaaaggtcctgatattcttgtttgggcatattgaaaaatgtgctcttacagataggtttcctctctctactgccccccgccccccaattttttttattgtggtaaaatacataaaacagaatttaccatcataaccatttctaagtacactgttcaacagcattaaatattcattacattgtgcaatcctcaccacgatccatctgcagaactttttcatcataccaaacagaaaactgccccattaaacacaaactccctattcttccctccccacagccccagcaaccaacgttctactttctctctctatgattttgacactctagggaccttttatatgtgggatcatatggtatttgtccttttgcgtctggcttagcacaagtttcatccatgtcatagcatgcgtcagaatttccttcctttttaaggctgtataatattccagtgtatggatggactacactctgtttatccactcatctgtcagaggacacatgggtggctttcaccttttggctgttgtggataatgctgctatgagcattggcatatgtttacttctcattgatttaagtttacatagtcatgtgtggctagtggctgctgtattagacaggacaaccctaggcctgatagccctgaggacctagtttgggtgggaagacaggggtgacctgcagcgagttgtcggctgggggccttggtgagagccagatctgggttgtgaggccactcgaggcagggggaatggtgtggcgggaagtgaggcccaaaatgagaatttcagagttgaaagctttggaagtaacatgatgctctatgactgtgaccagactcaactgcaccaatgtgcatctgagatcaggtcattggcgttgaaatcgtgaaatgctcactgcttgggacgtttgcactgtgcttgatgtctggaggttccgttaatgttaaaatagcaattatgggactggagattaggtttaatgtctgggttttttccactgtcttcaaaagcccgggtcttagtagtaaccatgctgctccccattttagtaatttcagcctggtttatgttgctcaatagcagaaaagcggttcagatttcctttggatatcatggaccatatgtttgcccaggtatcctttcttattgggaactatcaaatagttaacacagatttctccaagggcaccgactgggaaattagtttaccaaagataaatttggtaaaaggaaagtttttatgtgcgctatccttaaactaagacacatctgtcgaaatattaggacgtgcccagtctcccatcctctgctgaaactttagactgtacgtccttcagatatcttctctttggtgctttgtttgggaacagattagcctcatacttcctcgcttgtaaaactgctatcccatctcttgctcaatgcttttcttgtaccgaagggtgagggggaggttccagctctgttttctgtatcagtttcctgggtgatgtttgtttgagggtgccttgtgtccagagccccagaaggtgtttccgttctctgatgagcctgaagtctgcatgcttcgcctttggtagggaaaggcagctggggaaaggttgcatggcccagtgccagggtgccagagtgcgtgtgcacctgctggggagaagcccgctggggcccctcctctcagcacaagatgaggcctcagggcagtgcagcagatggagggcttagctgtccttgccagcaaaagctgctgggaacgtggcactcagataacaggacggttgagaagcggtgagttagggttactctgatggggagatactgagaggaggggatgacaatcttgatttctgttccctttgtgaatcttttggtggccaaaatgaggaaaaggatacattgtgtttgaggacaacaaggaacatctaggcacattgcatacttgattaaatgcacaaagagcttcttgtgacctttatcacaagagtgtggttctatgaaggtcgtaggtacaatagaaattgtgttggtctgagagttactcagattagggtgcattgtgtcaccaccattttgcatagctgtggcaccttgtcaagttaaccttttcctgcttgcttttcctaatcagaagaatgaagttgaccgtatgtactctataaggtggttgtgtgaggtcaatgagattacataggcaaaatcttggtgcaggggcacttggtaaaggttagtttctgttataaatttggggtattctgtgatgattcctactcccctcttctcctcatggctaagttctacttattctttgacgtggctccgatatcactttcctcaggaagcccggtttcccacccagatggctttgggctactcatcagtgttctgtaaaatgctgagaatattgtttatagcacttctgggttgttttgtgatagtcttttgagatatctgtctcctcaccaaactgttctttgtgtcatgggcaggcccacgtcatcctcgtctttgtagtcctgcacctggcacagagcctggcacatagctcagtcaaacaggtgaagactgggttattacatcttcccactccacccccttcattatcaagtcgtggtcagggcatgccccaccaaatgcaaaccctactaggcagtacagctgagacttggaactagactaacccagtgactcagaaatgtgccacaggacttatttggctctagatggggtcttaaaagacattcatagttgcaggcagaacagaatatccagaacaggtgcagaataacctgtgtgtacacagtaggtggtagttataatgcaggaagaatttggcacaagaagtgttacagtttaaaatgaagtcatgggccctatccacactggggacagagataatagtaactaatcatcatcactgtcatcactagcccattgtcagaggtagcactgaacacttatgcgttagccaggatttgggttctagagggtttagtgtactagttgggttaccaagacaaagatgcaggcatggggtgcaagttaacaaaggttatacactaggtggcaactgactcacaggagcctggttattgcagcggttgtggccagagccatacaagtgttctgatgcccctcaactgtgttgaaatttgtttgaggccaaccaagtcagctggcgagggggaaggcaagccagagagaaattgtgaaccagaaaggccccacctctggcagtggctcttccattggagatgaagtcttcttgccctgtttttctctttaaaaaagtgagccatttcacaagggaagttaaattaaaaactgtgcttgttagcgcggagctgggacaaccgagggaagtgatgccaaaggcaattgttggtctttccttcaaatatgtgctgacttaggaagagcaaaatgttttatattaacaattaacaaaagactaagtctttcatcacaaacaagtctaaattcagtggttaggtcagtattatattttcctatagttttaaataagatgcttatgtattcactagtgctttggatgttctttggaaaaatctccaatttagtgacaagccccaggaaatattactcttagttggtccagcatcctatattgtttgtgaaatccctcttttattgtcttttaaaggttgtaaaatgctttttctgtcaataatcagagaaggatgccgcattcatattaccccagtttccaactcaacctctcctttccaattgaaaacaaaagtcagaattcactttttgttgtggggcattaagtagtaagcaaagagatttcactcgccagggaaaagaaggagcctgcaaatcagacaatatcaaaacataaccaaaccatataaaaacacaaaaatgttgcttggcagaatttaactataattaattgtactaatttaatattgtagacacaaatgatcataaagccatatggtacaatccttttgttcatgaatttcttattcatcaaatgttaggtacgtgatgtgggaaagccagtatgttgggcttcgtgctaccagggctagagttgaccagttcagctttgtttctccagtgaccaaaaaaaaaaaaaggtatctgccttgcacatgaaaacactggatggttagattggatttagccaacaacaaactgcaaaaatcggttctggctaactgaagctcacagggtttattagagttgttggagcccatgggaactgatggagggcaaggaggcttgtcgtgcaggagcagcaggaaccaaggaagctttgcagagatgagaaacaaaaaacagggaacacagcaacatttgctgtgtcaggaacgactgccactggtggcctggacaccatcacagccgcagaagatacttaagacacatttctgttctagtgttggtagttcaagattcaaagtatgtgtgaaagtgagtgtgtgtgcataggcagagtagctaattggttgagttggggtccatgtgcccacctccaggttggaccaggggacaagccatgcagcgttttggtcacccctcacttggcagtattcccaccaggaatgaccctcgctaggatttgaggggcctggagtcactacttactaattttcttaaagttgacaacgatcacaaacttcatggtctgggaaaatgtgaattaattgcctgatccaccttcatatcttttttcttttcttttttctttttttttttttttaacaaaaatctgtatattcatagattgtctcttcctctgctagtggttttgcagtagcattttcaggtgaggaaacaacaacagagtttagggtccagctctgtcattgccattgttgtagcgatttacaagttgttactgctagtatgaacttttgcctagttaaattttggaaacttgcctgtaattgcatttgatggatgataaaaattgataaatgacttgataagtgataaaaattctacggaagaattttccatggactggcttctggctttgatcctttccaactgtgcttctcctaccctcaggccgcccctatcatgctgtgcttgtctggccccactcaccctgtcctgacactggatgatttatttccaaatgaattgctcctggaagccattccaacaccattacaaccggcggcaacacagctgtcttggatactcctggaccatatagatagatgtaaccacagcattccggtagctcccacttccccagcattttcttttagaatgggggcatcagagttgaaggaggtaactgtgggtagtgtgtcttgtctttggaaattttcatcatgacctgagcttgtgaacactctgccttggccccgcctcgcactttggaagagactggagcaggagcgggcagcgttgccttcgcagcatggtaacttctctcagcgctgtttgtaaagcagaatgggagaggaaactccccagagggaaactgggaccctgttaggtagggctagcaagaggtggttaaaacgtaagcatccgctgcaccagactgtattctccacgactgtatattttttgttgttcataagagccccgaattgcaatgagtacgattttccctggacgctgcagtgtatggagaagctgtcacttgtcacatgacagctcagtcattcgatccctgggtgctgcagagagggaagaattggcctcgcagtggggagtgagtgccagcccgtggcctgtcccctgccacgtgtcaccatactgaacgtttgtgtgtgctctgtgtgttttcaaaacaccttcatgtcacctgccccggactcctccctgtgagcaaggcagggtgggcgttaccatccctctggaccaacaaggacagaacagcttgagacgcacagggtggcttccccatggctgcggaggcatagaaagtgagggcacgggacgtgaatccgtgtgctgggattctggccgcctgtgcctgccgatcaccctcagtgcctccctggatttgattttgtggctcttctgggtgtgcgtgtgagtgtgttgtgggtaagtctgttgtctaggggaaggaacgggaaatcatccggccaggaatctctgtggggtggtcggcttgagttggccatatccaagctctgcgtgtgtctcacttttcagagtagcaggaaggccgggtgactttgaaatcagatgggtattttcctgattcgaagagacttggcttcttcccccgcccctccttctccctcctcccccctcctccctcttgctggctcacaaactcaatggggcatcccagcccacccatgggaggccaggagaaagaggaggcagagctgtcagagtgtggcccttcgtcttgggggtgtgcaagtgaccgctcctgccccttgatggctctcctgtttcgggtataagggatgttgtccaaaccatgtgtgggactctctgttgacagttgtttttaaattgcctgtttaattgagcttctctaaagtcttctttgtgccaagtatcgggacaggtgatagaaatagaaaattcgacacaaatcgaaaattccagtatcaaaaatgacagcgatgtacccttgccccttaacgcagccaagaaacaggggtgaagggctactctccacatatggagcaggccaccacccttgagtgacagtagccgaacacagaacattctctgcagatgtcactgaggcttaaactcattatgttttaaagggataatctgctattcttaagaaaacaaaaaacaatcacaaatctccctgccctccccacccctgcccccacttagatcctggtagggtctggcagggggagttttgcaaggagttggggcaaattactccagcagatacttccaccccgtatcccaagaaatgtgtgtaaatgctgttatgaattaatttaaaggtattccaaactcctactaattattatgtgtttgctcaagtcaagatcaggagaagtacaggcattgctatcccatggggcctgtgaaactctggtgaggtgtcctagtggaagagcttggggccccatggtgtctggaaagcgggctccactggagattctggctgttttcagcttgatgcacacggggtcccctggagaatgccaggcctgcctgagtgtgcagaggtgagggatcctcacactgcccagcatgtacgtggctgggagactccagagagacatgcaaaagtgctgttaactagacggcgtggtacaaatgcaaagtgagtgggtttttttttttccttaaacgacagtgaacattcatttcaatatttattttgcttattttaatattttactcaatgtttatttatttttatgtttttgagacagagtttcactcttgttgcccaggctgaagtgcaatggtgcgatctctgctcactgcaacctacgcctcccgagttcaagcgattctcctgcctctgcctcccgagtagctgggattataggcatgcaccaccacgcccagctaatttttttgtaattttttgtacagacagggtttctccgtgttggtcaggctggtcttgaacccttgacctcaggtgatccacctgccttgacctcccaaagtgctggaattacaggcgtgagccactgcacccagcctcaatatttatttcaatacagaaacggacttaattgggtattttgttgaaggcaaatagtagcaaagtgggactggtgtgaggcagtggaataacttagtgaaatccaaggtttatgtagttattttccccccacttttttttttttttttttttttttgaaatggagtctcactctcttgcccaggctgcaatgcagtggcatgagatcagctcactgcaacctctgcctcctgggttcaagcaattctcctgcctcagcctcctgagtagctgggattacaggtacccgccaccacgcccagctaatttttgtatttttagtagagatggggtttcgccatgctggccaggctggtccccccatttttatggtttgaaaattttcaaaccctggctgggtgtggtggctcatgcctataatcccagcactttgcggggctgaggcagaaggatcatttgaagccaggagttcgagaccagtctggacaaatagcaaaatcccatctctgcaaaaaataaaaaaatgaaaaattagccaggtgtggtggtgcacatctgtagtcctactgcttgagaggctgaggtgggaggattgcttgagcccaggagttcaaggcttgtgagccttgattgcgccactgcactccatcctgggtgacaaagcaaaactccatctcaagaaaaaaaaaaaaattcaaaccctcagaaaagcttaaagaatagattcatggatcgttaaacatttttaccaaatgtatgttttctctcattactctaaggttgctccctttcccccctcactctcctcttctccttcccttcactccatggatgtgtaggacattctcctacaaaaccatagtacttacattcttgaggttgtcacacctcataattaaacatatgatggttttattaagtatgctgtcacatgtaaatttctccagttgtttgatccaagttgtactcatggatagtgtattgtattttacgtctctttagtcttctgtattgtagaggagtcccccaaccttcttctatgacataggagtttggggatttgtctgtttcccgatgtgattagagtgatgttgaacagttttggcaggaacgctgcacagctgatgattatatttcccattgcatcccctcaggaactcagaatctccttctccatccttggtgaaggtgtattcaccagatggctccctgttgaagctcccttctctctgttaccaatgagtaatctgtgctatgatacagtgagatggtgtgattattctgttcctcacagtggttttcctttggtggttttagcatccactgattaccataaattaattagtccagctttggcaaactatggcttgccgtggtgactcacgcctgtaataccaacactttgggaggccgaggcgggcggatcacaaggtcaggagatcgagacccatcctggctaacacagtgaaaccccatttctactaaaagtacaaaaaattagctgggcgtggtggcgggcgcctgtagtcccagctactggggaggctaaggcaggacagtagcctgaacccgggaggcggagcttgcagggagtcgagattgcaccactgcactccagcctgggtgacagagcaagactccgtctcagaaaaaacaaacaaacaaaaaaacccccaaaaaactccaccaagtctgtttacttatgtgttgtctgttaacagttgcttttgcactacaacagcagaattgagttgggacagagaccagatagccaaaaatattttctatttagctgaatcttgatctagtacatttttggtcaaaaaatgatgcatttctaattcttctattcatttttcatttagtagttggcattcttaaagaagagctttctgttttgacctttaaaaatcactatggattcatttattcttaatttttttttttttttttttttttttttttttttgagacggagtctcgctctgtcgcccaggctggagtgcagtggcgcgatctcggctcactgcaagctccgcctcctgggttcacaccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgggccaccgcgcccggccttattcttaatttttaaaagtgtgttatacgttgttgtcattacattattcttttagatacacaatgttgccctaaatttgcccagtgggaacccctccaggctgggcactgtgttcttctgtcacgcccccttcaggatggggcctgggttcttttgttatgctcctctaaggccctttaatctatgtcgtttcatttttttgttgttgtttttattttgagacagggtctcactctatcacctaggctggagtgcaatggcgcgatctcgactcactgcaacctccacctcctgggttcaagccattctcctgcctcagcctcccaagtagctgggactacagatgtgtgctaccacgcccagctaatttttgtatttttggtagagacagggtttcaccatgttggccaggctggtctcaaactcttgacctcaagttctccacccgccttggcctcccaaagtgctgggattactagcatgaaccactgcgcctagcctcgtatctgtgtcctttctttctgggaccggaagaggtttcaggttcccagtggaaattccctgcccctcaccttgaatcagcctttggccaaagagccttggagaatgatatttaatatttaaaaaccaggaactgagaactgagtgtgctcattgctatggggatatcattgctcctgggctccttgggtgcagagacccagggaaatagatgtttctgtgtatgctttcacactgtccctccctctcaagcccaactccacaggatgcttcctcaccttcctcttgccatctagtatcacgcttctgtagtgagaatctgctgcctacagcaacaacatattgacacatccattctcttctataggacacaaaaaaaggtttcagaaatttttacgttggtgctgccaccaccaccgctaccaaagcaatgaaataaagttcaagattccttgagattctcttgtcgttaggatgtatctcactgtgggtgtacagacaatatacaaaagttacttaatttttctccgatgtttatagtaccaatttgataatgtaagttaaattattcatctttattgaattttaagatatgcatattttatcctctttgagttaagtatttttcaaatatagaaaacgtttacgtggtccaaagtcaaaactctgttaataggtttgctcagagttctcagctcccatccttatcccaccaccccatttttactcacctcttcagttcattgccattactttttgccttatcttttttgtgtgtttctttttgcatctacttagtgcttttaagccccccatttaaaggcctaatgctaagtcttacatgtaaaccagcaaaaatgtcacctttttaagtagacttttgtgaccaaaaccttattatcaaagcgtgaaagttgagaccgtctagggagttttcatcatggtggttagacagtgtgtggaattgaaatgtacagcgtttgtacatgcaggtccgttattgagagaactgatccaaaaccgtgacgactgccaataaaatgtactttaccaaatatctgctcaaaatgcccatgtctccttaatgtcaatacccaacacatgggtacatccagttttagtctcaaatgttttaagatttattaagcttggtttgcaggagtttagtgttcttggaattagaaggatttctctagtgatgtggtgagaagagataaacctgggaccttttgtgttttcttgatacgcacatttatgttgtgtgcaacacaggaattgtcaggaacctgcaatgcaatctttcttgatttataatcttgcaaaatgtggaataaaaagtaaagtgcaaagtttaagtggtaagtgttacaattcatgtgaacaatatgatgctttttctcatgcttacttgaagacagcagctggcccttgagttcagtctcagtgcaaacagcctccaaagaaagtgcattgcactaaggaagcccttttcatctcacaaagggcaaagtctggattgcccccctttctctgttgtctttgcctgttgctccctggaccccagccagtctccccaggcctggagctgggtcagctaggtctgtggccaggaggtgggggtccacgtccactgtgctcctcagcggcaggttctgcaaactgcagcccgtggggcagactccacctccagcctgagtgaggccatccagctaagaatggctttgacatttttaaatggccagggtgaaaaaactaaaagaggattttgtcatgacacatgaaaatgatataaaatgaaagtgtcaactgtcatacattttgatttttgtcagtttcagagaaatttattttctctttttattaaatgtcactacataatatacttgattttgcctttctgctcactgaagctaaaatatttactctctggccctttccggaaagagtccgccgaccccctctctgtggaatgagagcttccaaaaagatgcagaagaccgtgcatcccaagcggttgtaaaagccacttactttcgtaggtttaatgactcaaaagaaagggcgcttgttccctcccttccttcctgggcaggcccctttttggaatggagtttcgttatacagaaagttgttctcgctgtacagaattctgcgatgccttcacttgatggctgtttcttcggggataggagggctgggggtcaggatctgatctcacacgaatggttcagagtctggacttagtagctcagagcagttcactgatttgggatctctggaagaaaagggtactgagtcactggcaccttctgctcagctcctgacagcagtgtaaaggatgctttcgtgacacccagccttcagcccaggaggatggtggcagatcagacagctctggaaatgcagggcacaatgcgcagagggttgcaccacaacagcagtcactcggtgcccgcctggagcactgctctcatttccagagtccctgtatttctgatcttggctgctttaaaaaggaggtgtgggcctgggatcccagaagtattcctctgtgattctgtaccacagctttaccttaattgggggtgtagggggtggggagaaagaggaagacagatgaaagcagggaaatccttcttggagtcatagttaaaaggataaaataagagctttagtgtagcctccgtttccagcaatccattttattctttgtccacaaactgaatgaaaataagcagtcattcaaaaatgatatttacgtaacctacaaaaatctcaatcaaccaaggaaaaggtggaatggggcttaatacaatacagggctgtctccggagttccctcccttgatttcaggcttttggtgtaaagctcccgaaagaaagcaactttgatttttattagactcttcaaaatcatctcggtagaatattgaccttttttgtgtgtggaaaaatgacttctacgaattctcttgtaggagtgtacattttggtcattttttggaatgtaggaaaaaaaatgtggggtaccctttattgcattttcaagaccttccaaagaagataattctgattgtaactcattataatctgggaaagtagattgttctggtttcaaggactgcgtgtgctttaaataatcacaggctgctctcagacttgggaacttttggtagaatacagcagtgattctcaaccagggcagttgtgttccttgggggacatttggcagcgtctggagacatttttggttgtcacgttttggggaaatgggtggtgctcctggcatctaatgggtagaggcccaggatgctgccaaacatcctacagtgtgcaggacagcccccccccaaccaagaatgatttagccccagatgttcatagcgccagaggtggaggaactgcctcgggggatgtgtaggagctttactttatgggttttttaatggaaaatatatgtatagacacgtacatatatatacgtgtacatacacatgtagatgactctgctcagcgcacccatgaagtatgcagtgcacctgtcccctgggatctggttatacgatgggtgtccagcctgtgcccaggggatcagtttcctttgtgctgctgcagtaccttgtcagcatggagagggggaggtcagttatgaggaggcccttttggggtagagtggaggaatggtgccgcctggtcaaggcctcgcatggggtagtgttctttgtacagttctaggtgaggcggcgaacacgttctcatgcattcttcatggtggtggtgatgctgatgttaagaccaacgggcctctgttgttctgctcaaggttccaagtagagtaggttttctattttcaaaatgtagttcacggtgtcccaatttttagtgcagcgtatttcaacaaaatgtccttttacacatataaatggcttatgttgcaaggtccccctcagcttcctggtgtggaatcagtgatggataaaggcagagaggctctcaggctgacatatactccctatgaagaggggggaagaactgtgttggcccatgggtgtttggggaaacacttgtattccaaggtatttgtggagaagatatgggatgtttttccatgttgggcttcggatatgaagtttaaggaaggagaatggagtcctggtgcacacctctcataagcacacgcacgctggccactctgctggctccagagtcatccagagcatcgagcatagtttctcccccggagaccctccaatctgatcagatagggaggctgtgagtctggtgacccccactgcagggggcagagctagtgcaggtggtgctgagctgactgggagaagaagggcctgcaggaccggctgcaaagcccttaggggagggaggaagtgaggaatttggtttcctaaacgggtggtccaagagaggccgggttcatcgctgtgcagtgaggtggcactggaaggagggagtcctcagatgggccaccctttggggctataagtctcgtggtttgtttctcttggcttcaagataacatatctagtttgggtgttttgggatgatgaggttggggtgtttgggaattgaggtggccgcgtaggcattgaggaagatactggtgttttgtgcggtcaaagggcaatggtgtggaactcagatcccagctctgaccctgtgtggtcttgggggatcatccaccatcagtctatttctctgtgacttggggataacagtacatgtgagcgtgaaataagagtataaattgcatcaatgtctgtgtgtcaaggttgcctgaggaggagttggctgggcttgcactgacgcttgattctttgtatcactccgacttaaaccacgacacttccaaggcagagtctaaagcctgtcctctcacaatcttctacaggtgagtaggaggccatagaccttgtgagtacagagtcctaaaagaaggcagaaatgtgtgaatctgccaaaagtaaagaaagggtgttactactggtcaaagtcgttgcaagaatgctggcttttacaactcctgtttctgctgctatcacctgctgcctgtgtcttgtttcctgggctccagatcattttcacatttctcaaaatggtccttggtagctgtggtagatggaataatggccctcaaggtgtatctccatcctaatcctggaacctgtgaataggtcattctacatagcaaagtggactttgtggacgtggtttaaggatctcaaggcctggtgccaggggctcatgcctgtaatcccagcacttgaggaggctgaggtggaagggttatttgagcccaggagttcaaggccagcctgggcaacagagagagaccctgtctctagaaaaaaactaaaaattagctgggcatggtggcacgtgcctgtagtcccagctactcaggatgctgaggtgggaggattactgaagtccaggaggtttaggctgtagtgagccatgttggcgccactgcactccagcctgggcaacagagcaagacactgtcccagaaaaaaaaacaaaaacaaaaggatatcgagatgaggttggggaggttgtctgggtgggcccagagcaatcacagaggtgcttctgagtggaatagggaagctgggggaacagaatcccagaggagataggaggatgggcgcagaggccccagtgatgtgggcccatgagccaagggatgctggcggcctctagaagctggacaaggcaaggaatcgaattctcccctgaagcctttaaaaaaggacacagccctgtgacccattttagacattgcacatcgagaacctaagagagtgtgtctgtgttgcttatggtagccgagctggagattctttgtgacagcagcaacaggaaacgcagacagtgggtgagcaccagatggtagagtcaagtttaatatgctggagcaaggagggtcagctaatcactggcaaaagatcagggcctgggacttttgctaactgtttctatggattcctccttcctcttgcaatgagaagcgacagcctcgtggtgaaatttgttagctgtttattattttcattgatctgattctactagtgtgatttatgctaagcataaatgaccaaagttgactgtggttttttgaagaacattggaaaataaacgtacaaaattatgtttttataataatggttcagtccaaaataaaggaatatattcatagaaattagctaaaattatagagggtaagttacatacatcttcttcttaaagatgctggtaccaacactggaagaagctgtacaagtgggcaggttgttttttgtttttgagactaggtgtcactgtcacctcaacctccccaagctcaggcgatcctcccacctcagcctcctgagtagccgtgactacaggtgtgcacctccacatctggctaatttttgtattttttgtagagatggactttcaccatgttgtccagactggtcttaaattcctgggttcaagtgatccagatgccttggcctcccaaagtgctgggattaggggcatgagctacggtgcccagtctcaatttttaaaaatatattttaccatcactttccaagctttttgtcctatgtgacaacagaaaattgaatttcttaatccacttacattgaatttaaaatccacttaggaaagtgagcttcaggtattagaattattaactccgaataagcagatactctagcatattttatcttccagattgtgttgtgattgtaacaagacacattttatgcattttagttttcatcacaaactggctgaaaatcatgttatgtacaaatatgacttgattcaatacaatttattgtttgggtataatttgaattagaaagccatttgtataccttttgctcacttacattatgctattatgcttttgacatcagaggaaatacacttacttaaaatcctcgcagatcccagagcaaatgaagagtttttgttcttttaaaaattggaagtagtctagttttctggttgtacagtaacaatgtgatatatattgtctttatcatatatacacacatacataaatcatctttccttcaaagatctcagatcacttttttaaaaaacagctttactgagatataatttacataccataaaattcccctattgtaaatgtacaggttcagtgaattttagtaaatttacagagttgtacagacatcgagacagcacaattttagaacattgtcatcactccaggaagcgtccctgtaaccattagcagtcacgtcctccccagcccctggcggccactgatctattttatgtctctggatttgcatattctggacattagatataaatccaatcatataacctgtggtcttttatgtctggcctcgttcatttagttttcaaggttcatccatgtcatagcatggattgatccttcactttttattttattttgtgttttttagaaacagggtcttgctctgttgcccgggctggaatgtagtggtaggatcatagctcggtgcagcctcaaacgtctgggctcaatcagtcctcccacctcagcctcccaaatagctgggactacaggcagacaacaccacgcctggctaatttgtttttagttttgtagagagagtgtcttgttatgttgcctaggctggtcttttgaattcctgggctcaagcgatcctcctgtttcagcctcccaaagccttgggattacaagtttaaaccaccacacctggcctgttttttattgttagataatattccattgttataaatatcccacatttttagattgattcatcagtttatggacatttggttgctcccatgttttttgctgttataaataaagctgctgtgagccctcgtgtacaggtgtttacatgcacatatgcttttattcctctggggtagatttctaggagtggagttgctgagtcatatggcaatgctatgtttaactttttgaggaactgccaagctgctttctatagtggctgcagcatttcacattcccacccaaatgtatgagggttccagtttctctatatcctcgccaacacttgttattctctctcagagaactttctgaatctctcttataatgcctagggggttccttgttgaagatgaaattagggactaccatgaactgctttaggaaacctgggagaaaggagtcaggcccctttttcatatctatgcagtgtaaccggcctctcagaaagattggttggagtggatgggagaataaagaaatgaatgggttgggtgcagtagcttacacttggaatcccagcactttgggaggctgaggtgggaggatcacttgatcccaggagtttgagatcagcctgggcaacatggcaaaacctcatctccacaaaaaaatacaaaaattagctgggcatggtggcacacacctgtggtcccagctacttgggaggctgaggtgggaggattatttgagcccaggagttagaggctgcagtgagctatgattgtgccactgtattccagcctaggtgccagtgagactgtgtctaaacaaaaaaaaaacaaaacaaaacaaaaaaaacagtacaaagtgttcagtgccgtcagatgttctgaatatagtatgatgagaatgcagtggtgggggagaaggtggattagtttctgtggctgctgtaacaaactaccacaaacctagatgcttaaaactacacacatttactatcttaacagttctgggctgggtatggtagctcatgcctgtcatctgaacactttgggaggctgaggtgcaagaattgcttcagctcaggagttcgagaccagcctgggcaacatggcaagaccctgtctctctctaaaaaaaaaaaagccaggcatggtggtccacacctgtagtcccagctacttggaggctgaggtgggaggatcacttgagtccaggaggtcaagactgcagtgagccatgcgagtgctccagcctggatgacagaacaaaatcttgtctctataaaaagaaactggaaaaaaaaaaaagtagttctagaggtcataagttccaaatgggtcttattctgctaaaatcgaggcatctacagggtggtggtatttgctgaaggctcgagggttaagtttctggttttttgttttgttttgtgttttttgtttttgtttttgttttttttttgctttctcagtttctagaggctgcccatattccttagctcatggccccttcctccatctttaaagccagcactgcttgttcgagtctttttcacattgcatttcccctttcacattgaaagcactcttctgatgaaccacttctgttaaaaccactcttatgatccaagataatttacttttttaaaagatgaactgattagcagcctgaattccacctgtagccttcattcctccctgccatgcaacttaagttgttcatggtttctgggaatcaggatgtggacaccttgggtggggatggaccttaactctggctgccaccaatggcgcctggtcaaagtatcctgtaggatttattcttggaaacggcgttaaccccaacgccctactttgctggctgtgtaagaaacacgaggtcagtcaggcagtaagaggagcatggacttgttttctgaaacagcgacacaatccattacatattttcgaatgacgagatgagatcagacttctgctttaggaagagtcacagggttttgtggatttgcaggggaaacaggcggtcagagggagttctgtgtcaccgtccagaggctggggtgccaaggagggcagtggcagtgggcttgaagagatgcaatggggctgctttggggctgaggcgactggactggcgtctgattgatggaataccaggagagggatgggagagggaaagagatgagtccaggatgacagttggaaagtcctggacttcggagtaaagggtagcgattgaggagttaaagggtagaatcaggctggggagagcaaatttacttttgaaatagtgacctttggatgctggacagggagatatgaagcaggcagaggaaatatgggcatgaaatagagcttcagcattttctacaaagaagccaccacattcggtgacatgacaagggagtgatgccagagggaagagaggtacaagggcagaatgctggggaaatgcctgtgtttaatgggcgtggagaacccgcttaataaataatgagaatatattgctggactgaaacaaaagtcctcattagctcattaaatgtttcctggaattcccagtcaaatctgtgaaacaattttaatgctagatgttttgtaagtatttctccggaaatctggaaatttgtccacagacccccagacattgtttataaactgaagtcagttgactcaagtattttgcaaatgtctatggaccctagtgtgattaatagaaacacaaattattttaaaggtgtcactcaatttacagtcattctgtatttttgccatttggtattttttcctgaaacattacataataagaatgcagcatgctttctttatgtaggtgatctgtgaaactttttgacaattaaaaattggtttttggccaggcacagtggctcacacctgtaatcccagcacttcgggaggccgaggagggcagatcacccaaggtcaggagttagagactagcctggccaacatggcgaaaccctgcctctactaaaaatacaaaattagccgggcgtagtggtgcacacctgtaatcccagctacttgggaaggtgaggcaggagaattgcttgaacctgggaggtgcaggctgcagtgagccgagatcttgccgttgcactccagcctgggcaacaagagcgaaactccatctcaaaaaaaaaaggaaggaaaaaaaaatatatatatatatgtatataaaaattggtttttgctgtttgttgcggcatcacttgcagttacaaagaagtgaacatagtggttacagattgggttgtaaggctggacctggccgtatgatgggttactaggcacctgttaaaaatagtactgtggaagtggtatatttattggcatgtccatgtgtttacaatatattacaatggtgttactgtaatccccaggagaccagcagcccagctgggactctgagagctctaagatacgtccttggagtaaaccaagctgcaaggaggtctgttcacttctgtattgtttatccactcataaatttgatttacatagctggactttggtgttgtacagttatctcataatgagggttattttaagaagtgtctcaaggaaatgtgtcgtgtgtttactgaggatagcgttgtatgtagtccacaatttcctctttctgggagaaattttgcacatgtatcagaagtctaggagctgtgtttctgatatttgcatcttctttattgtttagatactgtgaatccagcatctaactatagttccttctttgaggtctaggaaacttggaattggattgacaattcccttccaagtgatttcaggttgtatccgactgcgaactttggataccgccttcctgtctcagcttcgtctcctttgtcctaccatgatcttctcttggccccagtttacccagtgaattactttatttttgctattttgtatgtgtttttggaagccacccccagttttttctcttcttttcctgggtggggagttagaagtgttgcagtggatgatggtgctgtggctttttggaggttggtttgcagtagcttttgagttctggtgtgttagtgtcatcttattctaatctagctgcttcctgttgaagtacatcaagacgaagtatatttctaaatttattacgatgaatactctatcaaaagcagctggtgcttaggccctaggtagagctttaagataaagttctttaatatcaatttagaaaaagaaagattcataatgattaatggagctcctgcatcactgaattttactggaataaaaaaaattagtgggcttaaagttacattgaatgtagtggaaattctttttcttatctccattactgttggggaacaatttcatctaaaccccattgaaaactgggccttatagccttcagtatacttcataacatttgttggaaagcaggaaatgaaaacgaagtatttgaagtaaaagttcttaaatgtgtcccaagaaatgaggattactgcagaaagaatggatcagttatttctcgaattataagaaggaaatatctgcagccttttttgtcatcagtgcagcagccccggtttttctgttaatcatagctggtaataatgccctccggtttatagttttgatgagccgggagctaggctgcgtgttttacatataatatctctgttccatcagctgcataacctagatatccttcaccccatttttatgagactcatgggttcttgtctgggaccatgcacctagtaactgacaagattgcaaactagttatgtcacctgtggagttccacgacaaaggcaattctaggcgatgtttatgtagtgttccttgcatgccagggggattctgtgctctttccatgtgtgaatgatagcatccacctgctaactttgttgggagggttcagttatcctctctgtacaggtgagaacaggaggtactgaggacatctggcccaaggatactaccgctggcacggggtggatggtgattcgccctcagtccctctggcgcagcatctgtgctgtttgctgccaggccagctgcatcccagatagagtgacaggatctgttcgcgtcacatccagaaaaggctctgaggccaagctccctgcgttgcttctcactttcactctggaatcagaggtgcgtgcctggaggacttagctctgcatggacagctggtaaggtgtcacagagggtgaggtgggccattgtagcagagagttgttaagagttggttacgtgggttttctcacagggtacaaggctgaggaatgggaaaccagttaggagaccttgctaatagcgtggaccaaagatggggagtaggtccagacagattccgcagtgttcatgcagtgttcatgaagcaggtgtagacagattgcggggccattcatgaaggtgatttgccggggctttttacggatggaaaaccccttttctgtgttcatcccacctcctgttgtcgacagatgacacctgcacaatcaggtcctcccaactccttccaccacccaaagtgaaatacgcaagtcccagagaactgtgtcattcttaccgaagtggctgatgtaggatgttagaaacatctcccaccccaagttgtgacaacctgaaacatccccagacattgctaactgcctcttggagggggcacagtcacccgctgttgggaacacaggcctaaaagcttggagccagggctgactgtctgtgtaggctagaacagaattcccaatgacccatcaccatgacatctgacactcaaaccgcaccccaccccgaccccccacaaccaccaccttttaaaaatttccatttttggaaaaggctggggcttagaagtcattatgaaggcacccatttccagaagggtaagaatcagaaagttggctaattcgggtctctgctttacaggagttccgcagcgtctttcagtagagtgaagctccagtatttgtatgagtgttggggttgtttggtggtgtggggtaatgcaggaggagagaattggggaactgttaaccaccacccaaacaggctatagagaagaatgccaggggactttactgtgatggagacaggagcgttgaagtctgaagagtgacatctgggttctctgtacgttctgatttcttctgctaggatgagtatagaaacatgttctctggggtgaaagtgaagccttgtgaaattcatacaggtgaagctgctgatagcagctcttcccgatggcatgaatatggaggtggcggttgaagcaagtttggtttgtgaatagaaatatacgtgttcatatgtatgtgtgcacgtatgtgtttgtgcatgtgtatgctttaggacccagttcttggattagctgattatttttttccctctctatagacattggtgacctaggttttcagatacttatgtaagtgaatagttgaatttgtttgagcatatttaattgctttcctgaagggatttgctggctgttttgttaaatgaaattgaagacagtactgttgacctttccaggtgaggagggagtcagaagtgttttgcaaatgatggaaactgaaacgtgagtaccaggaccatatgatgttcagaaacttttatcataactacagtgaataaataaagtgcttgacaattagatttaaaattaagcttcatcctcattgcaaaatgtggagacagtgctttgggacatgaggaagagattaattaggattcttttctacctcaagatgcgctatgtcatctctgaacaaaaaactgattggtattacgtgaggattatcttcataaagttcagagttgtatctacggggacagatttgaattgctgttaattgacaatttgctgaattggaaagatcatattaccttaatactttaatgtatcatctttaaatgtgattctttttctttctctcactaaagattagtttcatgccactaaataaaatttaatcttttgctgtaatttaaataataataagtgcttacaaacatattatgcagctgatagcttgttaaaatttcctgtgggcttgttttttgtttagaagtactgattttgccagttgtacaagcatgaaatattgtttatcaagcctcataagacattaaagaggaaatcaagtttgtgtgactttaatgtctctttttctccttatttcagtggctcatacttttaccctgaacttgtaaaatctacaagcttaataagattccatattttataggaactaatggatattcaatgacttgcctgaagagtagactaagaaaatgtatttctccatgaatctttacatagaaaaatgaaagatttttcctgaatatttatttctcaatatatacagcattaatatgtctgtttttcttcaaagcagaaaaaaaaaaaatcagtgattgcctttgggttttgatcttgctctgtatttgttttaagtacacacctattacatgcccactgtattctaggcactaagctctaatgaaaagtggtttccagtcattcgaatggaacaggaggctcatgtactttgaagtgggtatacagaacttttgcactttggttttattctactttctgtctatgtccttggcactagaatgcttggacgacagtttgctatatctgtggtatttatggaatgagtgaaacatgcaaggagaatgccctggctgccgttctggcttctgccctacccagagcatccagtatacagaagcagcgtttcttaccacagcttgcggaaagacacggggagtagtcggcttgccatataaggaagttgccttcagtggccttgttcattttaggtgttttttaatacttgcttctcttataatacatgttactgttccgtgaggaacctcagcagctcccctaaggggaaaaaaggaggagtacttgaaggagtactgtttatacttcaggggcaataaaatccatgtttatgcacaaagggacctttccacttgtgtgataaccattctacaaggcccttgagttcctgtgaggaaggaaggacgccataaggaatgaaatcacagaaccttattatgaaaatagtaatggtgggatttggaaattatactcaattttttcttctgaaaacaaattgaataccacctgagagttggtgctaaaggccctgattttcgtattttaaaaaatttttggcatagtctttggatttgtgctgtcctaatatggtagccaccagctgtacatgagtatttaagcttaactaagattaagtaaaatgtaaaattcagtttgtctcacactagccacattttgagtgctcagtagccacatgtggccagtggataccttattagacaaggaagatgtagtgcagaaagttttattggacagaagaacaatggttattcagatatttccctattgggaattccagggaagaaagggaaaacttaaatctgaagaagaaaaattttataccaagggactagggggcaatgcagaaaaattaaccacatcaaaacaatttactacatcaaagttcattgtcatgacatattagaacattagcataaaggaagtatctatgcacttcccggatttaaaaaagagtcacacgaaggatcttggaatcagaatgacattgtatttcttaacagcaacacgtgaagttagaaaacagactgaacatagacttctttgaaaataattttccctcagaattttgaaggtgttcctccactaattattaattaaggatagaataaagatgtttgggccgggcgtggtggctcatgcctgtaatcccagcactttgggagtctaaggcaggtggatcacttgaggtcaggagttcaagaccagcctggccaacacggtgaaacctcgtctctactgaaaatactttcacatgtcacttctaggaaacttatggagaatatgtcccaccaaagtgagggagtaaaccaagaaagggggaggtttgggatcttggaaacagaaagaggcagaaggaattctcaaacaaaggtgttttcagggcagtggctcttgtagtacagactagagcaggagacaaattttaggaggaggccaggcgagatggctcactcctgtaatcccagcactttgggggggcccaggtggacagatcacaaggtcaagagattgagaccatcctggccaacatggtgaaacctcgtctctactaaaaatacaaaaattagctgggcgtggtggcgcgtgcctgttgtcccagctacttgggaggctgaggcaggagaatcgcttgaacccaggaggtggagcttgccgtgagccaagatcgcgccactgcactccagcctggtgacagagcaagactctgtctcaaaaaaaaaaaaagaaattttaggagaaagtttggtgttagtgtattggtcgaaggtgggagggatgtgggtgggtgttgcgggaggaagggcatggaactgacaaattatccaagagttttgatcatgtaaaaaatgtaatagattgttggagagtgtgggaaggattatcaaagagtacaaagaaaactgaaatgaaaacagaggcaaataataattctaggagaacacaaaaagtatactaaaaaaaaatcataggctgggtgcggtggctcacgcctgtaatcccagcactttgggaggccgaggcgggcgggtcacgaggtcaggagatcgagaccatcctggctaacacggtgaaaccccgtctctactaaaaatacaaaaaaaattagccgggcgtggtgttgggcacctgtagtcccagctactcgggaggctgaagcaggagaatggcgtgaacccgggaggtggagcttgcagtgagccaagatggcgccactgcactccagcctgggtggcagagcgagactccgtctcaaaaaaaaaaaaaaaaaaaaaatcataatcatactatattgcccactcagcagtgcccattccattgtcaaagtaatatatgtgaaatattgatttagctgaaaaaaaaagttatatgagctatcgaaaacgtggaagggtcagtgtaagattggtggtgggaatgtaaaaaaccaacaatccttacctatgtgtgtgaaaatcagtaagtgatatctaaacttgatgtattgattagagtatcacaaacagactatttagaaacatggaagtctggccaggcatggtggcttatgcctgtaattacaacacttcgggaggccgaagcgggaacgtcactagagccccggtgtttgagaccagcctgggcagcatagcgtgaccctttctctaccaaaaaatttaaagcattagccaggcatggtggtgtgctcctgtggtcccagccactggagaggctgagacaggaggatcacttgagtcctggaggtcaaggctgcagtgagtcgtgatggtgccactgcactccagcctgggtgacagtgagaccctgtcccaaaaacaaaaaacaaaaacaacaacaaaaaaacaaacttggaagtcactatgcagggaacagcaccaataacagaaacagctccaagaaagtggttgctttgggaagtggaattggtgatagatggtgctaaaaggcatgtaattaataaaaggagccttttgcctcacctgcattttaaaaaaaattttgtacatgtattactttgtaaagactaaaagtggtttggaaagtgaaagtataggatatactatctgtataattacagacattttggcatagttaaaagcagggtttcacaaccttggcattgattgacgtttgtgtcaaataattctctttgttaagaggacctgtcctgtgtgttgtgggatgttccgcagcatctctggcctccacccactggatgccagtggcattcctccgccagtcctgacaaataacagtatctctagacattgcccaatgtttcctgggggtcaaaattacctgtaagaaccacttgttttgaaggatttttaaatatgtcattgaataaacctcaatatataaccctgctgtttgatattggtaatacaggaaacaccagcttccttacacagaccttgaaccctggagcaaatgaagcggtttggaatcctctggcactggaacacccgcaatgctcatgctggtgcatgtattagtcagcgtctggctcttggcccggttaattcagagctcactaaaaacagaaaagggatcaggaggaaactgcagcttctctgtcatgcttagtggcttctgaaaacatattttagatttttcatgttgctttcatgatggtacaacttgaatttctctggagttgaaatgttaatcattatggcaaaaatattgcaccctttggatgcattccagtgctcaggtggctgcggacagatcctctctgtctctctgcttccctccacaattcttttgcaagttcttagttaagttattgtcaagtgtttttccctagaattgacacaggaagtcaacaggaaaatggtatctcagattttttgatgtggatgaaacctcataaatagtttaaaaccctcatttcacagctgaggaaactctggtgcagagagggttttttacaattaattgggagcacaatggggcctggaactctgttcttctgttttactctttccttttaaaatacaacatgtgtgcccagtaatgctggaggaggatgatagaacgggctggggaagggctagggcatctggcgggtcatgggagtttgtcaggattttcgcactgttagaagttctcagcatcctctgccaggggcgtgtacccttagtaagcttagagaaaatggcacagagaggcaggaagtgtagtttccatgatctttccaggaggtgctcctgtacctcagttcctgatggcccagaactgggtggagagtgtaggctggtgcattggcgtgtctgacagggaagaccctggcctccttatcttgcagctcttgctaccagggcactcatggagccagcgtgcaccgccactgcagctgttcttgaagaagtggccagaagagtgaaattggcccgttgaggaagggtgtggagctgcttctctgtgggtccctgcatgacttccctgttccttcccctgggatcaaccttcctcaccccacatggttcagcagatgagggttaagtctgccccagcttgggggacgctggtgtcccactcaaaccggttgtccagtattttggtgctgcaccaggagagtgccatctgcagtctgcagggctgtcttgcccaggtggccccttcttccctcggatggatggggcatactgttctgaccaccatgtctccttccaggccacatcctctttcgtgagcactgtgagggcatcaccccacatttttagaaacctcagcgccccatcttgcccccatcccttgcctttggcaccacttaaactacagcctcattctcttcctcctcgcctgagttctccagccaactcaagtgccacctcctccatgaagcccctgtaggtttcctccactgggacaaggacgcgcagagatgaaaggcagagaagtccagccctgggacttccaggccgtcagttcaatcctttgagcctctgtctcctcctctgtgcagtggggcagttcagtgctcccccttagtgctgtggcacgctgcgttgattggcctgggtgctgttgcggatgcccagcgagttctctgtctccctcctggttcttgtcccactccctgctccctgttacagcctggaagtggttggacggtttcccctgggagtcttgagaacccccaaagacgccatgcatcttcttgtcctcttttcgtggcatgttctgtgttgtgtgtgtgtgtctgtgcaacgtgctgtggcattatgtgtgtctgtgtttgtggcgtgttgtgttgcatgtgtctgtctgtactgtgtgtgttgtgtgtgttgtgtgtctctggcgggctgtgtatgttgtgtgtgtctgtgcacgtgctgtgcggcatgctgtgtatgttgtatatgtctctggtgggctgtgtatgttgtgtgtggctgtgtattttgtgtgtctgtgtggctatatgcggcgtgctgtgcatgtcgtgtctatctgcaccgtggtttgtgtgttgtgtctatctgcgtggtgtactgtgtgtgttgtgtctatctgtgcagtgtgtctgtgtggtgtgctctgtgtatgttgtgtctatctgtgcagtgtgctgtgtgtgtgtgtgtgtggtgtgctgtatgtctgtctgtgcaaggtgctatgtgtatgtcgtgtctgtgcagtgtgctgtgtgtgtgtctgatgtgctgtgtgtgttgtgtctatctgcagtgtgctgtgtgtgtgtctgtgttgtgtgctgtttgtgttgtctctatctgtgcagtgtgctgtgtgtatgtctgtctggtgtgctctctgtatgttgtgtctatctgtgcagtgtgctgtgcgtggctgtgtggtgtgctatgtgtgttgtgtccgtctgtgcaccttgctgtgcatgttgtctatctgtgcaccttgctgtttgtgttgtgtctctctgcacggtgcactgtgtgtgttgtgtctatctgtgcagtgtgctctgtgcggtgtgctgtgtgtgtgtctgtgcagtgtgctctttgtgtgtgtgtggtgtgctgtatgtgtgtgtctatctgtgctgtgtgtgtctggtgtgctgtgtgtgtgtctctgcagtgtactgtgtgtgtgtggagtgctgtgtgcgttgtgtctatctgcagtgtgctgtgtgtgtggtatgctatgtgtgttgtgtctatctgtgcagtgtactgtgtgtgtgtgatgtgctgtctttgtggtgtctgcagtgtgctgtgtgtgtgtggtgtgctgtgtgtgtgtctatctgtgcagtatctgtgcaatgtgttgtgtgtgtgtggtgtgctgtgtgtgttgtgtctatctgtgcagtgtgctgtgtgtgtgtgtgtggtgtgctgtgtgtgcacgtgtgtggtgtgctgtgtgtctgtgtggtgtactgtgtgtgtgtctatttgtgtaccgtgctgtgtgtgtgttacatgtcctgagctcacgccttctgttttcacatttgactgtgattactgtcctttttgagatctgagtaacagggacagggctgggcccgatgacttaggcctgtagtcccagcacttgaggatcatttgagcccaggagttggaggctgcagtgagctgtgatcgcgccactgcactccagcctaggtgacagagtgagaccctggctcaagaaacaagaccaaacgaaacaggaatgggtggccagttctgccacttcctttttatttgtgaaatctaagcacatacataatccaggtagttgtcacggaaaggggccataactcaagagaagtggtgccctggagcctaaaggctttcccattaggataaattagaactggaaattgtcataaagacaatgcagggtttgtggatttcagctggatgagtaaagaccagcctgggcgtgaaggattttcatagtcagttgctaaaggtggtgccccaggaaggctatttggcaggcgtggggcgcagtcctggcatggggtgggatggggctggaggtgctgctaatctatcttattaaaacccaggaagtttcacaggcgccttccaaaccacagctcgttgatttaaagatgtgaattccacgtgtgtaagccaacagaacaattgcgttttgtggtctctggctgatgaaaagtccctgatgaagtgctgtttggtaaaacgattcctctccattttcctcccttccaatctgtggttcacatttattcaacgttcttttctttcaaacagcatttgtgtgtagccaacacacatgcatatggagtgctgcgaagtctctgtgcattatctggaaacctgctttctccagaaaagctgactatccacttcccgtgctctcaagcccaagagacaggaatgggacgtggggagcgcgtaccctcttctcaacaagcaggttgaaaatccagtgaatttctttatgatggaatttgaatcacgtggacattcattagaatatttgggcaggattaagcccttaaaactggctctagattatggttataaaatggcctcaaaggaccctgaaactaatgaaagaattcttccatttctgacatgcttcactccctctggctctggctcttatcccaaatcaaagaatgttggtttttttagtgtttcctttataaacaaggatggtttccagattttttttttctttttgtttttttttttttttttgagatggagtcttgctctgtcacccaggctggagtgcagtggcgccatctcggctcactgcaagctctgccttctgggttcacaccattctcctgcctcagcctcccaagtagctgggactacaggcccccgccaccatgcccagctaattttttgtagttttagtagagacggggtttcaccatgtcagccaggatggtctagatctcctgacctcgtgatctgcccgcctcggcctcccaaagtgctcggattacaggcgtgagccaccgcgcccggcccaaagtgactcttatactccattataattatgaatttggaaaacaataaggatattatatgagtctgctcaggctgctgtaaccaaagaccacaggctgtgtggcttaaacaatagaaatttcttttctcacaattctggaggctggaagtccaagatcaaggtgccaggaaactcagtttctggggaggcctctcctcctggcttgcagatggccgccttcttgctgtgtcctcacacggcctttcctcggagcgtctgtgtatgggtggggtggaggggcaagcagagagcttgcacacttcgacaatatgaccatctatcataggcatcaatttagtttaacttcatttcatttacagggtgttaaaaaggaaaatcatctgcataatttgagctttttcatagtgagttctgaatctaatttattttgagttattacagaagtctgcggatatcccaccttaagatagccatatgcacaattagtcatttcttaagggatcccccaatgtgaaaagaattccccgagaaaagacgacctgaaagatcttggcctttacataagtgtacacagaattatttttattgtgataaaatatacataacataaaacttactatcttacacagtttaactgtacagtttagtggcattaagtacactcacgttactgtgcaggcatcatcaccatccttctctaggactttcccagctttccaagctgaaactctgtcctcattaaacatgagctttccattccttctctccccaccaaccacctggcacccactgttctactttctgtctctgtgaacttgatgactctggatacctcccgtaagtggaatcctacaggatttgtcccttttgtaactggcttatttcacttggtagaatgtcctcaagattcatctgtattgtagcatgtgacataatttccttcctttttaaagctgaataatattcccttgtgtgtatagaccacattttgtttatccattcatgcatcgatggacagttgggttgtttacaaggaattattttaaagccgaatccagggtggctggcttgtgactactatttagatgcagacagtgattccaggtggtgcgtggtgaaatcatgtcacacccccgcggaaaactccacagctttcctcatgtgccctttccatcacttctctgctgctttaggaactacttttcttctgaggtgacctctttctgttcctttcagtttttaaaggaaagaatagtagaagtattaaaagcagcagcagaagtccacatgttaaccctgtgccagcccacatccccttgtgatctctggcagtggggtctcttctgctagcttctcccgagcttcctgccaaaaccctgtagccggccttcgccatgtccctgaatttgcttttctttttccaccctctacaaccttcctttcctgcagaagtataaactttcaatccgtgtgtataaactttggggacacttcgcaatcagcatgatgaagttttatttttatgtgaaaactcttgatgattctgaaattgtggtgtctgtaacttaaacatcatctacaaaatcactgctctatctttggatgtgagtttgttctagcatgttatcacagtaccgaattccaaagaaactgctgtttacttaccaagggtaggctttcaactcagatgagtttatgactttatttacatggaatagtcaaaatggacttctgacatttgctgcaaagtaggacaacttaattgatattgatggatctactcatttattcagcagataacaaagcccttccgattgcaggtgttgtggagagagcaggatattcatttgctagggttgccataacaaagtttgatttgatttttggttggggatggaaactgtgtaggaggcaagcgtggagcttgatgtgagctccttgaaataatgaaaaaccagttacaaaatctgtattacctgtagcagtacacattctcccaaagcattctgttggcattttaaagtcctttaaaacacacagctgctttctgttgcttcaaactaaataaggcattatcttcacttttccttttgttaacctaaagaaaaaccttcatttgtaaagcaaatcatcacagcaggaggattttctggtttatgcactagggtgcatttaatctttattttacactgctgattaactttatgattcaaattttaacttatagtttctttttaaattaattacattattgggtgctttcatgtttttgctaaaagccttcctattagaagcactacaattgacagtgatggactgacctttaatatttttttgttatgtgaccagtgtttggtttataaaaatttttctctaaaacaccaacttttggctgcaaataccaccttttcacttgggttcttttcatagtgtttatttacatgggatattgtcactttgcacgctgtagctatttgtctttgtcagcaaatgtaggtaaaatattaatcttgtatgaaattcagataagcagggaacagatggatttatggtgcttgaaacctctgaactctgcagctgtggcaagttgttgaactgtaaataaattctggacggtggctagcaggggctggcgtgacctcatttgccccacaatacctcaccgtgccagggatgcatttcctgccctgtgccacctgtggtttggtcctagtgctttggggccgcagagtggagctgggctccctttgaggaagtcatcagtgctgagagccctcctcacgggtgagagtccagtgggatgtgtctgagcagcctacgctgggcatgggccggggcacgctgtgtcccaagcatgctttaggggtcccagtggcaaaagcacatttgtggttgtttaatctctggaggtggaggatagccccagctcctgggtcagtcagctggcggaacagggtaggccaggggagacagcactccaccctgctgggcatcttattaaatgcagcccagtatattcaatgccggcatcactacttcatgggaaaggatgcagcgcttacagcaggtagtggggtagagtggctgtgtggggattttcaaaatggaggctaaagtgatgcactttggactcgctggaaagtgcctggacctctggtgagttcagcctgggaggtcagagcaccacaaaatttgcttgctgtggctgggtgcagtggctcacatctgtagtcctagcaggagctcagtagtccaagctcaggagtccgagaccagcctgggcaacatcctgtctccaccaaaacaaaaccaaaaacaaaaccaaactggcttggtgtggtagtgtgtgcctgtagtcccagctactcaggaggctgaggcaggaggattgcttgagcctaagagttcgaggctacaagtgagccatgatcataccactgcacttgagcctgggtgacagagtgagaccctgtctcaaatgaaaaaaaaaaaaaaaaaaaaaaaaagtacttgttgcctggccacaggaaggtctgtgtgttggtttgtttaccttcccgaacctttgctggggagactttttatgcccccatatgccccagattcactaacaagaaggaagtgttctgttctgtgtaggatgtgcagaaacagccttgaaaatgttaccaatcaccgaccttctgaaacgagcttctgtggatactgggaaagcactgggacaccattcccctcactcctgcctctgcttccccagggtggaactggcctgtgcttgatggtgccagctgtcataaagaagtcattgagcatccctgcatttgcactgtgtacccagcaccatggagggatagccactttagccaaagcagtttttcagctttactgagatgtaatttacataccttcagactccctccgagggtgtttttttgtgtattcgcagagttgtgcaatcatcactatctgagtttagaacatgttcagtaccccatgcccactgtattagtctgttttcacgctgctataaggaactacctgagactgggtaatttataaagaaaagaggttgaattgactcccagttctgcatggctggggaggcctcaggaaacttgcagtcatggcagaaggcgaagaggaggcaagacacatcttaccacagcaaggcaggagagagagtgagaggggaagcgccatacttctaaaccattagatctcgtgagaactcactcgccatcacaagaacagcatgggggaaacccgcccccatgacccaatcacctccaccaggtccctcccctgacgtgtggggattacagttcgacatgagatttgggtggggattcagagccaaaccatatcacccatcagcagtcacttcccattcttccctccctgtcccaaccggtgcaaccagcaatttactttctgcccctatgcatttccctattctgacatttcaggtaaatactcacaacatagggacttttgtgttctcatttcactgagcattgtgttttcagggttcactcatgttgtcccctgtgtcggtgcttcgttccttttcatagccagattatactatctgttcatcagttggcgggcgtttgggctgcctccactgtttggcgattgtgaatagtgttgttgtgaacatttaagcacacgtttttgtgtggatgtatgcaaagtcattttttttgaaagccacttactacacgattggctaacttccatcagagaaatgttgtttggtggagttaaaaacagattatctgtgtactatattaagttgggtgaggaatgatgaagtgtaaattatacttacataaatattataatgctgtgcagaaactcttaagctatcattcttttagaaaatgaattttatgagcttgggacctttttgttaaccaatctgagaaaagtctgttgtcagtgtggacatattttacctttaaatggaggaggggagagaatctttcaaaaacattaatatcagtgagattaatactaatctgtcaagatgacccagtgaacagttggctatcaaagtattataagaaggtttttaaaaggaaagtgtctattttgtaaagatcttgagtaaattatgcttttaagtatgttttgatattcccccccctcctcccaaagtgtagcatgcctgagcgctgtcatgtttaggaggtgatgggttggggttagagggtgattgactgttagcgaagtgggttgggatgaacaagtgcacttgagtacgcgctgcacagtgtaggcatcaggccacgtcagtgtgtctctgcatttgggcagatgccaggcctattgcaggcagcataacatctaggaacgggtttatggatgaacctgggtaactctgggagcacaaacccagaccacacccatcgggagagattgacctgagtgatgcgctaacgcatatcattgagatggggccagatatcttgcttagatgaataattggagttcatgtcaaccatctgtcctttcccataatttaaagccaacttctatattttccaggttcatactttttttttcattaattgcatgtaaagttgcggtgaacaccttctttcttgacttcctgtttaaaaaaattacagttcttaaaattataagcttattcaggatggagtggtcagtttgtagaaaaactagctctttagatcttttaaaagcactacattaaaaaaaaaaaaaaaaaaaaacatcggacgtggtgggtcacacctgtaatcccagcactttgggagtccaaggtgggaggatcgcttgagcccaggagtttgagaccagcctgggcaacatggtgaggccccatttctacataaaattttaaaaattagccgggagtggtggagtgcacctgtagtcttagctacttgggaggctgaggtgggagggttgcttgagcctgggagttcaaggttgcagtaagccgtaattgcaccattgcactccatcctggatgacagagcgagactctgcctcaaaaaacaaacaaacaaaaacaaacccagagaaactcaaaaaccaaaaaagaggtatccttattttcccaggcctcaatgatgaaatgtgcccagtgttcatttgaatctgcccatcaattagtcttttcctgatgtctcagagaagcatgcatgatgtacggaatgtcttgggtgacctagagcggcatccccaataggactgccctgtgaacatggccccacattcggctcttgggcacttaaaagatgtggccattgtgactgagaaactgaattgtgaatgttatttaattttcacgtgtttaagatgtggccagagcagacagatgaacagtctggcttgatggataactgcagggagtttcacgatgctggtaggaggcacagtgagcttctggaagagccggccccacctaggcctgattttggtggctgctcaaaaccgctggtactgaattcctttagaatagtgcttctcaaagcgggtgactttgtatcctccccaccctccaggggccatctcacaatgtctggagacatttttggtggtgacagtgggtgcttctggcatctggtgagtagaggccagggacactgctcaacatcccacagtgcacaggacggcctcataacaaggaatcatctagccccatatgcgccacgatggaggagccctgctttctattccgaagaccagcagtcctaagatacgatgtggacagcacagacccagttttctaagtgaagagataaggcttgagcaggcagcagcctggtaatgccaaggccaggacagttagccaagtgtctgagtccatggagcttctcgggcagtgttctcttttctcttcagctattccagtttgtattaagtgtaagaatatgaagttgatgtttgtcgtgagtcaagacggtgacacagaagcagtctttcgtgctttggtctaatagctttattgttaaaggagagaaacagaaaactcctctttgcctctgcagttttctctgaaattgaatttagggaaagctgaccctagaccatgcgtgccctttccaccagcatcgctgtgggttccactcgtgggagatcgataaggaagtggggatgaccacgctgcacagaagtgttctcatcacttttgcgcttgcttatttaacccatgattgttagaaagcgtttagaaagttggtctttgcaaaccagccctgttaagtgctgagatgaaattcttaactttttttttccttcttagagataaggcctcactctgtctcccacgctggagtgcagtggcgcaatcaaagctgactgcagcctccacctcctggactcaagcagtccccccacctcagcctcccaaattcttaaaaatgctaacagtaaccctcacacacaaaaagtgctgccgttagagatggcactggtattgagaagcacgtgctgtcagtgttgcaattggtaatgcacaccacacttgggcatagaaattggaaatccaactgcgccaagctggagcctgcagaaaggagcacgaggagacgggacagcaatagagctctgtcgacggcgctaagtagaaccagacgctgcaataagacaagcgtccccctgtgctcagtacaaatgggttgcctgtggcagatgcaggggtggctttggcagagagacggctcctggcatcgtggaattgaattggctgtttcttttaaagatactgcaaattgcggcagcatttatcatcctaaggaagcccgcacagcttgccaaacagataatattgatgatgataacaacaatgataaaaggaaaccatgatgcctctactcaatgaaaatcacttttatcttatttgcaaaagtcagaggtaggacagatgtgtcagcgtcttaataagacagttattcaaggagttaaattgaaattattcacatacccaaaataagctatttggcaaacctggagacccaggggcctttggatctatcttagtgtaaaatttcttgaagcagagacctagtaggtactctgttgcttatggttccaggcaatgtattgttttttcttccccctaaatatctgtgaatgtgtgaagtaccctgtgtgccagagatggaaagtaaaaccacagaagcggggtgcggggagatggcagctaaattccttttcagcagagttgaagcatcttgttgtaagagtctagctccacaacagtgggatgcaggaaactgtaacagctgaaatacccaacagatgtattcaccatcagtgcattgggaaaccctctcaaaagtgtcatcacaaatgatgatcttaacttttgtatgacaggatctttaggtcacccaacagtaggtgcacagtttctatgatttcaatttttaccacttctggagacttgtcttcccatttcttgtatcagtgccttactgatagagttggaaattggaaccaaagtaattagattggctctccagatctcttacatgagccaagaaaggattcaaaagcatgccctgtttccttcttgacaggctgggagaggaagtgaccgggaagtgaattgctaagatgtggtcgtcattttcctttacaccacagagcctctgcgtttgggaactgcaggttcatccgagtcaatgtcagaagtgccttgtgtctactgtagtgaacatcctttgtttccatcgggtcctgtgggaagcagcactgcttattgggtggtttgagggtgaatgctattttacaacttgtgacccccttgacacactaccttttcattttagcatggagcacagagccatttctcccctgtgctggattttgaatgttctttcaaccaccgtgatagaatgtccaagaaaggaacaaaggaagaggcaactaagggaatctttcagtgggttcataagccatgctgctcctggctttgacaggagttaaaatcatgggtatccctaaaccactatcattattggagttgctgttactgtcgacgtaaagagtcaaactctgtaaaatatttgaagagatttattctgagccaactctgagtggccatggcctgtgacacagccctcaggagatcctgagtacatgtgcccaaggtggtgggggcacaacttggttttatacattttagggagaacacagcttggttttatatgtgaacccccaaaatctgagacgggtctcaatcaatttaggaagtttattttgccaaagttaaggatgcgcacccatgacacaacctcaggaggtcctgacgatgtgcccaaggtggtccaagcacagcttggttttatacattttagggagacatgaaacatcaatcagtatatgtaggatgaacattggtttggtctggaaaggcgggacaactcaaagtggggagggggctcccaggtcataggtagacaagggacaaatagttgtattcttacgagtttctgattagcgtctccaaaggaggccatcagatatgcatctatatcagtgagcagaggcctgtcgttgaatagaaggggaggcaggtttgctctgagcagttcccagctggattttccctttaacttagtgatttgggagccccaagatttattttcctttcacatacacatttgagggagacatgaggcattgatcagacacatttaaggtagacattggttcagtccagaaaggtgggacaacttgaagcaagggtgcagggggaagggggggtgctttcaggttataggtagatttaaaatttttttgataggccattggttgaaagagtcattaccaatagaaaggaatgtctgggctaccttaagaggttgtggtgaccagtgttttatcctgcagatgtagcctccaggtagcaggcttcagagggaacagattgtaaatgtttcttatcagacttgaggtctgtgatgatgttcgtgctggaggggcttaatgaggcatgcttgacccccacttcccggcagtcatggcctggtccgtctttcaggataaatttagttggccttggcccagaggaggaagtccattcaggtgcttggggggctttcgaatgttattgttggtttacattatgattgtcattgttattaaaaaactaagggctgtagagaaatggttgcagcatccatcatgtgtccctaggaattgcacatagctaagtgagaacctcacagaaccctttcacgtgcagcccgatgctgtcactgttcataaacaattgtattttgccttcctgaaaggccatctgagttcattaaacttgcatgcttccatatctatacattcttttctcatggcctctttgtggatggtttgttttaccatttgttgtccatcagcttgaatggtagggggaagagttcacaccgtgccccctgtgtagcagaatagcccacagttcaggcatggctctccagcaaggagctttctagggctctgatgctcaccagtggggggattgggcacccctccgcaactgccaggggacattgacaatgtctggagacattttgggttgtctcagtagctgtgtgggggatgctgttggctagtgggtggagccctgggatgctgctaacatcccaccatgcacagtacagccccaacagccaagagtgatggctcacaaatgccaacataagaaacccattctagggtacctttcatttgcttagtgctgcgagaaggtttatctgccaaagatcatcatcttggagagggccaagatcctgtatcctgtactggacagatatgcaggcattcaaattctgaaacgccgttggaaacatgaggctcggatcacagaagcctcctgtacatagagcaaatgagagctggaggcctgctgcccagcccagctgagtcctgtttcttatttcggttttcctttagattccaccgaagtttctctgaagaatgctgactcaggctgccccttttattccatttctttgcagggcagtttaggtgaagctggaacacagtgttccctgaggaagcattaggacaattagaccctgcctttgctaaatgaatgtatcaagaaccttcaacgtctttacaagaagcaggataaccattttgcagagtactgtgcttagtagcagagcatggcttctgttacacagtttcagtattgcaaaggtccccagccagtacagtcccacccttaattactgcttcagagctgcaagttaacgtttaaagtgttttcacagtagcttgaagtgtgatctcccatattacggtcatatccttggacttagcccatgttacataaattagatctttataagcagcacacttctttgcaagcaatttgcttccctttgggaatctgattccatagaaaacagtagtattttaaacatgttgattctagtacttacagttctattcacgtgctcctggtatagtacatctaataagaaagaatcccttatttttacttttatccaaatgcatgtatgttctttcagcatgagatataatttgtctgatcaagtatatagggagatgagattaagaattaagatttgtttcaagatatgagattaagaattaagatttatttcaagaaactcaattgcatggttgctcgcataagccactatgcagtggcagctttaatgaatggggttccaatgttttccttactgttttcaagaaggtagtgaataaaattagatgttaaagcgaattgcattgtgtgaagattgggacagatgccacatatatagttcagatgcttgcctgccagtccctgagatatactcttagcttgttaatatggaaattgtcaaacatattcagaagtatacagaatatcttggtatattcctgtgtattcttcactcatctccagccactgttagcgtgtcacgagcttgtctcatcgtcccctcactgttttctctttagagtaatttaaagcagatctcagacatcatgtgatttttacctataaacatttcaagttgtatccctaatatagaaggatttttttatgatactattattctgtaattgtttcctgtttgccttaacgaaaagaccacagactaggtggcttaaaatagcagagatgtattgtgtcattgttgaggaggtcagcagggtggtcaggcggcagcagggtggcttccttttggaggctccaagggagagccccttctgtgtctgtcctccaggttctggtgcctgcaggtgccccttggcctgtggctgcataacgccaatctctgtctgttaggaggacactgtgtttagagcccatgcaataacccagaatacctcatctcaggattcttaatttaattacatctgcagtgacccttttttcccaaatgaggtcacattcagtcttttactatataaggtcatattcacagagtccagggatcaggttgtgtacttaatcctgtttctttcgtgctcatgggaatgtatgagttaggggaatacagattatctttgtgttgtagggttttcttaagattatgatttattgaaaaagaaggtcaatggcatataaaggaaaatgtcattgataaatataaaaagaaatgcaagttttttaggccaagcagaatgcttataggagccagtgtcttggattaaaattatatgtgaacctcaagtgttatcatctataaagtgaaggtagccgtgaattacctcttagattgttgtgaagataaaaatgaatacagcattaacacagtatataaatgctaagcatttagtaattatagttcgcctctttttttctggaggctcaaagttgattgtaaatgtcaaaccaagaaataatactaggtactagcaacacataatgcaaaggaatgattcctgtgatacatgaagaactcctataaagtactaaggaggatgaccagcagcaggccatgagaaaaatgaaaaaagacatgaacagttttcttaaagggaaataatgaatagctctaaaatgtatggaatgaagctcaatctccctcatgacatggggaatgcagatgaaaagtgtaaggtaccatttcacctttcccattagtagaggtcagaggtgtgactgtgttccgctggcaggagctcaaataaaagcgggtgttgttgctggcaggcattgcaagaggtccagcctctttggggagcagattggcaaaagatatctgacctagaattgtcacttcttgggatttagctcatggacatagtgtaaatatatgcaaagaagtactcacatgatattcaccaaaggcattgtaaaagcagaaggatgaaagcaaccacccacagtgaacgtgttagattataataaaggcatagaatctatcaaacaataggaaaaaaagcataattctgtatatggaatgaactccacatgacgctcttgcatgtaaaaagcaagacagatacctgattgtgagtagagtttaatacaagttctatgtcaaagtgggaggagctatatgggctggtctaggtagaatatttctggaaggaaataccaaaaattggacttccctgttggggagaggtggattttagagatggggtagtagcagcttctcaaaaaccaagagaaagcttcgcatttacaatgggattattggaagcaataggaaacacccatttttgtaaaatctgtgagaatgtgtatacttggtaaaagtatagatattcagccattaaaaggaatgaagtattcatatatgctacattgtgagaattgaggatatgctacattgaaagaaaccagccacaaaagactgtataaggttccatttgtggaaaatactcagaaaaccttgggggaggaggggacaggaagtgtctgtttagtgggtattagatctcctttggaggagaggaaaatgttttggaattagatacagaggtggcggtgattgtataacattgtgaatgcccccaaatgccactaaattgtacacttgaaaatggttaattttatgtcgtgaatgttacttcaatttttaaaaaaatccaactgcaaggagagaagattctctagggaatggcttgtcaaagcatccatgtcaaagggaccatttaaaaatttccagtctgaggtgggtgcctttgtgaaaagcaattaaaatgtataactagaagagcaatcatgtctcagacaccaacgcaagcacaacttgccctaagttttctaagcacttcttacctcattcattcatcaccagagacagacagttcccaggccagaatccgcacctggatgcaacttttaatacatggatctagagttgtgttcttccagctctagaagagctccatgccacccccctcccctcccccccccgccacagcttgtcagaaatgcagatcacaggccgtctctaggtctgctgaatgagaatttgcattttagtaagctgcctaggcagctcagaagcacattaaagtttgagagggtaatttggggacagtaaagtgcagtcggaggaggatggttttgtggccctttggactggtcacttaatgactgtgaccctgggcaagggactgggttcgttccctaggctcctgtaacagagtgccacagactggtggcttaccgtatagaaacaaatgctctgcagctccagaggccacaggtctgaaactgtggtgttgtggggttggcacctgttccaggcctctcttcttggcttgtagaaggctgtcttcatgttcacatgaccttctgcctatgtgcagttctgtatccaaattccccaccttaatgacatcatcttcactaattacatgtacggcgaccttatgtccaagtcaggtcacattctgaggtactgggcgctaggactttaacatgtgaattttaggggaacacagttgaacccgtagcagtacttaacctttctaatcctcaatttcgtcatcttaaaaatgagtaaactacacattaatgtgggtaccatcaaaaaaacaaaaaaaccaacccaaaaaatagtaagtgttggcagggatgtggagaaattggaactcttatgcactattggaaggatcataaacaggtaaacactatagactatagttcagcagtttcttaaaactagaattatcagatgatccagcaaatccacttttgggtatacatccaaaagaattgaaatcagaatctcaaagagacacttacacactcaggtttagagcagcgttatttatattaaccaagaggtggaaacagcccacatgtccctcagcagatgactggataaacaaaatgtggcctgtccacacaatggaatagtattcggccttgaaaaggaaggaaatcctatcacatgccgcaattttgtatgaaacttgtggacattatgttaagtgaaataagccagtcacagaagagaaatactgtataatcccactttcatgaggtatctaaagtacacaaattcgtagagacagaaagtagaatggcagttgccaggggctgggggaggtgaaatggggaattgttgaatgggcatagagttggagttttgcaagataaagagagttctggagattggttgcacagcattgtgaatttaacactgttgaactgtgtacttaaaaatggttaagaggctggatgttttgggtcacacctgtagttccagggctatgggaggctcaggtgggaggatggcttgaggccaggaattcaagaccagcctgggcaacatagtgagaccccatcttttacaaaaaattaaaattagccaggcatggtactgcatgcctttagtcccagctacttgagaggctaaggcaggaggatcgtttgagcccaggaggtcaaggctgcagtgagctatgatcacacagttgcactccagcctgggtgacagagcaagattctatctcaaaaaaataaataaataaaagatggagaggagcgttacttttttgtgtgcaggaacgattgctgactgcagagcctggctggctaaaattagatttgccttgtcagtataataattgtaggtatttttggagggaaggatgcctggagcccggctgggttatttccgcccttggagtgagccagggcagcttagagggctacccgcgtgcagccctggaaggtaccgaaggagccctggaggcaccgagcgctggaggcctcatccctgagcaggttgccctccttctggtcggatggcagggcggaaacccatctgtgtcgggagtgagagctgtctgctgtccgcggcttgcgcttggagcttttcctgcagtccagggagagcagaggaggccagtgacttccatgaaaacacccccagtggtggggagggaggcggcatcccttggaggtagggatggggcccctgctgtgacccattagaggcaaagaagggcttggaagtttcattttgtcttacatgagtgtgtgtgccgagttcacattatttgcacatctgtgtttgtttttatataatgataaggacatcagtttccattgataaactataaggaagatgtgccatgtttaccagggccagagtgaagagactgaggtgcttgctttgggagaaaaatttgagggggtgacaaacaccacagacatcaagataaattatctgtgtgtattttaatagctttattgagatgctgtgcacagccatacaattcacgcatttgcagtgcacagttcagaggtttttactatatccacagaggcgtgcacccgtcaccacagcccagtttagaacattttcatcacctggggaagaaacacccacccagtggcagtcacttcccaccccacccccacccctgccaccgtgcattctgctttctgtagatgaatgcgtttgtctactctaggaacctcatacaagcagagtcatacagtgtctgtccttctgtgtctgacttctttcactctgcgtgtgttcctggttcattcatgtggtagcacgtgccagacattcctttctgttacacagtactgtatgtattatatatgtacacagccggctgttcatatccacgagttctgcttctatgaattcaaccaaccgtggattgaaagtatttgggaaaaataataatgcaacaataaaaaaatacaagtttaaaaacaaatagagcataacagatatttacatgacattgacattgtattgggtatgatacataatccagaggtgatttaaagtgtaagggaggatgagcggttatatgcagatgctactcccttttatctaagggactggaggatactcggattttggtatctgcaggggtcctggacccatcccctgtggatgctcaggggcggctgcaccacatttgatctatgtgttcatctgtcagtagatgtttgggttgtttccattcattttttggctaagtgaataatattttaatgtgatatttaaaaaattaaaatgaatgcaagaaattccatgaggaacaaaatattaattttaagtaaagaccacaggatcagtatttctgaagtttccttttgcctcaggatccagtatggctccatacattactgatcctgtctctctctctaacattttgatattttgtcatgtactttttgcattcattttgattttttttttttctttttgagacagagtctctgttgcccaggctggagtgcagtgatgcgatctcggctcactgcaaccaccgctttccaggttcaagcattctcctgcctcagtctcctgagtagctgggattacaggcacacaccaccacgcccggctaatttttgtatttttagtagagactgggttttaccatgttggccaggctggtcccaaactcctgacttcaggtgatccacctgcctcgacctcccaaagtgctgggattacaggtgtgagccactgcgcccgtcctcattttgatttttaaagataatgtattacactattgtttcttttgatggttgaattttctggcatccccttcaattttgcaccagaggtaagtgatcctaatccctgccctgacattttacactgtgctgtgaataccccagggcatcatgaggaataaaatttgaaagtgtatttcagtgagctaacttggctggacagaatacccatgggttatccttaccagtggtgccatatttatgcctttcagcagtgttgtgattaaactcaggtccagtaaaattatcattatactatattagttttgtagaacttctgtaacaaatttccacaaactgaatggcttggcttaaaacaccagaagtatatcctctcacggttctggagtccagaagtccaaagtcaagatgggggcagggttgtttgcgtctggagcctctacaggaggatccttcctgcctcctccagctcttggtggcgccaggctccagttcccttgtagatgctacaagggaactcttgtttatagtcgggatagaaattacacaaaacccggtcttgattggggataccttttggagtactggcaagttgccgcatggactgagccttccgatcggagtttgctgtcttgctggtgatctgcctggatgccggtgcacacactaatccctgaacacactaagcattgcgcttgctgttgtttaacttttcatccatgattgaattcaggagttctttttttaaaatggccatttttaaagatttctaattgggagtttttcttctgaaaagaatacccgtaaagcaaactatttaaattatacactgagagacgtatgttcattcttgtatccataacagttaagaatcattacctattactagcataggcacaaagcgtctcctctaagacatttgttaattacaaaagggacaaaagtagtgacatgtggggaagaaacccagcagataccacctaggtggtcaaggtcatcatcatcatcacgatgagggcatgttgacaccctgtgataatctgagaaggactcagcatcactcctgtggtgttcctgccaaaaatgcgtaagagtctaatcacgagaaaaattagacaaacccaaactgagaggcattctgcaaaacacctctcctgctcctccaaagcattaagagtgacaagggaagaacggggaaccatcacaggtcaaaggggatgtgctgactataggaatgtgggctcctgggagagagaaagggcggaaggagaaaccggtgaaattgggtaagtctgtagttcacttacttgtgctgtgccgggtcttaactttcttatattttgctaattgctatgtttgtgtaagatgtcaacataagtggaagctgggtggcagttatatgcaactctgtgctatttctgcagcttattgtaagtctaaaaattatttcaagattaaaagtttttttttttaaaaaagtcagatgaaaacacgaataagtaaaaaaaacataaaaagagagaaaaaaggagccatttatatgattaactttttggttggtgtcgccataagttttttcagttcggattcttagtaaaggatgtggatcaaaacaaatcttcatactaaaacatcagcagagaccttatttcatttgaacaaaatatcatgaagtcaggattcgttttgcatttgaatcttgaacatttaagttttttaggaaatttgtggtgctcctgtccttgaaaggaagcccacatatgttcaaaatgcagtatcttttaaatgcatttgaattttttaaagttttggtgtttgttgtttttggttgtttattgctttgatttttcatgagcagtgctgttcaggggtactattattgtcagttttaaatcactgctgcagcatacttcatttgatcttgagacttgccatgagtcttactgtgggggtggggaggatggggaaagaaaccattgagtatgagttggcatgtcccacagaacagcgggcggacacttcagggggctgtgcctttctcagagactcgagggctatgcccaaatcgttatgcagtgtgtatgtgtgggggggatagttggggggacgggtatggggaaaggagtaatctaccagggacgacccaggacagatcccagagccaggaatgagggttggatcttgggcaaggccatctctgccatgactgcttgtgggaactcctgcttactccccgtgaccctgagcaaaacttccaagtttgaagcctcaattttatgctctgtcaaagaaactagtttttcaccctccaccagaggatgaagtatcattctccacgtgaagcactcagcacagtgcctgtcccctctgcagacatgatgccaatctgtgatgatgttctcttctgtcagcattttacaaagcagatgagagcgttcacttgcacagcctcctgttgacctttcttctctcagacgccttgctgtagatcccaatcgactgcttttccttggccagccgattcatgcagtctcttgcttacttaatactgttgatatatttaaattattgtttaataaatacttgttattctggagtatatttgttcatccaaggatggtttactactgcttgctttgtgcaggttataacaggtaagggggtggaggtgtgtgcagagcatcagctggtcatcagccatcttgcgggagtgcccagaggggggaagagcaaagcctaccccttctacggagtgtgagggaggcaggcttgggtggaggcaggactgcaccagccttccagagctcagagaggtgacacctgagccaagtgacacacacatgataaagaggaggtttctggagtccagaggaggaaggcatccttggctaagaggacagcatgaactcatagggtacctccaggaatttttcccctgggcagtaggggcagagaaaggtacccaggggggcaggggataaggactggcatggagcatgggctcgatatcagcctgctgattttaatgaaagccgtttggtcacctgaagaacagctttgattttacttctgtaatctaaactcttttgagttggaatataaaactcagtgttccatgtgacaaaggggtttttaaattggtcattcccttaaacatctttacattttcgtatctgttgatgtcatttttttccccattgctgactcctgttcctgtcttctatttctgctcttgacttaataattcttggcttcttgacgtttatcattgccgactgctctgaatcctcatcttcccttcatttatttccatttgtccgctctgtttactgcctgagatgttgaccttttttccaagcatgcactaagcggcattttaaagaagcagcatcatgtcatagctcctggtagtggggctgggcctattcatcttggggcttctttatctaccttggttgtaggtagttaagaaaatcttaacccttgggtcattatttctatagtgggtcaaagagatgaccacgttactaaaactttcatgtctagttgcatattctgttttttttattgtggtaagatatacattacgtaatacatttgtaagtgtacaattcagtggtatgaaaacattcacaatgttgtgtagccatcaccctcttacacctaaacatttttccattatccttctccaaaactctctgctcattatacaataactggcccttccacactcccctccccacactcagtccctggtgacttctcttttttctctttatttgcctattctaggtaccccatagaagaggaatcatataacatttatccttctgcgtctggcttatttccctaagcataatgttttcaaagtccatccgtgttatagcatatatcaaaatgtcatcgtatttttgtggccgaatactaatccgttgtagggtcactcacacgcacacacgtagagtagctgtgagtacagtgcccagattggtacagaaaggccacagtgcccatgggtctgtccattttacatgctgtaccgtgtgcttcatgggaaatatatttcttctgtgagttttcttgtacattgcttgtttccagacttctaaaggggtggttgtggggatgtggtgctgtgtctcaggtatactctgcttatgaaatagcgggtgtgatggaagggtggagaaagggagttgagtaataatgttcacctggggtcgggcgcggtggctcaggcctgtaatcccagcactttgggaggccgaggcaggcggatcacctgaggtcaggagttcaagaccagcctggccaatgtgttgaaactccgtctctactaaaaatacaaaaattagccaggtgtgacggtgggcgcctataatcccagccactcaggaggctgaggcaggagaatcgcttgaacccgggaggcagaggttgcagtgagctgatatcgcaccactgcactccagcctgtgcaacaagagcgagactccatcttaaaaataataataataataataataaggttcacctgattgaaatagcctctgtattgaagaacaccagcaggtgaagttcgcttagcagatctgagcttcctgttaccctaaacactgccaaccttgacctacctctgaaagccagtgggatgaggtctagggccaggtgggaaccttgggaaaggcatgccctactgtttgaccaaggggatgaggaggctgggtactccagtgatggagaccctttccccaccttttctctcacctctcctccacccagtgccctttcacctttcctttccaaccccacacccatccttccgccccacttccccatttatttctctctgctctttcatttccgtggccagccgcctcccaagccctgccctcaagcttcccctcccttttctttcatgcccatagcctacctggatctcctctccctcgtcgggcccacctccctccacccttgggatcctggtcaccccctccactgcaagggggagaagggctgcactgtgtggagggttctccctaccttggctgtgttctggggatttcccaccagcccttgcgctgcactggtgatgcccgatgtagctgaaactctgccccgctcggggttactggcctgggatcagcataggagatgggtttaaaacaggatgcagggaggctgctggcagacagttatttgaggaaatgcatttcttaggatatagctttcaagaaggtgctgttattgtgcgtcacacatagagtggctgtaatgcgccagggcaaatgaaaattatgtttataaaatagggcaccttgtcaagattaacttgtgtgaaattcccaagaatatacctcaaacagttttttatgtcagtgcatgatattgtagtaactctcccagttctagatatctttattttaaaaggaatgcttgtgtgcagacacatttttaggtggaggttagtatgttttagttctcaggatttctaggagaataaatagccataacttgataggattggtatgaatagtacttggtcttgggaagttttctccatgaaaatgtttcatgttgacgttttgctccctcccgtcttggttttacactcattcttcacagaactgtcatttataggaacttatcccctggccatctctataggtgtctttcttgcccagataaggtgagaatcattttggaaaccaacttcttgagaatccacaagaaatgggttttagccacaagggatcattgcattgcattctataagatgagagcttctacaagaaaaaattctggagccagatattttagggaagacagggggctgataagtgaattgttattttaaatggttttcatttcccctcatcctgatttagaagaggagagaaaactctccttagaatcagtgggtagtcctgacttgaatgggtttattttctttttctctcttgaattgtcggtgtatacccgtgtctttcttggtttatccttcatccccattcctccggatacccctatttgcatttaatctgtttggtcacataacctctcaagtagcgatcttggaggtttcaaaacttaacatttcattttccccgctgggtcaactaccagtctggaagcaccagggtttccaaggttaggttacagtgaaggcacaggggacatcttcctgtctcctctgcagagccagcgccactgtgcagtggggtgtggaccccggctcctccccaggctcccaggcctgcagctggcacaggggtccccagaacctgtgagggggtccttccctctgcctccctgagggacttggtgattcttagccctctctaacagagggagaagacgctgtcaaaaatgtggtttgcccaaacccacatagagctgggaaaggggccagggactcaaatagcagagatttcctggccatccatcagtcaggttacatcagtatactccatgtggattccactgggtgccggcctggtggctgaccctgcctttagagggaactcattattgtgtatttgaagtgtaaatacctcttttcccagatgttaatcttgtttcagatattcgatggagagggttcacataataaataattccctcctgagtcggcttgcgtggctcctgagagcagctggtcagggcccttcttgtcggtgtctcactggcttttagcaaaatggagacgaagatgaaagggaaaccttaactatagcttgaatccttagggtggactaagcactcaaagccttccatgcaaagcagtgtggcttataaattggaggcatttttcttattattaggacaaaccagcacccgaattggtttgtcaccagtaaaagaatttaaaacagtgcccgatttgcacagctgagattttggcaacagtatcttacacatctgaatgggtggagtaagatggagcatcattctgtgatatgtttaaaataatataccatgaaatgatgcagtaagtgttggagatatcttccagaagtcttaggtcatttgttttcatgtttaaattgtttccgcaaaggcattctcttcaacataaggagagctaaaaatcaaatacacagaaattttgtaagtgtgttgtttttttcttttcctgtttagactttataacattacactatttacctgggctaaacaaaataaattattttgtacataaaaccacaaggagatggtttagcctacttatgggaccaaactgttgtattagccagtgtgggagaatattgcagagatgtgtggcttcatcaatgaagattagatgtaaagtctttttaaaatatatgagaatgttgaactaaagatggttcagatgggactttgctcgagttgcttgagtctagaaggcaaaataaatgtttgtaattgttacataggccagccttccaaaatcccagctatccatagaaaacaaggggtcagcaaaattggccatctgcctagactggtaggttgtatgggtctgaactagaggcagtctttccccaggggacatttggcaatatctagagacatttttggtgtcaccttgggggaggggtagtactggcatctggtgggtggagaccagggatgccgctcaacatcctacaatgcagcggtcaccgatagcccaccctgccccaccacagccaagaatgatgcacccagtagaagcaccatccctcttccactggtgacatccgaacatgtctacagacactgcctaatgcctcttggggggcataatcacccctagttgaaaaccactgccctaaactgagactctgaaatcaaccacttaatctcctttcctctgagctcaggggagggacgtgactcctgcgagctgccttggctttttgtaggggcacagatagaagccatcccccaacacggtgccctgggttctgtggtggtctctgagaacccatgaataaggatcccagggaagcctttctaggtcgtgctgctttaatattattctagatgccgatttaaagtcataaaggaagaagagctaggactgtgctggaggaccctaaagcccatggcccatggtttcctataatgctaaccatgcccggagtatctagttataaataattgtgctgaggtcatgaatatttgactttggttctcaaatattcctaagaaaaaagtcatgaaagcccctgatggtaaaaggaggagagctgagacctaagtggataggagactcaggaaaaagcaagttagaaataaagttcaacaaccacaggagaggagaaaatgggtccaaaagacttgggctttaggcacatcttacctaaggacaaaaaagtagagaaaagatcaaatgttgagaaaagattgagccatgcggagaacgggcagggtgttgaagtacctgctgctctccttaaacccagcatgctgttcactgctttattttagagagtgggtgtagtggtctgtttcagaagactcaagtctacactgcctctgccactgaggttccttttgactctgcagaagtctttacctttcatctcctttctgaaatgctgtgagcatttttcctcccagagacattaattgggaacagcagtgaatgcctagttccttgcagtcctttggcccacacgcatttccagctgcccactggccagactggattctaaatgccaaaagctacaggcgctgacagagtgcttttgaaaagaaagaaatgcatgaaatgccccgaatttatgggaaatatttatacccagcagtccttgagccatgcgtgtcctttaggaacggtgctaccagacagccgtcggcatggccttgctcctggtggtgcaggctctgatgttccactgatgtgagcccaagagaggaatgaccagtcagcctgtaaccccagctccagtgttgttaatgagtgtcaccgatcaggtttcagacgttagtcagtgtcccggctccagtgttgttaatgatggccacggattgggcttcatgcgttagtcagtgtctctgttaggagctgaattgtgtccctgcaaaagggatgtatttaagttccaaccccttgcatctcagaatgtgagcttatttggaggtgggatcttaaccgagtgtgactggcttccttagaaaaagaggaaatttggacacactcgtacagggaaaaggccatgtgaacagccacctccaagccaaggagacaggctcagaacagattctccctcacagccctcagaagaaaccaaccctactgacgccttgatgtctctgaattctgcactccagaaccgtgagagagtcagtttctgtgaagccaatcagcttgtggtactttgttatgttgggcctatgaaattcatctactgttactagcctttcccaaatatttcagtccatgaaatgcacccagcatggcaactcttcaacttacagaaatggaaaagagaaagaatactgtgcttcagctagttttctcattacccagaaatgaaaaggcctgacctctgaaaccttgaggaatctctttttaagatgccagagcctgtacttctgcctgatccaagcagagtttgctcgctaccccgggcatcacttctcactgcccaggtggcactggatgatgtccaagactggccagatctggatggattccataaatagctcgtgctgtttctggtcagtgaagaaagaggaaggcaaagccacgtgcataagtttgttgtggatgccataacaaagcgctgctggagtggctaaaacgacagacgtttattgtatcccagttctggaggccagaagtccaaaatcaagatgtcagcagggctcttcctcctgagggcttgaggcaggatctgtcctgtgcccatcttccagcttctggtggctgctggcagtctttggtgtcccttggcttgtagctacatcacccagatctctgccttcatttgcacatggccttttccctgtgtccaaatttccatccccctaccttttttttttgttttgttttgttttgttttgttttgttttttgtttttttttttagacggagtctccctctgtcgcccaggctggagtgcagtggcgcgatcccggctcactgcaacccccgcctcctgggttcaagcgattcttctgcctcagcctcccgagtagctgggattacaagcatgagccgccacacccggctaatttttgtatttttagtagagacggggtttcaccgtgttggccaggctggtctcgaactcctgacctcaggtgatccgcccacctcagactcccaaagtgttaggattacaagcatgagccactgcaactggccaaatttcccctttttataaggactccagtcacattggcttagagctctctcctaatgagtttacatctgcaaagaccctatttcccaataagaagttactcccaggtactaggtgttagggcttcaacatacgccttgggatgggcagtcttgaatccataacaccgtcaattaaaaggttctgctttcattgccgccaggttgggaaaagttgccagggtgggcttggtggaggagggtctctcagcagggcagggtcattgcagggaaaaggagagagaaacagagacacacaaaagcagatagattgccttggcagaggtggccagactagagtctttgagttttgtagagagatcaattgattacttctagaaatgtcctcttcaaagtctctagttttctctcccatttccttatacaaggctctggccatattactacttctggcacagttgattcagtgacttttgcatataggtttccccaaagctaaagctaaaaacgaacaaacaaaaaaagattattcatgaatatgccacaaactttgcccatagataagactttgtgattacaagcaaaatctgattggaaaataaaatacattatatgttagaataccaggaaacttctttttggggagcgtctttatgaaatgaagccatgctaacctccctgggactgctgatcagaatgtgctccaccccaaagcctcggagagggcaggacagccagtgactctctcctgtcagtagacacactaaacctgaatccaggatgggaaatcaatgtttgacacagctgtatctctttcagttggatcagtaacactcgctcactcactaggacttccatttgcttttagctgcctgcaatgaaaacctggcaagacgtcttagtctgatccggctgctgtaacaaaataccgtagactgagtggcttataaaaaatagaaatgtattgctcatagctctggagactgggaagtccaggatcaaggcactggcagttttggtgtctggtgagggctgctttctcacagacagcatctttttgctgtgttctcacatggtggaaggggtgagagcgctctctggggtccctttgataaggcactaatcccattcatgaggccccaccctcatgaccgcattacctcccagaggctttacctcccaacaccatcatattgtaggttaggtttcaacataggaatttggtgggcgggggggggggtacacaaatgtccggaccatagaataggacattacagcttgaaaaagcactagagagaatgacgttgttcctttgtaacacagaaaagcattcacctctcaatttagatgagccattttgaccccagttggttctgaaaatccttgttgacaaacaaaattggagaggaccatagcctgcctgcttttcccgaggcccggggaaagctttttcatatgatgttattataatgttaggtgtaacaataaatgaaagttttgtatggtctgattgggtaggacaggcctgaacacaggcaaacccatctgcacagcatgctcaattcagtcagtgtacaaaccctgtgtcatgggagcagagagaagggtctgcttccattccggaggatgacagaggcttaaggacggtgctggcgtttcagctgagcctttaagaagtggaattttatccagaggtgatcttcttggaatagagagaacaaacaggtcagggcatgcagacttgattacaggtgctctggggaccactggaatttttgttgaacagaggatgatgaaataaatcagtgttctagtgtgttacctttgggcagtggcgagatccgagtctccatagtgaacaaatcagtgcacagaccagggcagaagtgcaggggaacatggaacattcagggcctggagggtggtacccaggccaacactgccccctttttccagctcccatctctgtccacatagttgggccagtgtagacatctgggtcatatagggaggcattccagtggccccatgtggtttccatggagatcttcaggaaggggttttggggtgagagttggtatctcgtggcaaggacacactccctgggctaggtacatatgggtggttttcttgtcctacagattgcaaagatacaggggtagctgttctgctctgggcagcttctgtagagacaggatgtgtatttgcttgcctgctcctggaagccagtcactgaggcagacctctttactcgtccagaagcatgacttggggatgattatagttcaaggacataaggcctagtggtgtctttcatcagcgccccccattttacatttctgggatccccctttctcttttactctgatctggcctcccttcccacccctctggccactcaggtgaggagatgccagatcccaggtgggcaggaaggaatcccactgaatgagatccttggaattgcagcgtagcctggagctgtatgttcattttagatagaaatattgacactattgacactatttggccgggcgcagtggctcacacctgtagtcccagcactttgggaggcaaatcactttgaggccaggagttcaagaccagcctggccaacatggcgaaaccctgtatctactaaaaatacaaaaaaattagctgggcatggtggcacacatctggaatcccagctactcgggaggctgaggcacaagaatcctttgaaaccgggaggcggaggttgcagtgagccgagattgcgccactgcactccagcctgggcaacaggtcgagactgtgtcttgagaaaacaaaaagaaagaaatattgacactatctgtccgcaaaaggtcaaaggcataattacaatatgattttgtttccatttttctttttcttcttatttcatgcaaatgctgtctttttgagagaagtggttataagcacagcgatattctatgctatgtacagctctcatatatagaactctctagaatggctcaagttaccattaagcctcaggtgatatcaaggttataaaatgtaaaatgaatgatcatgatcattaagtagaaatcctggctgtgtcttccaagttctttttctttctttcttcctttttttttttggagataggtactatctgcatttcagcttagcttgccgccagtgttctggtttcttgaccatgctgagtaattttcagccacaccttgtatcccttagaagcccttcttgattctgaggtacggggctcagaaagctttgtcgtgggaggttgtaaattaggaaacatgaaaatcagatcaacaacagtggctggtcctggctgcagggctcatctgcctggagtagcttgaagttgaatgttaatatatacttttaaattgcagttgtttaattaggtaaagtgcacaggtgactttctcacactaaatggatgatgagtattgggaagagttgactaaaatttctctatcttttgcccatatccaactctcattgaattttaactcttatgagatatgtgctatttaataaataatgagtctgagttttctcccttttggaaatgtcaggaaagtctcaatgattttaagtatcttttattttataatagcaatagaatctagaatttctaaaatcaaactgagttcttgattaaatgttgaaatgcttgtcttcatccacctgggagcagtcgttgtgaacgagaagccccagtgcataaatcattgaatgatacattggagaagtctcagagtaaaggaagatttgtttacttttcagacatcctggaaggtgagcatcaaagcaggtgagtggctggctcttggattcaagcttccctgatcctttccagaagtgtatccttctcctttaagagaa[450 bp omitted]cagaggttgacacccaggactagagctcagtagaggggccgtttcctacctgcagttcccttggaagagaaggggtgaagcttaccatgttggtggtggtttgtttcctggggctgctgtagcaacgtgccaccaactggctggcttaaaacatgtatggtctcccagttctggaggccagaagtgcagaatcaaggggtccgcagggcccagctacctctgaggcctccaggggaggatgcttcctgcatccccttgctgcttttggtgttgctggcggtccttggcttgtgggcacagcactttcctctctgcctcggtgactacatggcctccctgggtgtctctgtcttcttgcaaggacaccagtcatgttagattatggctccaccctgctgcgatttgacctcattttactttaactaactatctgcaatgaccctttttccaaatgaggttctgaggtgctgcacgttaggactttagcatgtgatttctgcggactcaggtcaccccataacagtagtcatgccccaccccatcccactccacccttctcccaattcccctggtatactccagggtggctctgtggccacacatgacccaggcccactggccattagacactttggcagggtggccaaagaaattctttgtgctgaataaaattaatgtgtaaatgcggcggtgctccaagggcagtgttgcgtgaaagggcaatagaaccatggctcctgataaacagaagcctgttaagcagcaaggtcaaaagccagatgcagaagtcagaattagccgggtagactttttatttcactttcccccccttttttttttgccagtggactgccaactgttctcttaacagaagggcagtttttgagtaaatgaagcaggacttgatctgggttgtcataaattgtctctccctcaagaggtaacttctcgtgtttgccagttcagaggtgtagggagacatctctgatgtgtagatgtcctagtttggggtgcagggtggctttgggtctgagagcctgctgttggccactgggtgcgcgtgggcttctccacatgacaagacgggaatgctgtgaaggaggccgctgttccgcttgggatgttggccgagcgccgctggcctgtgtccctggaatcctctctgattcaaccattgaacattaactctgtgaggtcacagccaccagcggggcttctgagcccggccctgttctggccatagagggtcaggaggagaagacgtttcacccttggattttctgtgtttggaatccaaggcctttcccgtggagtcttgtgaggttttctcgggaagaaatgatcctctgggagaggcttgggcgcgaactgaaacatctttcaagacactgtggctcttttcagggaaatgctaagccaagcaaacatccactcagaaatgttctgtatttggaagcctcagagtgttaggggaagccttgaccctggaatgtcatctcctggtggtggcggcttcacgtggtaaacaggaggtaacctgggtgtcatgtcacccaggtgacatgacacagggccacacaggatcatcttccagtggcagtggtgaagataggggatatgatttcacatcctcattagagcccacacatgagatccagctttataattggaatcccagataatgagcatgtgaacgtccgtaagttccgcctattctgggtatgatgtcacactcataaacaagctaagcacacaaactggaatttcactttggaggaaaaaaatttcaattctgttacatgagataatacaagtagtttaaagccacagagggtctctttcgatcaggtagatctattcttctgtgctcatgcaatatgatagaagagcttcttgcatctttatgtcaagaatttgctaaaataaatcagacaagtttaggatttacctcatagtaaatcaagaactttaagcaggggcttttcttctaattaaaaatgtcatgtataccacttagacatggaaatgcttaggtaagtggagcaaattattctctggggatttagaaaaaagaaaatcagtctggtttctatggctgcatgaatctggaaggtaaattattaacccagtagactaagattttactaaaaacagactaatttgttgtggcaagacagttccagtctgtgtgctagggcttttgtttgcatgcttgcttgaaggcagacaagtcaaattaaacaataattattggcttggagggggagcagatgtattggattagtttctgtgccacatttctctcatttccaccaatgcactccagtttcagcccttgtatcagttatctgttgattgctgtgtaacaaatgaccccaaaactcagcaggtgaaaactacaaacgttaatgatctcacacaggttctgagtgtcatgaatccaggtgcagcataaccaggtggttctggctcagggtctctcgtgaggttgcagcctgcgctgcagcctttgagacctcgtgtggggctggggggtcagttccaagctcccttagggtgtggctgcagcagaagtgatgcaccatgtgcaacaattctcttggtcctgtggatcaacctggtgaatgtgggacaggccggtactggagtgtgaatgccagggctcacggggaccgaccgtctgagaagctgcctgtcacgtctctctttgtcttttacacccataaatgggcaccttggtcagagaataactccttttgagtccataatcgtctatcagaaaattctgggaaaattacttgttgatttagccacgttcatggcctatctttggagccatcagagcccacaaatggagactgtcaacagcttagcagtcagttcattagaaagtagtgttactgcagcctgggtgacacagtgagactctgtctgtacaaaaacattaaaaaattagccaggtgtggtggcgcatggctgtagttgctggaactcgggaggctgaggtggaggatcacttgagcccaggaggtagaggctgcagtgagccatgatggcatcactgcactccagcctaggtgacagagcaagaccgtgtcccaaaaataaataataaaaaaagaatgaatcacataccaatttttttgctcttaattgcatttttgaacagaaaaacagttttccctgcaatcaaatgcaaacagttcctgagcccctaatggacgagcgtcctcagctcccacctgcactataaatttgcgttaatcttccagttaacttcagaactgctgctgtctctctatgttccttctgcctcaagacatataggaaatgttggcctttccctttcaaaagaacaaaacagttgaataacctactacagtcttctgtgcaaagttagcttcaaaaattatcaagaatgttttctccaaacattcacaaagtttacagagttttcccttttactcaggatttcagcccctttgttgctcttggctctcacagcaccaagatcgtctgtccactcgttcattgggcagatgtttattgaatacctgtgtgtgccaggccctgggccctgaagtcagggccataaacacagagcacagtcctaagggcaaacgattttctcaacagggatttgaggcctgtgaggtttgaacaaatgagcctcgtgagtgccagttctggacactcggcctgacttatcggacatttcgcagattcctaagattttagaattgggagagaatctttgagatttgcttgtagcccttacattttctagacaaggcagaaagaagtccagtgggatgaggcagtgctggtgctggcaccgcctcaccctggcacttgcatcgcctggaaacaaggcagagcccactggggcccccagggtccaaagcctccaggtacgtgtctgagttctagcattggagttgccgctctcacccttgccagttgctttggcatgaagcttgatggtaccagtgtgtttctgtcttcacagcttgtggccctggccctgagacctgaggcttggatggcactcccacttcttgctttaattcttccctggagagttctcaccttccctgctttccaagtccagctgagatgggcaaccaaaatttcccaagggagaaaatagctgaaaatagaagtagaacatgaaagaggatggcttttcttttttctttttttttctttgttccttttatttttttaagttgatttatttatttatttatttgagatgaagtcttcactctgtcacccaggctggagtgcagtggtgtgatcatagctcactacagcctcaacctcctgggcttaagcaatcctcccacctcagcctcccacaggtgcatatcaccatgcctggaattttttttttttttttttccaatttttgtagagacagggtgtcactgtgtttcccaagctgttctcaaactaactgatcctcccgccttgggctcccaaagtgctaggattacaggcatgagccatgtgcctggccgagaatgtttttcaatttgggcttgttcagtggttttcacatgattggactggggtggtaggttttgaggaacgagaccccagaggtgaagcgcccttctcaccacatcatatcaagggtaggtactgtcaacctgactcaccactgttgctgttgaccttgaccactgggtttaggtcatgggtgttgggttgcgattaatgtttttccctttccatgtagtattctttcaaaatccccactcgggtggaggaggggtgttaagcatctcttcctggaggttgtttatttcggttttatgttaaaatatatcagtgcagatccattcacccatctcttgatagaaggagtaggatttttcttgggacagggatcctttattcctagtttggagtcagcttcccccattccggatggtgcagcctctacaatgtttgtctctttgaagcggagtgggaattgaaagagatttatgaaaccatctcggtatagaatctatctaggattttattttcttttcccaaatcccttgaggcaatctgtcttggttaagtctctaaaaaagcagtcaaagtggtttttgtcgaaaaaataatttgggggtactcctagttcaccattttatataatattcaattacttttcgtaaatgcaataacaaggccaactgacataagcgagtttgaagcagtcagcagtttgggtgtttcagacccaggtaggcagctgaggtgggagatcccaggggaagctcagggagcagctgcccgccttggtcagttcagccaggttaagtggaggccttgggaagagagtttctcctcttgagtatttttagaagcagcagatatcagccataaatatttaatgttgtgtttctaaactttagcgtcataaaaatacaaaaaggtgactgggcgggggttggtcagtatatacctaggggagaaaagaacttcctcaacacatcacactgcataaggaaaaccgtcttaaacgttcttagaagaaaagtcagtaggtaaacagctatcgtgtaatctgatgaatacccaccggaggaagtattagtaattattctttgcttgccagggttttcataattcttttccaattataaaaattaatatgctgtaagcagtttttaaaaataaaagtaagcatgaaaagaaaaacatctataaacccacccctagaagttttgccccagcattttggtggtgtgttttcttccaggtgtgtgtgtgtgtgtgtgtgtgtgtgtgtgtgtgtgttgccccagcattttggtgtgttttcttccaggtaggggtgtgtgtgtgtgtgtgtgtgtcctgctgtattctgagctttgtagtatgccccttccacttgaccttctccaggaagcatttgatcatccagcaacatcgattgaaaatgtttgtatgcatctctttcatgaagtacatgttccatcatttatatcacatgtgttgctggagatttcaattgcttccattttcctttaggataaattgctggaaatagaactggagggctcttgagaccgattaccatattgctttcctgagaggctgtgcgggttgcgtggcagtgaggagggacgggggtaagtggaggggctggggcacaggcctctccaacacttcatgtgaacatggtcagctgagccaggaatgcgtgacatctttatttttccccttgcatttctttaattcctaacgaggtggaatatttgatcacatttgtcagctatttgcatttctttttccatgtattagacctaagcctctttgaaaggtgttatctcaggttctttccaatattgcactttctgagtttctcttgaatcccagttattttaaggattgcagtgttggagtttcagctgaaggggccatgtctgatgtttgctggtccattagcctcctggcctgagccaaaccatgcatcttcatgtcagagctgcatatgaaacaagagctaagtccagaaagcaagaagaagctagcagattgattttcctaggtggggcctaccagggcacttctgttgttgactgtaccactctctcctgaagggccctggttgtgtactgcagttgggactgctgacgtgttggggtgttacaagagcatgcggaggctgctcctctcctgtttcctggtgtgctgatcaaaagactttttatagaatgacagttgtaggaaaagcacagattcttatgttagccaataacggattattttttaatgttattataaattggcaagcttactaatttgtttctacttgtcattagccaaagttcagtgtttcccaaggatatatgtgaatgtgtgtctgtgtgtgacatctgttgtatttttcacatgaattaattgagtatctattatgtggcaagctctgtgctgtctttgaagcactgaactgtcttatgatacacacaggatgaggacaggatcattttctatatttctgtgaagtcctttttcaaattcccattcttttgctgcttctgcatctcctttgactgctttagggcatcccaggtagaaagcttacctaatgtcaactccagttctttcttttgtagtcttcattttaagcatgatttctgtttttctttttccctttaaagaaagcttctcaaactttgaaatgaaaacaaatgaaaggagagggaaaagattcagaaattattgatagattgctaaaaacaaatgctatgataattttgggtcggagcatctgtcgttttacagcacaacagatttagcttcttaatgatgtttgtatgtttttcctcaaaagtgtattgactaggtaggagttgagccaagccttgaatgaatcatttcctgccaaattcaatagactgagcaaatcctcggagaaatggccatatttctctaacactgggttcctttcagggctcaagattccattttctctcaatactttgctcctacagactaggagtcctcttcatgctacagtatgcagtgtgtatggaaactgtgaatggagaagcagccgttcatgctgccaagtttctttcagaaggtggctccaggtggatgactttcagtctgaactcagtgtcaccaggcatgtgtgtgcccacacactgccactttaagctgtggacaaacagaacggatattctcccaccaaaataaacatacaagcaaaacactctgtcttcattcagcatcatttgcatcctataaaataatggtttctccttgatgcccacctttcttatgggtggttcttaattagttccaaacagaacttaacgtggccatgatattccacttgctaaaacaagggcagtcgagtgttcgatttgccatcattgattagacgcatgcagtcacccagtgctgtttgcccaagcatctgtaggcggggattccccagtgctgattccccaatgcttgtaaggggcaggacttaattaaatcttaaagtgacagctgaaaatgtaagggtcaggaagtcatgtctaaaaggggatttagtataacaataataacagcagtgactaagactaatcctggctcaggcattttgtttggggtcacctggtcttaattagcagcactctgggatttgagtggcgctgtgctgttgcccacaaagcccatcagtggcaccattgcctgtgtctttcggggcagtctgttagggagggggtggcacaggtgttggcacggccatccccattttatatgtgagggaacctcagccaggcaggatccttgcctggatgctctgtggggagccctgtgagtttgtaaccctccgtgcagcctgccaggtcagcggccccaaaatggagagatacagagggcaccaaattgtaaggcagagcgttggctagtgacacaagctgcctttcgatcgcctgggcgttctgaagcccgcaaacattcgcctggaccttggtcaggtgtctcacagaacctacagtaattcactgttaagaataacttcaaacacagaaaatcgctttttgtttcctagagaaggctagtcttcagcgagaacaacttgtgatttttaatctgtttcacactggtcggggaggggggaagaaaagatgttatgggcatataattaaaaatttgtcggcagatacaattacaggaagaatcatgtggcctaaaaaactgaaagcctccatatgcctcttcatcttgccagctacagtccacaaattgtagagcctgcgggcactgtggaagccagctagatttgctctatccagtagcagcagattgagagccatacatggaatttatacttttctagcagccacaggaaaagagtacaaagaagcaggtaaaatttatattacaacatcttttttactgtgtattaaattattattgtaatacctattttaatatataataatgccataatatattttatttaacccaacgtatccaaaatggcatcatttctacaagcgattcctattttaaaaattatccgcaagatattttatgttctttcttttttgtacaaagtctgcaaaatccagtgtgttctttggtcagtgatgtctgagatcccaagttccaatgtctgtctgaaattatgaaaatcaagtcatgggagatggataccctattccctacgatccacttatttcacattgcatgcctgtatcaaaacatctcatgtactccataaatatatacacttactatgtaaccgcaaaaattttaagaatatacaaaaaattttaaaaactgaattaaagagcattgtagataattgtatttttcaaaaaataagtaaaatatctggtatataacagttaaaaaaaaaactgtattatcaactctgtgaccttagaactacctttttacattttcaaagattaactctccttaaaaaaataaatgtacaaattattaccaaaaaaaaaaaagaaaatcaagtcataatgtgaaaaataatttttaagctgaaagttacactgtttctaggagttttaaactaggatagtttgtggttattaatctgtttggaagtagtccagaaaaaaatgctatgggtcaataacttgaaaatgtgcatgtggactacttaaagaggaatcgtgtggcctaaaaagtccctgttatccctccaccctgcagactccaataggagaatttccgctgctgcagactctccttggtggccaagctgcccagcactctcccgtcccaccaatggtgtgactcctatcactgagaaacagaccccttaccatttcatttccttttaattaatttaaatttaaaaatcaacacttccttggttactggaatgttgggaaccatgtgggtgtgtgcatctatattttccagggtctattttgttacctataataccagtcatgtatttccaatgaaaatttaacttgtgaattgagatatagtacaaatgtaaaatacatacactgtgatgatttaggaaatttagtaggaaaaaggaacgtaaaagatctcagtaattttttaaatagaatacaagttgaaatgatactattttggatacactgagtaaatcaaaatctatcatgaaaattaatttaaggctgggcgcggtggctcacacctgtaatcccagcactttggcaggccttggcgggcggatcacctgaggtcagcagttcaagaccagcctggccaacgtggtgaaaccctgtctctactaaaaatacaaaaattagccgggcatggtggggcatgcttgtagtcccagctacttgggaggctgaggcaggagaatagcttgaaaccgggaggcggaggttgcagtgagctgagattgcgccactgcactccagcctgggcgacagagtgagactccatctcaaaaaaaaaaaaaaaaaagaaaagaaaaagaaaactaatttaaaattatacataaggcttgccttagatttctgttgggttgtgcagatctagaccacagttgtcatgtaacaaaggaaggagagtttgaaattacaggctcacagttaatgataaaattccaacctaaacccaagaccagacattccaaacactcaagtgagtcaatctgatgatttgtaaggcttaatgttgaaccgtcttcaaatgtgatgacctcatcctaactctttccaagctcccactttgggtatatcaagaggctgaatgtggtggctcacatctgtaatctcagcactttgggaggctgagtcaggaggattgcttgaggccaggcatttgagaccagcctgggcaacacagcaagaccccatctctacaaaaaaaattagccggatgtgttgatgcacacctgtagtcctggctactcatgatgcttgggttggaggatcattgagtccaggaatttgaggctgcagcgagccaggatcatgccactgcactctagcctgggagacagagcaagaccttgtctcaagaaaacaaaacaaaaaatgaattggccaagagaagtcaaggctcatctgacttggaagggagccaggttctcagtctatactgcttttctcatcctggcagcatccccatgagataaaaatgattattcccattgtacacttaaggtaaaaggtctcaaacagatgaaataattgcaccatgactatagaaactagtaagagtcagcgcctgaaattaagcccagggctgtctcctttgacactggccaaaaagcagtaacctcttttgatgaaggggcttacttcaagctttgtttatgtgatgaaaacaccccagggctccagaaacttaacatttggttccacatccagaaaagtaaatttacaaaatggtactgcaagtgataattctcgttgacctgggattgctagggtataagcattctgggaatacctgggtttctgatcaggaagtcattcgcagctataatggtgatcctcagtcaccgggactctgggattgctagggtacaagcactctggggttacctgggttcctgaccaggacatcactcgcagctatagatggaatgctttaccccttttctcctgtgttatatgacatcggttagcaccttttaacctttttagaagataggttggaagttgagttagataaatcaacaggtagctgatggcctagaatataactttctgtagctttcaaagtgaggatgaggggcatcttgttccctaaactgcttcctcatgatggggaacctcagcattgtcttgccttgtgtctgagtacccatgtaaaattcagtatttcattcttaaaagataaaggggaagaaggaataacaatagacaaagagattccaccctagtccccatcctcattctggtgaaaagttgtcattactaagacaatcacacactcgatggagaattgtaggctgtggacaacagagccatagatggtgtactaatagctgctacaaaggacgcctctgtcctacctttcatgcccagctttgagtatatcctgtctcttgctcattaccgatgctgagttttagccctgtaaccagagtcctctttctttttccacagatgggactatgaactgtgttttaatgattagagggagtagtgaagattttcactgtgaacattttcaccccctttcccatccttggccagagatgatctcacatggtcttggcaggtatctttttacaggagtgcatgttgtttatcttgggagctttttgcacagggaaggcctttgtcttccagctctgtgaatccttcttcactgcgtagcaccttgcagaacatttgcacatattaggctcttggtgaacacttagaatcctcagtcatttgcattcacgtcatgtttccataacacattgaatgaaccagcaagtatttattgaacatttactatgtgaaacacagggaagacagccatgaacagaccagacacaaatcttacgtgctactggataaaaatgtaccccacggatgacactttgggtattatgatgccaacaatgagaacatattaaatcactttggtatttgcattagattgtgtcctgtaagtttcagattggtgtatttgccaaagaacaattgtgtgtaccccccacccaccagaaaagaatacagtaaaagtgctaaactattgaatatttttaaatggtattatatttgaaacgtgtgtttgtaattttgagccatgtaattagaaatctagggtttatttaaattcttgtttgttttagagaaatatgtaaagccacatttccctttatataaagtacttggttgaaaaaacaatttttttctaaagaaaaaaaacactctttagtgtacttttgccaattaaaagacagtacagagaaattgattcctcctggagtttgtgtagaaattagaaaacataatgcttttccctaggcatgaactcgcttaaaactactgagaagcttatactcacgcaggttgaatggagtgaatagtggtttagagaattgagctgattaataagaagtccctgattttcttttaataacacgttctgacccaataaggaaaatttgcactatgttttcctacagcgatggtgctgttaaaacttatgcaaatgggacaactttattattactaagccttttacagtatgttgctttccagggagctttgtaaatcattataattgtgtttcctcagtgtatgggttctgaatgctcctgttgtcctgtgaggtgaatttccatttggtgaagatgatactgttaaatggaggtttctaccccatagaaattaagaagagataaatgcagacagacccagcccttggaaattctgctttgtgatgaattatttccttatacttatggtgaacttttttacccgtgatgtgcacaggggcccagaatcatatatgacaagtccttccatgtggactacatccatatgacaccatgttcactagttggagccttggaaatccagtgggaatggtgagatagtgtgaacagctccaaggcaccgtgtttttaatgtaacccattcgtttctggctgaataggctagttgttgatgtggtgggcattatgagatagtgttaatggttgggccacggcatttcaaagagatgccttataagtcctgagcccattgtgcgtctctgatcattttggtcttcatttgctccccttgcccaccgtccttccacagagcattctctggaagcgctcagggagcagaacagggcaggcccacgtagaaaatggtctcttgagagtagaaggtcaggttcgctgagatctctgactcagaccacccgtacccatgctttttgttgtgatggagaaggtgctctcatatatacacatttgtgtagtaattactgcatattgatagcaatgttactgcacctgttaattaatataaccaaatggcatagctacagtgttttattctagttcaatttaggagagtatatttgttctcaatgggaattgatctggggagacccagagagtggggacatgagggttatttgtggaggggatgacacagcagcttcagaaaacagaaacattaatgcattagactgctgacctgtggggtcacacttccttcagtgatgcccataagagtcttggagtgccggaaagtataagcaacgctgagttcctgccagtatcacaaaggtgtgttttggataagagaggagccagaaagattacacttgtgtagaaagtgaaaactgagtttgagggaacagtcacattctcatggcaataaggtgggtagaatgggccgctcagcctctgcactgtggtcagctggagctggaagatggttgtggtggggctgccgtgtgcacggtgggaggtttagcagcatcccaggacccaggagataccagtagcaccgcctcccccagttgtggcaactgaaaatgtctccagatattgccagatgtcccaggatgccatagggggagcatgcagtatcattgcctgttgagaacctctggaataaataggtaaatgcatacaaatataaggatcttagtcttgcattgggaggcggcgtctgacatgtaaagacaccactagagcacactgaagtaggttctttcagagcattgcatgcatgataccctggagcccaaggagaaaatgatcaggccatgcctcctggaatcaagaaggcttgacttcacggcctggaggagataagttttaaactgatccttgaaggtagaggtaggtgaggaactagatgaaaggatcagtattaggtgggcttttaaaatattttctggccgggcgcggtggctcacgcctgtaatcccagcactttgggaggccgagacgggtggatcacatgaggtcaggagttcaagaccagcctggccaacatggcaaaaccccgtctctactaaaaatgcaaaaaaaattagccgggcatggtggcgcgcccctgtaatcccagctacttgggaggctgaggcagaagaatcgcttgaacctgggaggcggaggttgcagtgagccaagatcgtgccactgcactccagcccggacgacagagtgagactgtctcaaaaaataataataaataaataaaatagaatttttctgagtattttgtatgctgttgaaaaatttatcacttcgtagatgtatctcactttgtctatatctaagaaaaaaactatgtgcataaatgaatttttattagctagttaatctagtcagtggaatggagtattatttccagagttccacttcatattccttggtaatattgagacgctggttgtagtgaaaatactcttaattaaggcatgttgtaggttcagagtttagatggctgaatttcatgaagggtcttcaaagcattgggggtgtttggtgtacggtagtgattttcttgtgttcatttgacattttaaagtgatagacgtttaaccttgggctttctcaggactctagaatatgaatgatcactgttaactgtttagaaactcatgatgtaagcccatatgacttatggatttatgcacattctaaacagataagcatcatacaaatataacttgagttttctatgaaaggacagtgagacaccaccccccgcaagtctggcctgaacattggtggactgggaatcataaaaactgatacatacatgtcttactttgtgtttgtttgttctaagcgaaagcatgtgaatatgcagtcatctgccaatactttgtgggccagcccaggcctctgctctgaggatggcccacagcctggagtgccccagtgatcccagcactgtccacacccgcggtgcatccctcctggcttctagtttccagttaacttaagcaaagctgcacagacatctcactgtacatctctctagatttatacctcccctctctaccttcccggtcttgctgcccacacctgtcctcaagtaaaaactgattcacacttaccctgtctctcaaacattcaatgttattttcattttgaaaaaaggctgtgaccctgtgtgtactcgtacttcatccgtctgtgtaatatttaaagtttgtagttaaaatagtgaggacactgagtgaaatggggctgggagcagacttggatcggctttgggagatggtgtaggcagcgatggggacaggtggaggtgcggaccggagtgccgccctctagctgcgagcttacatcctcatgcttgggtgtctgtccttcagtttcttctccagtgccacgtcacctacctgagctgcctcaggtttgctccctgctgctgtgcacacgtaaatcagtgtctggcgggaaacaggcagacgcctttacaagaactagttgccatttatctttttattgttagacctcccagtaatgtgtgaagtctagtaattgcctgtgtgtcagactaactcagttgtaagctctacattatggtgctattaatctcttcaatgtaggcaaaatggggacagtggctcccacagcaagcccatctgctctacccatgtaagttgggagggatgtggtaccgtgtggcttctacttctccatccactttacggttgatgttcatgcttattgtaaaagccctgcaagacctagagatgctgtgagtcctcacgaaggaaaatgcagtgttccgtggggttgtgctgtccactacaggctcttgacttctgaactttctgaagtttgtatatttatccgggaactcatacttaccaagctgtattttaagtttctttcctgagtcaggcaccctccaagctaagtgctgtggctgcagaggcccctgccctgatggagcttgcctgttacttgggagacttgtagcaaacagaggaacaaagaaacaaaataatctgatgacagtaacacatcctgtgacagagacgaacaaggtgacatgggttggaggggtttgcacattagaggtaagaagactcctgtgaggaagagatggatgaaccgaagtgtgtaagatgcagccggaagagccaggagaagagagtttcaggtggagaggccagcacatgcgaaggccaggcacccaggaaactgagggaaaacacaggccaggccagcatggtggagcgagtgaccaacagagcagaggtgtgcacggtgaacaaagcctacagtgctttgccggccataatactaagaggatgagtgtggacctgaaaccccccagcagcttcctaccacactaaccagtggctggctgctggctgagggacggactgtgatgactcccactgggtcccaggcagggagataacctcaccttccactagcatagctcagcggagccaagaaggggagaggacagattcaggacactccagtgcagaatgtcagcggacgtgcatgtgtcctgccaggggagtgaaggtgtggcatgtgagcacggagtgggagggaggtgtgacttatggagactacaggctagaagagagacgagatgccatggttgggtgggtggaggtctctgctgtgggcgtgttgcgtttgagatgctgcttggaccttcaagtggccaagtcatgcagtccctgcagggataggtgaggagctatggaggttgggggctggagacatctgggatgtagacctggagactagattcgttcactggagagacccatggcggtgtagtcagcgaggggcactcaaaggtcgggaagatgcctttcagaaactcagggtgcccaaagcatttccaaaatcatttaacacctccttgcattttcacagggacttggaacctcttaggagataagaatatagggaaccagccatctggagacttctgcagagaatatacattaatatcactgtcttattctcactgactccccacctttttaaaataagggagatggcctagactaggaattttgcttaacttctatcctcctgtcctttttttctgactctgcagttttcatctgaggtagagagaaatgatgcactctgctaaattagacctgaatatctgttgtttttcttagacttgtgaagtttttactaacaaccacaagcacagtcctgaacatcgtataacagcatcatttgttaattttttgaatgaattttgtgattaaccttgatttaacaagaacacccagcccatttcccaacgacacaaattaatacaaatttaatgaaccgaagtgtgcccttctgctgccacgtagctcagttctccagggatggaagctggcctgagaatttctaagtttgacgaacattcagatgttccagaaactatcaagattctgagactgtttctaggaaaggccacaactctactggaaagtatatcagaatgacatttttgaatctgaaaagaaaaaagtcctgtacatttttaattttagttaagagtttgaatctggcttaatatattcttaacttgctagtttgaaaacaaactggtcgatgctcattttcactctcataactgtttcgatatttctgattttttttttttctttaaccaacagaggggtctttggaagacatatgtgcttttaagtttcaattttcattgcaattttgtttgtggtaaaatgcacataacattacatttaccattgtaagcatacagttcagtggcattaagtacagtcaccatctacctccagaactttttcatcttcctgcactgattctccatcccccatctccacacccccggaaaaccaccatcccactttctagctcttgttttgactactctggtgacttcatatagtggaatcatacattaattgtcctttcatatcgggcatatttcacttagtgtagcgtcttcaaggttcacacacctgtgtcagaatttcattctttttttttgtttttgaaactaagtctcactctatcacccaggctggagtgcagtggtacaatttcagctcagtgcaacctccgcctctcaggttcaagcaattctcctgcctcagcctcctgagtagctaggattacaggtgcgcgccaccacaccctgctaatttttttgtgttttttgtttgcttgtttgtttgtttctttgtttgttttttgtatttttagtagagatggggttttgccatgttggccaggctggtctcgaactcctggtctcaagtgatctgctcaccttggcctcccaaagtgctgggattacaggcgtgtgccactgtgcctgaacagaatttcattccatttaaaggccaaatatgtcattgttcgtataaacagcatgttgtttatccactcatccgttcatagacatttgggttgctattccaaaatagcttttggctattgtgaatgatgctgctgtgaacattgaggaacaagtgtctgtttgagtctctgcttccagttcctttgcatatacctagaagtggacttgctggatcacatggtaattctgtttactcttttgagggcctgccatactgtttttctgaaggtttaagtttttgtgagatgtgataaaggtagggtccaaccgtgactcctatgatttgatgcaaaggttaacccactgtatcctgcaagccaaatttagcccttgctaattttgtacaggcaacatgctaaggatatttttaatattttcagatggctaaaaaaattgaaggataatatgtcattatccatggaaattcaatgaaattcagatttcactttacatagttgaagtttcattggaacacggttatacccattgtctgttgtctatggagcagactttgtatggcccatggagtgggatttgctatggcccttcgagaacaaatttgcaggcctggcatggtggctcatgcctgtaatcccagcactttgggagggtgaagtgggaggatcatttgagcccaggagttcgagaccggcctaggcatcatggagaaaccctgtctctacaaaaagtacaaaaattagcggggcatagtggtgcatgcttgtagtcccagctacttgggaggttgaggtggcaggatcacttgagcttgggagatggaggctgcagtgagccgtgattgcaccactgcactccagcctaggcaacagagtgagaccctgtctcaaacaaacaaacaaacaaaacacatttgcaaacctggttaaaatgataaggagttcgacaaagcttacttacgtctgttgactgctctgcccaactccgtgggcttttccaagggtctgagtaggtgcatcaagctgtccacctaattactcacaccatcctacacattatttgtcacttttttgcatgtaagcaccaatcccagttgcttaagcctgcagggggcatttccttcagtaggagatgcagagtgtaaaaactccaacccatttgcatcttgcttatttcaggtacatttcctttcctgtttataattccaaagtgtggcttcctatcatgccttttaaggaactatctattcccattgactaggagataaatctctgtatagtggaggaaccaaactgaggaagacttctcaaaattgttctttttatcatacacttttttggaacgaagtttatagccaactaagaggcagtcttctatttttaatctgtgatatttctgtaaagtcatgtaaatgtcataactgcagtgttttcaagttgttgttgtttttgcaaagagctgttctctgcagtgagggctgagtgtgacttgttaaaaatgaaattcacatagcatccgtttcctccgttagcttctttcacttaaaggacatcttcaacatatcatttaagggcaacacttggttcatagtgtttaatttgttgtcaggaatgtcagcctcagaacttcttaatatacacacccaactctactgtaggtgcctatataatttacatttaacctattattttattttattttattcatgagggtgatcttaggacctgagataaatttgaacaggatcaatacaaatcaggctatgtttaaaccaggaagcagaattaaattctatttttcttgtatttgggttttgcaggaaatggggcatcgtgttttctcttttgaaattgtgtttgaagtgatatttgcatgaagaagcagcctgttttctattagactggtaaagtgggaatagtagaaaagagaaaggcgggatttgggaaatgtgacatgaagacgttgttaaataaggtatgcgtataactaaatgtggcaagaacaatgctacttagatacggaagctgctaaagtattttaatgttctctttacaaaaaaaaatttaagaattttaacatctgctagagctcaatctagtctgaattttttttctcatctgacctttttcatttttcctttctcaaacacacttgctcatttaaaaaattcagttggagaaccaagtaatatgtttccatttaagaaagccacagataaatattgttccatttgaaactacagcttcactcacttgatacttgtatgactattttaagttccttttaaaaaaatggctcaaatttatccttttgggagggactggtgaaaacgtctgcaggttcatcttggtttttaaatttttatgtgtttaattgtggtaaaaacacataaaagtttcatcttgctttcatgtttgcttttaaggtctgagaatattaatagaacaaaaggaacacaacagcattccaatgaccagtgagtgtagctgttcccactgtgtggttatattgtttttttacaagcctacatatgtggctttacctatattttaatatgtgaattcatacagtgtaactataaagcattgtgctcacttagtggcacagagaggttaagttactgactgggggacatgcagccctcagcacgaaattctgggatttagccgagaacagcctcactccaggatcatgctgcttctcagagtttgctagcttgcattgttagagtgtaatttctggaaaacaaggccatactggaatccggaggagagaaagatggcttacactgggtatgagtacagtgtagttgagatgtgcaaacaagatgtaggtaagataaaagaaaatgcaaactaggccgagtgcggtggctcacgcctgtaatcccagcactttgggagactgaggcaggtggatcacgaggtcaggagttcaagaccagcctggccaaggtggtgaaacccccgtctctactaaaaatacaaaaaattagctgggcacggtggcaggcgcctgtaatcccagctactcgggaggccgaggcaggagaatcgcttgaacccggcgggggggcggaggttacagtgagccgagatcatgccactgcactccagcctgggcggttacccttttttggttgtttttattttttattttaagataggtcatgtggtgtaacgggaagctgatgggacttagggtcagacgacctgggatcattcctggattccaatctccctggcaatgtagtaaaaggtctccttgtctttgagatgtcgggacggtgatgcagtgaggggcagggtgttagggaagactaaactcatgtaacacgaagcatgacacgtgtcgcgtgtgtctctttgtaccacaatatccttggacatacatattcctgacctggtaagatgagattctgtatgttttttgagacctcagcatcccatgcccagacactaaagtcacaggggaccatcagagtcccctagtagtttggaaattctgatcaccagtcagcaaagatatttgactgttggaaattttttaaatggtgagctctctttttctgtttcaagattcggtcatcctttctaatagtagacacggaagtctttttgacaaaggtaatgctaggccctgcactggctgacactccatgcagtgtactgtccttccatagcctgtgccgttagtttacagaggtcagtagtacctgcccgccccacagggtttgtgtccaagtgcttcatcgtggtagaagtggtttttaatgaaacaatagatttcttggtcttgcttcaagtgaaatccctgaagtgtttgctttcccgatgatttcatgctgtaaactgcctatttgtggccatggcccatgagcataaagcagcatcattgctattcaggcacataaaagccagatagaagaaaacctcactatttagccatcgtgtcagagagagccaaactacatgtctttctgggccctggtttttaggggattgaatgtcacccagaccttgagtcttagttatcagtgtcgcatatcaagaaaggacactgaggaatcagaattcttacaagggtggcaacttttattttatgaattgaaaaatattcctattcagcggctgtagtcacacaaaactaggcctgatgtaaggttccacacttttaaaaagcattgtatatatttaactaggattctgtagtcatttatattaggaatattgttgctagttgttttgcaagtttccagtagctgtaatgcaactagggaagcatttacatattgaaggcaggagccaccaataatgtacggattttaacagtaattagggtatctgggaattgcacaggtttcattctcgaaaagttaactgaattgcacagatcaaaagtgaaattgattcactcatctaaacatgcactctgttgctttcttggtgagaggaatgacccacctacttggtcttcatggagctcggtctcctcatctataaataatatattaagtgttgatctaagaatctatgaatctgaattttacataatgagagagatgtacatgtgagtgaaaagcaaaaccctgtgataactcatttttgttccagctacaatattgtggactctgtggactaactatagccaagacttatctgagtcaggaaaaaagtatcatagaaaatccaaaaattaattgaaggcagttgtttgtaggtacagcccaagtgactgcataaatttcacaccaactaaaagtgttaaagagtaacaagatgaaggggttagaatgatttgtgatggatacattgtgcattggaaattgtttgtaagacttccccaataattgtgtttcagttgcccaattcctgtttattctcattgtgcagaagtaagttactactcccttcaatataaattagtgtaaattgtgaattgctttcgtctaaaacaatgagagcacccaacatgaagccaggacttggggttcaaatcctactacttgttacctgtgaagccagcctagattgttcacttacactcttcagaaagcagcctctttatctacaaaatgagaataaacagggctgatgtgatggttcagttatataatggacataatattaaatagactctttctttctgaatgggaaagtgaggagttactgtatttagaagatgcataaccagccttgctgttcaagaatgttaggaatgaaaacagttgatatgtggttctcatgactcaattaaaagatgctatgtttgtgtaaaaattaagaatacatttctgctgaacttgtggaagaagcttagagcagaggctgcctgtgcattaagactgagaggacttggaaagagaagatttttaatgttttccttttacattagggtttcctaactgtggcactgttgacatgtagggctggagaactatctgtgggaggtccttcctgtgcactgtaggaggttcagcagcatccctgggcgtcccccactggatgccagcagcaccctctccgtatggtgaccaccataagtgtctccagacattgtccaatgtcccctggggggcaaaatcacgcctgcttgagaaccactgaaaatttccccaatataaacatgcattacttctgtaattttaatagcaacttaaaaaaaaagatgtcatttccaaactgacaaggctagtctgtacagcttcacatattgaagactcagaagagttggactttttttttctttttcttttcttttttttttgagacggagtcttgctctgttgcccaggctggagtgcaatggcgtgatctcagctcactggcaacctctgcctcctggattcaaataattatcctgcctcagcctcccaagtagctgggattacaggtgtgtgccaccatgcccagctaatttttgtatttttagtagagacagggtttctccgtgttggccaggctggtctcaaactcctgacctcaggtgatcctcccaccttggcctcccaaagtgctgggattacaggcatgaggcactgcgcctggcagacttggatgtttttacgaggcgttttgggcttgtgttctgtaagcatcagcttaacagaaagtgatgttgcatgactgccccaaagactcctggtggcagctgtgaaagcatccagggaccaaaacctgtgctgaggttgccctcaggcacctgtgggcctgtcagtggggccattctaagtaaccaagacaaacctgctctacttgtggaatacggatcttcttcttctgcatgttagttgtctagggtcaccttgatgatattagtaggttatctgttctactttagtaatgtgttaggagtgcacagcttaatcaatctaatatgatactgctctaaggtagggctcagcaaactactgcacacaggccaactggcttgcagcctgcttttgtaggtagttttattggaacacatacacatctgtttgcataaacacacccatttgtttacagattgccagtggcttccaggtacacgtgactacgatggctgcaaagtccaagatccttgctatttggccctttagagaaaatgtgtacctaccactgctccatggttctggaactttctccccttctgttgccatatctaggtatatctcccatctgttaatctcagtttcagaaagggggaggatagtaaacagcatagccaaacaagacaaattatgatagagagcactgtgaatatttcaactttattcagtgcttttagtgagtatgcgtgtgtttctctgcatatcagatgcatgtaacgtgtaccagagtgtatttattaaaatgcctggctcatgtacttgttcatgaaagaagcaaaacaccatcgttttccttgatttaaaaaaacggtagcagcatttgtgctggagaactttgatagaacatggcagttgcgtgtaggatattggaccagacaggctgttggggccagagttttaagagggtttctctagaaacagaccgtactaggattacatgggaagtgagtgtggaatacttcgggatcgctgatcgccggttgtatgggagtgaggagcaggacggggctcagtggggagctttctggaatgccagtcccgctctttcctgcatgtctactacccccgtccaagcacttccttggctctagtatgtcctcatgagcagggcccatgacttcccggtgttatcttctggataatttaatacagggttcaggatatttgttaagtcccataaaggtgttttaagtgaacagctgaatggcaacctcagtttgatgatgctctgtctcctggaggggcctaatgtctggctgtctccagtctccttctaacagaccggcatcatcgtgtcgtgttaagttcgcttattaattctctaccaaaggcatctgcatttagtgtccaggaatcactcgatgtttcgtttctttttatgttttctttgcctccgaaatatcttccacagattccctaaggacgtgaggaatggaggaagttgtgaaggaggagaactgtaagctgaatagaatacagtcatccctcggtatctgtggggtattggttccaggacccctgtatataccaaaatccagggaggcgcaagtctctgatataaaatagtgtcctatttgcatataaactatgcacatcttcctgtaaactttaaatcgtagattacttggaatacctaatacattgtaaatactatgtaaataattgttatattgtttttaaaattgtttttattgtattgtttttattttttaaaaatattttttttctttctttttttgacacagggtcttgctaagctcactgcagccccttcctcccgggctcaggtgatcctcccacctcagcctcccaagtagctgggactacaggcgtgagctaccacgcccagctaatttttgtattttttgtagagactgggtttcacaatgttgtccagactggtctcgaactcctggcctcaatcagtcctctcgccttggcctcccaaagtgccgggattagaggcgtgagccaccacacctggccttaaaaatattttcaatccgtagatgcagaacttgtggatacagagggctggctgttcatattttcaaagactatatatcaacaacatataatcaatatataacatatatgagatatatggataatatatatatatatattcagtaacgatatacatgtattcaaagtagtaggtttgttatagacagcatagagaagactctggctttttaaatccagtttcacaatctcggcctcttatttattttgctttgatttttattttatttttgaactttttaggttcaggggtacatgtgcaggtttgttacacaggtaaactcgtgtcatggggggtttgttgtacagattattttgtcacccccagtattcagcctggtacccaatagttatcgtctctgttcctctccttcctcgcactcttcacccggcagtagcccacagtgtctgctgttcgtgtctcagccttttcgctggagtggttataccatttaccacttgctctttgttttctctttgtaccacttactctgtgtttcctttttcctcggttcctgtgtgcttttgcataaattgcggcttttttgtgactatacttcacagtaagcttattagcaataactcattgctttattttttagggtgttgctctagtgttgacaattttcatgtttaaccttatcacaatctatgtttgaaagatattttacttcacatataagagccttacaacaacaatgtgctttcattctccttccattcttagtgctttgtgctacatttgccgtatgttttacttttatacatgttacaaacaccataatacgttgttattaattttgtactaagaagtcaattatatggaaaaggattcttttaaagagaagaaaatatttttatgtttatatttactatttctgccacttatcatttctttgtgggaatccacattttccatccgaagtttttcttccccttcatggactcccttcagtctgtcttgtaatgcaggtctacaagaagtgaattctctctgcttttgtttctttggtaaagtctttattttgccatcattctttgaaagatatttcatctgagtgtagagttttgcattgatacatcctctcagttctttaaagatttcattgtcttctgccttgcatagcttttgacaagaaatttgcagtttttactatcatttttcccctggatataacttttgggttgttttctggctgcttttaagagtttgtcactgattttcaagaaattgattgtgtcttgttggggttttctatgctgtttatcctgcttggagtttgtttagggttttgaatctgttttactttccttaactgagagttttacaacttgatttgatcttggaatccttaaaatgcgtttttggtttttgtggtttttttgagacagtctggctctgtcacccaggctggagtgcagtggccgcgatcttagcttaccgcaacctccgcctcccgagttcaagcgattctcgtgcctcagcctcctgagtagctgggactgcgggcgcatgccacaacacccagctaacttttttgtatttttagtagagatgggatttcgctatgttcgccaggctggtctcggactcctggcctcaagtaatctctccacctcggcctcccaaagtgctgggattacaggtgtgagccactgcgcccagccaaaatgtgttttaagtaacatattttatcatctcagtactagtgttttattaatgaacactaaaaccagttagagaaacactgatgaaaaccagtgtttattatttttacatatttttataactccatattggctccttggaccttttagagttgggttacgagaaagcaattgggcatttgcctggtattatgtagagggtatgcaaacacggttagcttgtggaaaagatatcagtaacaattgcctgtgtaaccgccagctttatgggagtgctccagtagtaacatttttgcttgtttcagctataaaagctattaccacaatctgtctctctcattttgtacagtaatgatccatgaacatactaaagggaaattgatggcatacccagggttaccatttacagatggcagtactgaaatgttaatttcaaaaacattcaaactgtagttttcttctgtagacatgggacaagcaatttttatcatttaatcatgcagacttggttttaaaagaaaactcttttaagatgttctttgcttttaatttatagccttctagtttgcttataacatatatgcttatttttaaagaacattaaaggttaggcctaaggaatttgtgtgcaaaattggtcattgattattaagaaaataatatagaacctttttttatgtcataaatacaactttaaaaggaaggggactcttcagagttgcctctgaggagcacatatgaaaaagaagggcagaggtttactgcagtggtaaaaaataatccacctagatcaagactattccaaaagtgaatttaaaaagaaaaaaagatgagatggtaagatatgaggaaataatgaatgcattgtgactttccacctccccatacccattttcatagtttggtgagtagaaagagaaatgaggatgctggcccaattttgattcccagtggatgaggctcacacagaactgccctgcttcttgacactattatgatattaaaagtaacttgtatttttataagttattaccatcttggcacacttgcattcattttagtcaagtactgtcacctttagatttcaagcttgcagagtcttaaaaaaatacacattggagaacacatagtcttttaacagtaaaatctcagcttattagaatgtttagtgactgaggtattcagagtcagtcagaaaagtatctttaggatttcagcatgtggagatgtctttcatagagaaaccggggagagtcaggcaaaccctagcacgttgagcatggcgtatcctcatctgcacgggcacttagacacctggacaagtccattagcagtaaggcaggatagaggggttcacaggatacgtgctgcccaggatacgtacgtgcagcccagagctgggaggaaatcatgaggaccgactagacatttattgtacagatgcatgactggctggtatggcctgggatatgtcagtgaagatacaccgtgaggttgtgggaggtaggattcacagtaaatcctaaattcttcatctttgcactcacgacgcacaatagctgatcaaagcttttagcaaactgcagcaaatgaaaaggcggcagaacctcatggtgacaaatgcaaaccctggagtcggactgcaagcattcacaccccagctccaccagtccccagccctaggacctagacatggagctgcatgtcagtgtgtccgttccctctgtgtgagaacgggatagtaacagcgctccctcacacgctcctgtacacatggaaaccaccactgccgtcggacacagtgtatgctgtagaagcacttatggtactaagcacattaaatatttaaaattattaattagattatttaatccaagctcaaagctctcagaacagagccaggcatgtaacaggtacaatatacatgttagctattattattattatttaatagagatggggtcttgctatgttgcccagactggtcctgaactcctggcctcaagtgatcttcccacctcggcctcccaaagtgctgcaattacaggcatgagccactgcgcccagcctattattttttaataactttatgtaacccggtgttgccaattgttttgaagtgtggagccgtttttcagatgacacatactaaacatctactaaacagcctgagaaacggcactctgaagagcatgccttggcaaacactcccctacttactctaaaactccagtcgattggcttccaagttcacttggttctcatttttcctggcaacaactctgcaaattattacccccatttgatgaggtgctggctgagaaggccccttgcccaggtatgtttccgacctgcctgtgacaaagtgttagattctgaaagccgggagtgctggcctcggttagctgagtgataccagcgtggggtctttcgaggctgcaggcaagatgtccgcccacctaaaggcaggatgggggctggaggggccgtgtcccggcgcctccttcctgtggctgctgagttggtatggctgtaggcagggggcctcagtcagtgttgtaccgtgctggcctcgccacgagcacccgaaggaattttatcatacaaatttgattctgttttatcaagagatgccagtagcacctccacttccagttgggacaccccaaaatatctccagacattgcctaatatcccctgggagatggcggggggtgtggggagggggcggcagcgggcactgtctcccctgctccagaacactgtattgaaatacagaaacgtgatgccaatcccatgcttttatttgggattaaatgtgtaatccatatgcttctgagtgggaaaaaaaaaaacttggctccaagcagaaaatggtgcatcctttgttgtcattgggcaaatgcttggtagggatttgatctgtgtagaggaatgctcagtctgcagtggcagccaggtagtgagcatgtgcggccctgcacacagcatgagcttgtcagacagacagtgcttgccaagcagggctctggcatgcgcttgttgttggctatggctcttccatgggcaggctcccggctcctccttgtgcatccatcccctttgttggccaccctgcctgctggccttaggccttctgctcctttccccaggtcctggctctctccagcttggcctccctccgcccatcctgtgcacctttcattcctgggtaggaggagactcaggtaaagaaggataaaggcagaacgatgccaggcaattccactgctagccattgccccaaggacatgaatgttcatagcagcatggttgacccaagccaggttcctgtcagctgctgcctggaaaaacacaacgtggttcagccacgcagtagcatagtattcagccataaaaggagtgaagccctggaacgtgctacaacatggatgctctgggaaaacatgctcagtgaaagaagccagatgcaagaggtcacatattgtatgatctcatttagtgccccaaatagggaaattcatagagccagaaagcattctgtggtcaccaggcctgggggaggagggaatgggagtgactgcttagtgggcaccagaactcctttccaagtgattgaaaatggtttggaacttgacataggtggtggttgcataacatctgaacgtaccactaaattgtacactttaatttggccaggctcagtggctcacacctgtaatcccagcactttggaaggctgaggcaggagcatcacttgaagccaggagttcaagaccagcctgggcaacatatcaagacctccatctctatatttaaaaaaaataagaatttttttaaaagaaaaataataaaatggttaattttatgttgttacttttattccaactgaaaacaaagcaaaacaacaacaacaacaacaacaacaacaacaacaacaacaaccatgtatggtccaggggaatgtctatgttgggcctgaggtgtgctgttctggtttttcttaggtgaatgggttctgaaggctgcatcaaaagaggagtctttaaagttgctaattctttcctgataggaaaagaatataatttctcaaaatgactgctttcgaggaatgcccctttctgaatttgaaaacatagtattaaaaagaagagtctctcagtgctttagattattatttcttgtattcgatgtaaaaatcccttacagtggttttacaagtctgcagaggaattcacaaagcacgattgaaaagtgatgtacaggatttatagttgaatgggaacaaaccagctgatctgcatataggatgaaatttagctgagggtgctattgagtttggacaacatttggctggacctttgtaactcttcagctctatgaaacaatagttgtgtgaagaattaaaaggtggaaaatgaactgtaggtggctggctcacatatgcctaggtctatttccagacacagcgaacagtgaaatgacagtgtcggtgaggcaccagttcaaggaaatacacaaagactgcctactcataaatacagacacaatggggtgataactggtgcttgcacttggagatctagaattctaaaacatcggaaaacaatagcagaccattctgtgtccttttctttaaaactatctcttgaaattttcgtgcttcccccaagaacatcctcaaagatgccagtaaaaataactccacaggaatctttctgaattccaatatccatgtgaaaaggctgcattttattctgatttttcacaatagaattaaggcagacatgatgaagaaatgaatgtgtagaggacttccgaaatctgtattaacgtgtgtgatcagcaactgtaatgttttgattgattatatatggtacatctttcattcattaagctaactttaatcaagtatgtgttatgtgtcaagcctggactgtagaaatgaacttgaagaagaaaggactcttcctcctgttcgggtagaaaaggtataatgcgtgttatggatggtgtgaccgaaggaaacaccggataccatgaggaaaattgagatcatcacccagggattctgtattctacttagggaataggctaaacatcaaaatacagcaatttgagacaaaggcaggcggtagtcccagaagggtaggtgtcaaatccccaagagcatcggcggatccaggttcctgttgtgttactatcctgccttcctaagggtcagacaggctctcaagcaacccccatgaccacaagttgtgcacatcctttcccagctcctctcacctaccattggcaagaactcagtagtggaacacctggggtctcttaatgaggtgtgcttgtgtgactaaaagaaaaagaaattttgggggaggagcaggctggtggatgtgcagtttctaaattatcttgtattttatttgattacagtgtttgaattcagtgttttgaagagatgtatgtagcactgcaagctctattctaacctactttctttggagaagcaggtacatgctgtgttgtgtcagcttagagagccccttcaaaacctctccatgttcaatgtggagggactgtcactatacatgcatggcacaccacaccaagaacagagggctaccagaaaattagaatcccttttatatttgtcacatatcagcatttatttagctgtaaaaataaacagcatatggcatttgttaaaatcgtttgtatttcacacaaatatttggcaatatgtaaactttcttgccagggctgtttattgtggttctatttgcatactaataatggggaaatcagtaatgaccaggtgttggaaggtctgatttctcatttaaatgtattgtttctagcaataaactaattatttttgacatgtttcataaccagaagaatgttattaaccaaagtcataattcctatttttgtgttgatcacacacagatgataagttaattatacttattgaatttaacaacatatataagagataatctcaaatttcaagactctcatttgtgggttaccatctgttttggaccaaagaataggaatttgattgcaagctttcttctgaacagcttgtaataagagctgtttgtatattaattacttattgaattattgtggattttaatgttttaatttacaagcaatttggaacttattgtggtgacagctgctcatattttgatactttatggtatttagcaatttcatcataaggctattttttcccctggtaatttataacccaatcctgaaaacagtaatttggtctctccagctcactataaggagtattgtcctgtttcatccccactgcagatttttttcatagttaaaagtatattttataagcaaaatcaagattcctttgtgcctgcttccctggtgccctttcatttctattcagagttacagatgaatttagtttcactctcattattttacttcagtggtagattttttacaaattgccctggttattactttcatcttgaatatccttatggtttttgttttcaatgtactgtaatgcactttaggggcctgtgaacctgcttgtaggtttttttttaatctccttcctttaaacaacataactataaacatgactcagtgggaataatttgcttgaatttccttaaaacacttgagtttctatataaactccctaataagaaacaccttcactcatagcttcacttgtggacttcaattatattaaacctggtacctttttattatcactgaagactattaaataagaatttagagaaaatggtggacatttaatttccttagttcttgaattcgtagatgatagaggataattgatactctctaggaggcaggaatcattcacaaccaaagaaattttataaggtaaatatcattaggtaaatggtttactgattagtgtttatagtgactgagaaataaaaacaatttttgatataaaggattatcattttatgagccataaacctggcttcctcataaatcagtgcaaatggaacacttgtgaaacagaaatgtctgaagagtaaatgaaaagttgagacgttagtgggtgcctttggttttcttgattttagaggagccggaggagaaaggattctgacccgtttgtgtgtttttatgagcacagtacatgaggatgcatatatgcacacaaatgtgcctggtagagttattggaaagctagcccaagcgatggggaatgtttagctaaagcgtgttgtcttctcccgagggtgtgcacaggttcatgtatcagctgaataaggccctgttccaaaaactgatatttcaagggaaccttaatttatctttaaatttaatgtaatttaaaattaatttaaatctttaaattatctttaaataatagcagtagcaatagctgagctaacattaattttatctattttgagactcttttatttcagaacttctacatgcataatgcctgaccggccacttttaatttctcctttctttcactttgcaaacaaaaccttacaatctgtgctatggactaagacagaaattaagaaccaataaaatgtgttaagttttaattaggaagaagaaaaaacctaaaggaacgggatggttgagaggtaaacacaccccaatgatttttaagtcttttgtttcaaacctttccctttctccctaggctggtccctgcagacggcttcccatttttatgaccggatgctgggaagcctgctggtccacaggtccatacatgaagtcaccataaggtaagcagcccagcatgccattggatccttgcccttgtacctgaaatccgtttgaggagcagaactgcattttcccaaaatggaaccccttctgttttaaatgatgttgtcaggggaagtgcccggtctttctccttactgaaggttgaaggtagtagacagacaatcattaaatcattgcgagctgcatagtcaattccaaatgagaaatttgcctttttactgacttctgagaattttgggttgtgtttttgttttgttttgttttgtttttgtttgtttgttttgagacagagtctttgctctgtcacccaggctggagtgcagtggtgcaatctcggctcactgcaacccccgcctcccaggttcaagcgattctcctgcctcagcctctcaagtagctgggattacaggcacctgccaccacacctggctaatttttaaaatagtttcagtagagacagggtttcaccatgttgtccaggctggtctcgaactgagctcaagtgatccgcccaccttggcttcccaaagtgctgggattacaagtgtgagccattgcatctggcctgccttctgagaattttggatcctgaaggagctataacaaatttttctgggtcttaccaggcgaggatgacaccttctaaaatcaacctctcttgtcaacattatcaattacaattatgcagacaagttaattataattgggtgcatgagtatagattttatttggctcctatatcttaattctatgctttatcagtttcttaatatgatttgtgtctgtctccaaattgatttgctagttaactttgaaacttattagaaaatcatggagattactatgtgtaaatctggtgagatgctaaggtttcctgactagcacaccaaacaattgtatgtgcacaggtgtcaagagttgagaagcccgtagcccaaactaaaactgagacccatgccccaaaagttctgtaaaagttatcttactacctttcggtacgtgtgattttaatttcactttacttaattgttatttaattttctgtttctttctctaatgcctttttagttaaaaaaacaaacaaacaaacctgtagaacttgggcagttttaaagtgtaaagatagaattttgaggaagctttttgatttactattttaagagaaccaactagaactaaaatgatagacttaaatttaattaaaataagcagcttactgtttgaggtacttttgtttaaagccagacatatgcatatgtaggttgttttaacaagttaaatatgtataagtattttaatgaaaggtgtagtctgtttataaaaacaaaatttgtaatgtattagtgaatttgaattttctgactggctttttcactcagtataatgttttcaaggttcgtgtgcattgtggcatgtgtcatttctttttatgtcagaatattccattgtgtggctagaccatggatagaacatatttgattcatgcatcagttgatggaaattggagttgtatttcccttttggttattattaaaaatgatgtcatgaacacacatatacaagtttttttgtgtggacatatgtttcatttctctgtggcatttacttaggagtgggtcatatggtacctctgttgaacattttgaggaactgaatttttccaaagtggctgttacaccagtcaatatttttcgaaatgccattgaaccatattttaaatgtcagagggaagcagggaggggatctttctcttatcaatgttttgagtgggtattagttcagtactttgggaacataagcttcaatttcattgaatccagcacacattggatttctcctctgcgtgaggtatctgtgtttggctttatacctcagtcatttatacatgactgagtgtttttgtagcctttgataacttgtatggtttatacatgcagatagtcatttggcattatcctcaaaaatggtactctattgctgtagttcattagtaaggttgggaataacctacataacatactctttctgcctatgctgcgtgctgcgtctcagaaagtgagggcttctaacggtttccttgaggtgtgtgtggtttcaacacatgtcctcctttcaaaggcatccatcgcagaccctggtgatagtgttttttgtatctcagtcttaaaggggttggtatggttatgaggaatgttcacattcaggggcgttcactgttgaagttctcaggcaggaagattccaagccgagaagggactaggcagtccgttctcggatgtagaggtgggaaaatctgtggtagagcaggaaggactgagagcaggctcagcaagcatgttctgtgatgggcccgatagttaggggcttaggcttcgcgggccaggcggtctgtgcggcagctgctgtactctgccattgcagtgtgaaagcagtgtaggccctacagaaatgtatgaacatggctgagtgccaagaaaaccctatttatagacactgatactgggttgcagtttgctgaccctaacctagaggaacacaactgttttctttccaccttttctaattgtggccttttgagttggaggccacctggaggtgaggctccgagaggcccacccaagggccatgatgtgatgaagacagactctaaattgtgattacgtagcgaaggcactgcagatatttgggggtcaggacttttacgtaaggaatttgagggcctttctgccacataagagggagtggctctgggcctgtgtaactgccctaacttgggttctcaccctgggggagtctccacccccaagataacctgggaatgtgtggagacatgtctggttgtcaccactgggggagtgggtgctactggcatctagtgggtagaggcccgggatgctgtcaaatgtcccgcagttcacaggacatcctccccaacccctaaatgtcaaacgtgaggagattgaggagtcctgctcaccgctgcttctgtcagccctttattttgtacttgttgtcagtcatatggctgtggaattataggctatggggcattaaattacaaaatttagtacctgtgtttgctgacataagtgtaaggatggttggactctgatctaatatttgggttcatgatgcttttagttttttccttttttaaaaacgtctttgtcattcatttaaatataagcctccaaaattgatataggccaggcacggtggctcacactttgtactccctgcactttagaaggccaaagcaggaggatcacttgaggccggaagtttgagaccatcctgggcaacatagtgacacccccatctttacaaaaaaagtaaaaacataataattagccagaggtggtaacacatacctgtagtcccaactgctcaagaggttgaggcaggagaatcacttgggcctgggaggttgagccttcagcaggctatgattgcaccactgcactccagcctgggcaacacagtgagaccctgtcactaaaacaaaacaaaatgctgatataacactaagatttatatgagatccaggccacattgggggatggggcaccgcctgcctttcgaactgtagggtacgcttcagagtttatttttcacaacttcacaggccacatcatatgtgtaggtgaacccactgctgactccatctactgccagaaagagactcatcatggtcaaattaaattcttcatatgtcagtgaaaaatcagtgtcttagagatatcatgaccagagtgcatgtattcctgaaatttgtttgaaggcccggtgcacattgtgtagaaactgtgttcagtctatctaaaagataattaaaatccataaattaatttctggctggaaaataggtcataatggatctggatatcagaagtgctaggttaaagaccacggtcatcaggaaaataggatgagctcctgctccgtggaagcagtagcatcagtgccttccaaggcagtctgctctgaaatcttgggcacgtgcatctgtgttgaactgtggccagaggaggagaggatgaaagggaggcagtgctctttttcttacatgcattgtccggctcatgtgatgtgggtttccctggtagtggcttgctcttgctaggtggagcattttcaagagggcttccttcctgtcaccatagcatctgccgttgacgtgcatgtgggctttggatgaaagccccagccagccactaattaacccagaagggtggcagggcacagaaaggaccttttctgaatgcctcatcatggggattttttcttttcttttctttttttttttttttagatggaggctcgctctgtcatcctggctgcagtgcagtggcacaatcttgggtcgctgcaacctccatttcccaggttcaagtgattctcctgcttcagcctcctgagtagctgggattacaggcgtgcgccacaacgcccagttaatttttttgtatttttagtagacatggggttttgctatgttggccagtctggtctcaaactcctggcctcaagtaatcagcccgcctcagcctcccaaagtgctgggattaacaggcgtgagccaccatgtcccgtcagggatgattttattctgtgaaaagcggcattccttttctaacacaaaacctctcctctgctctgccctcccaaccctgtagcctcatttcctatatagttgttttcatactgattatctctgaagacattgccaggtcgtttttgtttgttttgagacaaggtcttgctctgttacccaggctggagtacagtggcacgatgtcggctcactgcagcctccacctcccagggtcaagcgattgtcgtgcctcagactcccaaatagctgggaatacaggggcatgcctccacacctagctaatttttgtattttttgtagagatgggtttcactgtgttgcccaggctggtctcaaactcctggactcaagtgagcgaccacgcccagccgacattcccaggttttctttacgttttaataaatatgagtagtccatgttcagagtagaaactatacaacgtgtagaaagatacacatgcaattgggagccgtgcttttcccacacagtcccctgtcatggacattgcccctgcctgaaatgctgttttcctggccgcatcttatgccactagtttattccatatttaaatggaggcgtcactgctcggcattggaactctagtaacgaagaaataattctttgattatatttaccatttcagaccattgactccaagtaaataaatataaccgtaaaactaatgggaaattttttactttgcggggaatattttcgtactgaaagtattgtatatctgattgtgggtaaatggagagaagtgtatgaaagaaagcaagcaacataaaatatttttatgcatttctccccaaacttttcctctgtatgtgttttcctacaggtttgggtcaaactgtaaccttgttggccctcttttctgttttgttgtcgccccctgccacccaatttgggacatatcataaatatctttccattaacctagctttgaaatttttaacttgcactggaagaccacagcgtttaatgtcaaacaacgtaactttaaatcctagcttcgctgggatttaagttggttatcttccctaagcctttatttgttaaacctataaaatggtaataagagtaatggtcatatttatctcttggagttatgactggtgagatcgatcgtatcgtgcacatagcactcacacctgatagctagcatacaatccatgccgtgtattggtttctaaaatcatcttcatggcggcctgatagttcccatatgtgttcactgcaatttatttcatcgtgctgtcactggacaatgagattgtttcgagaaccacacattgtcttctttacaattacataggatgaaaagatgtgcaaagtggtaaaacaagcctgtgtcagcccccaaataagctgctccccaggcagatgttagaaaaggtgtattgggatttatatgtaaactttatacatacatttaaaattctgtcttaagctggttactgattgtgaaatgaaaataaactcagtttacatctgagcagagaaaagagccgctgcctccaaatgggcagagtttgctcgtttccatgaagcaacttggagaaagaggtgccctttagaggctgaggtcagttcaagcagatcttccagtgaccctggctcggtccagtctgcatggagacaagccccaaagacctgagccttgtccaggccatccctccaagcaatggattcttccagcacagacgccaacagcctgactaatagcagcctaactaatgacactcactttctcaggtgccttcagaaaccaagggctgctttagaagatctttaagatgtttacataacagggcaaatggctgaaagataaagcttcccctccagtgatgtcagaggagctctgtgcgctgcccttcctacaatacacgcccccttcatcagctcgtgcttccttcgctgtttcagaacacggctggcctcttggcaagaaacgaacttgccctttctgtccttaactaccagcaccagctctccagcaggccccatgtgattctactttttaagataattaaaacagcaattaagattttgtttggggccagtgttctcccacagaatgatggcatattgagtgctctaactacatactcaatgaaatgaaactcttaaacagccatttctcctgggaccgaatgctgaactgttttgtgaagggaactgcgaattaataggacttttggccaccttgaaaccaaggcttaaaaaaaaatactataaataatctccccttcagcttcttgacggctctaaaccccaaattatcacttatattgaattacttatctttagcagagaaacttcaaaaatgccatcagcccatgctcgtttgttcttctttgccttctttaagcagcacagtgagagaatgttgtggctttaacccaaagtggaaggtggttatttcgtttttgcgcaatcacaactccaaacacctcaaatcaacctaattgaaggtgtctttaatcaaagctgggtcaggcaagaaaataaacacagttgctctaattaagactcccctctcatccccctcctgtttggggccaaggaggagctgtgagtgctgccaaaactctcctttattttagaactggagaaattggaaaacatccacaggagttctcagaactcgaaggctggaagcggatgctgttcgggaaaccggttaggtgttagaatgcggcttgtgtctccagctgtacatactagaaaagaatgcccaaacacaggcctctggtggtagttctttttggttgggctttatgtgtgccaccttgcctgcttgacattgctgatgagccaggacgaggagtcgagccctgagtggtcatgggcgaggcaggtgtgtgtttccctgatcctctcctactgacctttcaggtctctcttggggaattgctggaggagctaaaataccagctcccacatactggatattttctgtgcatcgggctctgcataaaagcattgactcctcacactctcccctttacataggggctatttgatactcagtttagagataaggaaacagccatataactgaccctccaatcccagggctagatagtggtgcagctgcccctagaagtcagggtctctggcgcttggccaaaggctccctgaatcccacatctttacctgttctctgtggctctcaggacgtgagctaccttatctctagccaataagcctatacggatggggactctcaccctgatttaccctaactttattgtaataaagtcataactgtcataagaagtaatagttgcaataaaaagtagtaattgtaataaagcatgaacattccaaactccatgttatttgtccacaaaaatagttcttggcacagaagacaaaggcggactttttcccacagaatacatagctgtcgatggcactttgctttgaaccttggtgtagagggcagtcctcatgccctgggctgaggggtgcatgtgacacatcattaaaagtcaaaaatcattttcatagagcaggtcctccccacatgtacacccagagctcctgtgcttctctcctctttctctgacttcttccaaaatcgtgggtcttgtctccatcagtcaagaatttaacttttcttccaaaacatccccctcctcttctgtgaaggaaggtgcttgtggactggccttaggaaatgtcgcccagacaggaacggcacaccagtgtgccatcactcaagccagaaatgaggtttgcagtgaccttctctgtgcttgagagttctgctacactacgaataccactataataacagcacatttatttgtgggaaattaaacagcaaagccctgggtgggagatccataatttaccatcttcctgtgaaatttagttctggtcttagaaaaaagaggaggaggaggaatttttattcccagccttgtgtgtggtgaggtttgtctggaacagtggttcttgcagaggaatactggccaggagactcacttgagtcaaaaaactgaagaagatccatgaaaacaaccaccaccttcaagtgagccacttagagataagcgcagctaaacgccgggacacccagctgatggatggtttctcttgattttggtgtgatgaagcccacagagctgaagggcattaaatacagctgttagggttaggagtccattcagagaatattctcatgcttgtatctaataatctaagaatatatatgtagattctacaatttttggaattaggttttaaaagaaaaataatcatttaaaagctagcaaagtaagtgtttgttgggggagaaaagtttgatccaaatattaaatcagtcttaaaaaattaaaatatgtacttgagatggagcagtcagtcttaccaaacattacatcctggctcgattgcaggccatggatagtttttgttttgttttctcttctgcttagaaatcaaaaccctttagaaagttaacaatgtattggggaaagcattccaatccttggaccctaacttatacatttaaaaacaatgaatctgtgatcagaaagcagaaagccagagctgaagcagaagtttttctagttggaagaaagaaagatgtataatgcaaattagaggaacagataattaaaaatggcccgtaatccccatctcctcaggatcttatattctcattctccatagttctatataaacacatgcagagacacctgtatttatcacagatgctcctggggtggggaatattaaccaggctgtgtatacaggtgtttcatctccacgaatcagagtatctgctcttattttgaggcaagatctcactctgtcacccaagatctcactccactcactggagtgcagtggcataatcatggctcactgcagcctcagcctcctgggctcaagcaaacctcttgccttagcctcctgagtagctaagaccacaggcatgtgctaccatactttgctaatttttaaaatttttttgtagagagggcatctccctatgttgccaaggctggcctctaactcctaagctgaagcaatcctcccatctcagcctcttagagtgctgggattacaggcatgagccattgcgcccagctggtaccttttcagtggtcaggtcaccaagcagcgtctgagcctgcaccagttgccttactttataaatggagttcatttcaaacacaaaatgcttattttccctctaaagagcaatggttctcggccagctgcagttttgcaatgtgggacatttggcaatgtgtgcaggcatttttggttgtcaccactgcaaggaggttgggggagtccaaggatgctgcagaacatcgtgctgtgcctggaacaggcttgcttttttttttcccccagagtaaaagaggaaaggagctaggcatggcaaacaagaagggcagctgggaagctggggtgtttgccaggtcctgccagacatagtttcctctctgtgcctcagtttcctcatctgtaacatgcagagatgagatgccctccaagattggtcctttccagctgccctcactgggagggggcaccgtgccctgcctcccaggctgactcgtcctttgtaattctcttcctttccacgggactccagattcatgccggtcccactagccctgttgccctgttcctaagcctgtccagaaatccttgggactaagtgaggctgaagctatagcgctctgctcttcctacctttttaagaggtcttacattgtaaaacttcaatttttcaaacactcactggctcacagaagaaaataaaataaaaagctgcaattgtgaaaatgtaattgctcaactttagctcatgctccagatcagtgattttctcttttagccaaacttctttataattatttcctttatttttataatagattcttcaaaattaatttcaaaattccttatctaccgtctttcacaaatgtatgtatagcctagagaattttggtaataattttgtgatacatttatattgggatttgtagctgccagcctttttttttttttttttttttttttttttttttttgagaaagggtctcacttccgttgcccaggctggagtgcagtggtgatcgcggctcactgcagcctcgacttcccaggctcagatgattctcccacctcagtctcctgagtagctgggactacaggcgtgcaccaccacactcagctagttttttcgtttgtttgttttgttttgtttttgtagagacagagttttgctgtgttgcccaggcaggtctcaaactcctgggctcaagcgatccgcctgcctcggcctcccaaattgctgggatgataggtgtgtgccactgtgcccggcccaagccattttttcagtccattctttttgctcctcctagtaacccttcgtagcaaccagccttccattgttcagtcaccagaagttaatgatagaaaaccagagatttctagctgtgcaagatgtagagagaaacctaaactctatacatttgctattggcactgtgttgccatagtcactgcagcactcagcatcaccaaaagcctgcccagtgctgcaacattctttagatagatttttgttgttttattttgtctccttaaataatatttaatttttcattaggtcatgctatgatttcatagcttattttgtctctaatattttcttctgcatgctgtcttttgagagacctctccagagttcaagcacaaatcctaggacagacttgtattttgactgtcaaattttcattgcagtatgtgcaaaagtacagaaatgtcatcaaattaagcaaagaagataagaatttttgaatggcagtgttctggcaactataaaataaagtctattaagagtgcaaagtgagaggtggaatgtcgccagggcagctgcattcattatctcttgctggataacagacgaccacacgtttagcagcttgaaacaacacacattcattctctcaccgtggctgcgggtcacgggtccaggcacagcacagctggggccagtgctcagcgtcccacaaggcttggtccgggtgtcagccaggctgcgctctcctttaagctcaggggttttcttccaagcacaggttgttggtagaattcagttcctgtggctgcaggactgagaccctcagctccctgcaggctgcctgccattgcctggacagatcatgcaatgtggtgttaataatcacaggagagaaatgtggtcaaccttgccatgtaatgtaacctaacctagggagtggtgccccatctccttgacgcattctggaagcaagtgacagatcttgcccatactcaagggtcgggagtataccagggcaggactttgtgggggtaaggtatgtccctggcagtaaccattactttgaatcctcccattaaatgtaaaatatcttccaacttgaacatatactttgtacttttctccccctaaacaaacaaaaactcaatcctcattcaacaatgaaagttttgctgcctgtaaagatacttgcaaatgtgtgatatagacaccaaagacagttcccaaacagcctaaagatgtttagtgctggccgggcgtggcggctcacgcctgaaatcccaccactttggaagtctgaggcaggtggatcgcttgagttcagaagctgaacaccagcctgggtaaaaccttgtctctacaaaaagaaccaaaaaattagctgggcgtgctgatgcccacctttggtcacagctacccgggaggctgaggtgagaggattgcttgagcccgggaggtggaggttgcagtaagcccagatcatgccactgctctccagcctgggcaacactgcaagactctgtctcaaaaaaaaaaaaaaaagaaagaaagaaaaaaagaggccaggtgtggtggctcacgcccgtaatcccagcactttgggaggctgaggcgggtgggtcacgaggtcaggagatcgagaccatcctggccaacatggtgaaaccccgtctctacaaaaaatacaaaaattagccgggcgtattggcgggcgcctgtagtcccagctactcgggaggctgaggcaggagaatcccttgaacccaggaggcggaggatgcagtgagctgagatcgcaccactgcactccggcctggcaacagagcgagactccgtctcaaaagaaaaaagatgtttagtgttggtgacatcattgacgttagttgcagcctttctggggctgcccagctgtttggagtgagcagctcttactgatgtatgaattctggtttgttcatggacaacagagttctttccttgcttgttccctttgggctggtttgctcttgtgtctaaccgggtggtgtctaagaaaaccagactctgtcttggctgtctcacacagaagcccctgaacgttttcctgcccatcctccctccccagatttctgcctgccttctgggcaccagaagtcttagccagacggatgcagcggattctgtggtgaaacacaaatgacagaggtgctccctgccttctgtgttctggttttccaccaggagccctggcctccttgcagaaacatcgaggtgacatgtagcatgaccgagctcgctggcgcctcttcatcgtgctgccaccgccctgcaggaagaggggccatgcagtcagtcttgcaccactttcaacgtttgcgagggagaggtactgcggttcctcatgtggccaggaccgtgtggtcactctttgggggtgttgacatggccgcgggtgtactcggtcacctctccatgtgtccagaaaagtgctcagtgttgaatccctccacgtctgcctgagtgcactttgggattccattcctgccgcttatggggcgcgctgcggatccctgcatgcacagagctttattgaacgcaaagtcagttgtttgttgtcgtgctctgttgcccctgcttctggcttcattcatgtggtttttgctcaattcttccccggccttaggaaataggccaactcttgtttttttggaaaacatttcacctgggcatatttttctatctataattacggaatttttatgtaatcacataattataaaatataacacaatcagatattaattaccttcatgtgtataatagcatggatattattttctttagtcatctcaaaaaaaaaaaagagaaaaatacaagcagtgtttcaaaactctcttctctttttgaacagagggtggttcccacttcatcaacacctcatcgccgcgaggtgaggctaagatgagcataaccagtgacgaggtgaactttctggtgtatcggtatctccaggagtcaggtaagaggcttggttttctgtcggtaggaaattcatctacagcatcttacaagcagaaggatcaacgcttaattcaaaaccaggctgtagaagaagaagaagaagagctaagaaggttcttagtgctgatggggagaagagaaggttctggagctgtgccatccccgggtggaaagagggaatgtgttctttcttcccttgacacttctgtgcagatgaatcaggcaggaatcaagagcggttgtggtgaatgtggaaaggacggaagcagtgcggggctcttggcctccacctcggcgagggcatgcatgagctggtgtgtgtgtttgaacctcttcgattttgctccagagatttattcagctccccagcctcccctactccccgccccctaaatgggctgctaggcaattttctaaaacttaggaatcgtcgtagcatcttccaacatttttgattaccactgagacattactttatggttagtaagtaaacagccaatcacatgtgttcgttgttgacaagacagactttgagctgagcagctgccctcctccgccagcagggaagtagtgggaagaagccacggagcccagggcttgggttctaacttagaagatatgtaatttaagacctacaaaatgatattggtgaaaaacgtcctgatacccacctacctgttcaacttaaacaaacctctcaggtgcattggaaaccccgcccatgtttgcctccccgccttcctcgatgatgatgaccctggtggacttgctgtttgttatctccacgtgtttattacacacagccgttttcctaagcgacatacggtgcaggtggattcgtttcctagggctgctataatgacgtaccgcaaactggggtggcttaaaaagaaatatgttgtctcctagttcctgaggacagaagtccaagatgaaggtgtaggcgggtcggttccttctgaggggaagtctctcctgtgcccctgcctggctcctggggccttgctgcagtctttgaactccttggctcgtaggcacatcaccctcatctctgtgttcagatttgtccacatttccccacggtaaagacagattggattcggaatttaccctcctccaagacaatctcattttaactattgtttttgaatacagcaataattacatctgcagtgaccctgtttctaaatagtgtcacattctgaggtgcgctgttggtgaacactgcaacctgtgaatttgtggaggagggggcacacttcaactcataacagtcggtttgggattttaagttgggttttaagcttcgtgcccttgatatcagattgtatatattctggaacttgattatttgaaaaggaaaccccagttcctaggccccgtcctcccagagatgcatgtattcgattggagggaaaaccagtctacgatcctctaggcttgagttctctcacagctggcctggtagggtagactgtacgcattggagccacacagaatggctcgagctctgatcctcgaacaagtctgagtgaggcctgttcatttgagcctgggtttccttgcccaggcaaatgtgctcaaatacgtcaggcacgtagcacattgtaagtgcgtgccttccccatccaagcctgggtctctgtcccttgcgctcccagctagtgttattcatggaaagtacacattcttttctgcatatatattagatgcctgtgattggctgttgccagaacatagtataggaagttggtatacaaaacaaaatatgtactgcctcactctggaaatcagggaaatgataaccgctctgctaatacctcaacctcggctcttagaggagcacaggtgatctcctgcctcagagcccatagctttccagaggtgcctgcaaatggaaatccatgtaccaaaccctgcttccctgtcgacttgtggcatggaatttgagattctttccatttagcaacacctctgcacaaggacacgatgaaggccaaagagactcacagctcttgtgtaaacaagtcccaggctggaactgtccggtgtgaaggaccacgtgctccggtaacctggagacagagccatgctgctggctggtccccagggggccacggagcatgagctttgctggcttcttgaaataaacacagaaacccccatccctccccagaaaggtcggcttccttattcagtgtttgtttatgaagcttctgtaaccaggcagctgagagggagagttggagcacaacaatgcatagaccttggcaaatgtcaactttgtgtaacatctgtgagctccattcctgattcatcagtgtcactgaagtataataacacttcttaggcagagttgatattgaagagagagactattacaccttcttcagctcactgtgtgtattgtggaactttttagagcaccctacaaggttgtattcaaaggaagaagggagcaaagaaatacttaatgttgaaatgttcattctggggttattttctatgttcgtctcaagtcctaaagttttggttaggtcaatagtcattgagcccccatcaagaaagcacaccttctcagcctatcgctgtctcccttctaccttaaataaaaaggaaaacatttccctgatcatgcttcctcctcaagcacctgtactcttactcctgcaccccaccaaactcattaaaaacaggttctgcatctcagaagatgattcattcctcagctccctccactctggctttctccactagaagttgtcagtaaattctgggttcccagatccactgatcttactgcaactggcattcctccttccctggtcatccctccttacctgtgtgtggcaggaagcgggtgggggtgggcagtgaggcagggagtaggtgtttccctgcagtgcggcaggacagctgcttccctggaaggtctgctggaacactcaaccccaccttccaggtacagtgacggacaagttttccagagtcaccaagcatgtggcctgagccctgcttctctgccctggacccagcagaccaggttgccgctcctgtccatccattcatctccttcaccagtgcctctcttcctcccctctgccagtatccatggtgtcagttaggatgtattaggctgcaaggaggaatcttcagtggagcactgatggcctcagacagccgggaagcagggtgttgaagaaggatccaagacacatctcttcaaactcggaaaagaacctcaaaaacagatgtgttttgttctctgcccacaacaggcagaagtcaggtcatctggcttttagcaaaccacatatatttccctacctgtgtggattagtggattttcattgttgcccttgttacttgtccaaagcaagggctttgcccatcagaagcactcaatagctgttacccacaggcgacatctcatagcagcagactcatggcagtctgaaagaggaaactggttaaagcaagaatgttaagtagtagggaacttttgcattaccaagctctagtgccaaaatggatttgttggtttttgcatgagttcagcagtctggctttgacgagtgatatggtttggccatatctcatcttgaattgtagctcccgtaattcccacatgtcatggggagggacccagtgggaagtaaatgaatcatgggagcaggttttcccgtgctgttctcgtgaaaagtgaataggtctcacgagacctgatggttgtataaaggggagttcccttgcacaccttctctttcctgcagccatgtaagatgtgactttgttcctcattcaccttctgccatgattgtgaggcctccccagccatgtggaactgtgagtccattaaacctctttcctttgtaaattacccagtctcaggtatgtctgtattagcagcatgataatggactaatacagtgtgtgagtccattggcctctgtcttacgggatccattgcctggtcacttgtgctatctgggcagtttttaagaatcacatggtggccatgtgcctttcccgtgagctcgtgttaccatcccaggaggagagaagcaagggagcgagcccctagaaatgtgcacagcctgcacctgctgtagtgagcagctcccccaaatgctgggggagtcgtgagttgtgtgcccccgcatatttctgaatacagccagggaagtggaagtccattttccacttagtatggaaagagagaaaatttggcaagtgagtccctgtaaacatattatttcctctgggacttcatcccaaaatccaaactataaagaaaacatgttctcccagacccacatttttggcataaattaaataattcacaggaacttgcaaaacggtatgaggaatacagggggacagaaccacagattcaaactgaatttaactgagaaagagctgcctgcaagataatcgggtgatacattcaggggaaagggaggtactatgaaaaattttgttttttgagactcactcatgctgagggtctcactctgttgcccaggctggagtgcagtggcacgatcacggctcactgcagcctctacctcccaagctcaattgatcgtcccacctcagtcgcccaagcagctgggactataggcttgtgccacaagaaattatgcccagctaatttcttattttctgttttattttatttgtagagacagggtctcactgtgttgcccaatctggtctcaaactcctgggttcaagagatcctcccccccggcctcataaagtgctggcattacaggcatgagccactgcgttacctggccaaaaatattttttaaagaagtagaagatactgtctgaagaggaaagaaggaaggaatgcgcggagctggcttgagcatagtcaacacacaggacagttctgtcaccctcaaaattgccttgtatccctttgtactcagctcctcttccacccccaccctgccccggcaaccaccactgctctgtccctagagttttgcccttgcaagaatggcatagagatggcatcacatattgtgtggtcctgagagtgtgacgtctttcactcaaccttatgcatttgagattcatgcatgctgttgtgtgcaccagccattcattcttgaatagctaagtggtgttccattttgaatgctgtttctgcgatttgtttatgcatcctcttgtggagggacatttgcgttctttccaggttttggtgattccaacataaagctacaaaaaagattttcatacaggtcatttgtatgaacgcaggttttcatttctcttgggtaaatatcttggagtggggttgctgggtcgtgtgacaagtgtaggtttcactttaccagaaaccagtgcattcttttccatctaaggcagaggcaggacacgtcgtaaacatgactggttttatagacgtgagttgagtcacagaactcctctgcctgtcgcacaaggcatactggaaagtatgtaaagggacgttagctctggcgtatatatctgcaggacgctcatgaagtgtgattcttcctttgaggatttgcagctagccttctggactaatttcatgaacctgtcagggtcacagtttccatgggccgacatgaatgtagcccaggtcggctgaatgacagagcgtccttgtttgcataccttcccctccttaagcagtgccgttggtctaaccttctgcttaaaaatagaaaactctatacagcctcatcagccctccggtggataagcccaggcatctgggcaaggcaaaggccaggcttccagatagcaggattccgcaggctgggccctgtggcggccacgaaagctctctgtgcatttgcccacatacccatggtatcaaagtcatcgaaaacccagcgaagtatttccctacctggagctttgtgactgacgtccacacaccaccaggaacaggcagacaagttaataaaaaccatgtgatgatggtggtggcgacagtactgaagaaaaagaaacacaagtagaaatggaatttcactaacgttgtgtccggcacagggatgttaccaagttccgtgtccatgacggcagtaattttaaacactgtagctactaaaaggagcttgtcaccataataaatggtaaaaatccacttctcacacacgctgaattcccagagtgaggaacttctggcttagctctaaagatttaaagaccctagaggatggttgaaatctccttattcagtggaacttatgttctgatttgccctgattcgtagctgagaggccaatttattatacatttttcttgcctccattaacgtcaccaaacatgggttattcagagtgagagtatcactagttatcaaaagtgagcatctacactctgggcactcttgttttcctaaagagcccatttctgcacacctgactagctgggtagaagtaggcatgcttcttttatttacataacgtatatatggctctgtgttatatgtcatccttgctcataaggaggatagttgctatggtcccaatgtttctgttcccccgaattcctatgttgaaatcctaacccccaaggggatggtatttgggggtggggcctttaggaggtgatgaagtcatgaggagagctcctttgccccttctaccatgtgggaacacggtgagaaggcaccatctatgaatcgggaagcgggttctcaccagacacccaatctgccacatgttgatcgtggactcccagcctccagaactgtgaaacacacatgttgtttataagccacctactctatgtattttggtagagcagcccgaacagagtaagataatagtgaagtagtacatccacatgcccagactttcagggttgtgaatataacttagtgacatttgtcattcatttcgtgaagcttccatgccaagaaaatcattaataagaaagatttctacccagtgtggaggcccacgcctataatcccagcactttgggaggttgaggtgggtggattgctttgagcccaggagttcaagaccaacctgggcaataaatacaaaaattagccgggtgtggtggttcatgcctgtagtcccaactactcaggaggctgaggcgggaggactgcctgagcctgggaggtcaaggctgcagtgagccataattgtgctattgcactccagagtgggtgacagagtgagaccctgtctgaaaaaaaaagaaagagtcttgctgggtgacacacttcacctgcagtgcttctctctggtggcgatgccattcaggtgagttagcctcagaggagtgcatggaagagtgagtgagacctcagcggcctcctctttccacaacaaacccaagcacagagataaaaggctgtgctgagcgcccaccaacacgcagcgaggttatactgtccaaaaagagtacctggcagatgacccagcaagttcacagcgggtaagctggcgtgggtctcggttagagtgaggtggagcggaggggaaggttccctgttcttcaacactttctacagaaacataagactgagggtgaagtgagatcccctctgaaaaagcaccaggtgtcttgtgggggcctgatgctgagggatgggttgtagctcatgccctgtagaagagaacactgttcaaagccaaccagtctggattcaagaggggtcctgggagcttcagtctgtccgtgaaagaagcacttccctgaggcttccctgtgttccaatgcccttcatatcctaggcctctgaacagggtgctgtcagtcgagtgggattcatcatcctcaagtttttgccggagtggaggccaggctgtgtgctgggctgatctcctcctgttgcatctgtgagctgctgttgtgaggacagtggcttgagagagctgaacagaaagacatgccccctccttccaagactgacctcacactttaggggagcagtacagtgtcctttagaacacctcagcggaagcaacccagatgtccattgacagaggaaattccatcaacagaacgtgtccatccatacagtggaatatcatgactcagctttgaaaaggaaggaaattctgacacaggctccagcacggatgacacttgaagacactatgccaagtgaaattagccagccacaaaaggcaaatactgtaggattccacttagaagggatacctcgaggagtctaatccaaaaagacaggcagtggaagggtggttgctgggggatggggagaagcaggggacgtggagttgctatttaatgggtacagtttccattttgcaaaatgaataacgttctggggatggttgatggtgatggttgcacagtagtgtgaatgcacctaatgccactgaactgtgcacttaaaaatggttaagatggaggccaaggtgggaggatcactggaggccaggagtttaagacaagcttggacaacgtagcaagaccctgtctcaataacaaaaaaaattttcaaaaattagccaggcatgggctcacacctgcagtcccagctattcagaaggctgaggtggggggatcacttgaggctgggaggtgaaggctgcagtgagttatgatcacaccattgcattccagcctggacaaaagagtgagaccctgtctcttaaaaattttttttaaaaatggttagcatgatatattttatgttatatatattttaccacgattttagggggaggtcatggtattataggtgagaagttccatgtgtagattgtttttcagagtttagaaaattagtctcaaagggaagagagaaccacctgtattcacagtaatattaatattactaatattacatgataagggctttttcatagtcccatataagtgtttggggcaaatccctggcacagctagtatcatttgtaagctacattggtgtctgacaaaatccagttatttaaaaaacagaaaacagtggcttatttataatagcaatattctggacatatggccagtgtccatcagtgggcgtagttgaagcaagctgtggcatgcctgtgccgtggagcaccactcagctgtgaaaaggaaggagttgtgggtaggcacagcaagctggaggaacccccagagaaatgtgccgagtagaacaggccacgtcagaagattgcagactgggccaggtgcggtggctcatgcctgtaatcccggcactttaggaagcctaggtgggcagatcacttgagatcaggagtttgagaccagcctggccaatatggtgaaaccccatctctactaaaaatacaaaaaaattagccaggcgtggtggcacatgccagtagtcccagctactctggaggctgaggcaggagaaacgctggaacccaggaggtggaggttgctgtgagccgaaattgcacagctgcactccagcctgggcgacagagcgagattctgtctcaaaaaaaaaaaaaaaaaaaaggaagaagattgcagactatatgattccatttataggacctgcttaaagtgctgaaaatatacaggtggacaccagatcagtggctgctacagatctggagtagggatgggagcacgtgcgtacaaaggaaggttataggagagttcttttgtgttgaatgaagagtttggtaccttgaccagagacacagttccacagatctacacgtaggatcaaactgcatagattatacgtacacaaccagtgaatgcagtgcagaaaggatgacgatagtttgtgttccagtgagcatttccgtcctgcctcctacttagtggtgttgatcctctttgacagtagtgtaagatgcctagatgggaggagacaggatgaaaggtgcacagcacttcactagttttgcagtttcccctgagtccatagtaattgcagaattatttaattgtaaaaaagactataccaaaaatgtaattcaatgtttctattgtctgcaaagctttgtgtgtgtgatagatggtggtccataatgcaaaggcagccaagacatttttattatatttcgcaggtcattagccatattgcaggcctagggctgggtgggggtactctcttgtgtaatggattcgagtggcagccctattaactgagaaatggatggccacacagacactgtggggccgttggaaacagaagaatcagctggaagcaaacagcatttgtcatacggacattgcttgaatgtttgcagactggggactgtcgtttctgggtgggctgcatttttactgggggaaaaagtcggtgcatggcttcttccctgctcatttaccagtgagtcttagaatgcttttacaatatccacttagaaccttcagtgtggaggattctgttagatttatgtgttcagcctgagagaagtgggcagatttgagggtcttaacttctgaagatgttgtgaatggccacaacatataatgcattaactcaacattttcagcccattcattgagatcagggtttcttggccttggcactattgacaatggcggctggattgttcttcatcttggggggactgtcctgaatactataggatgttcagcagcatccctaacatttgcccactctctattacaatggagagagagtgggaagacatttgtcaaatgtcccctggtgggtaaaatcaatgtcagttaagaagcactgattcatatcctttagttgtaggatttttttttccttccaactggtttttcttgggaaatggagttttaatggcattctgatttctttgcccttcatcttgtgttctccttgggcttcattttgattcccttacctgcagaactcaaatagacgttcacggcaagcaaaatgcagtccttgttattattaaaattttgcaggtattttttcccttgaggaaggagaaagtctgccaaaagcattctctggcagataataaaataattgagagtagcagactttccatttgatttttcttttttggcttggctcctggtgagtaagttagttaacccggaaaagggtgttactgaaactgcctttgcaaatattgtaacggaagaaattatgacagtgagagaaatctgacatggctgactccatcttgtctctagcttcacaggctggctgtctttgctcattcctggttaaaatcaacttaattaaaaactgatattcaagctatatatatatatatatatatatatatatatatatatatatatatatataaaaggccttggtgctttttcgcttcttggatcttgtttaagaaaaatttttctttgtttttcttcttagtcagctgaattatttccccagtctgttttcttgccactcttgatgcccacatgagaggacctaaagtaatttctgacagcccgggactccttgggaaaaacacaggaggtgccacataccctgttttgagaaaaacctacgttttcctcatggaaccccaggaattgaaggaggctagatccctctcaaaatctaaggctctgttccgtgttacctgatgtattttgactttgggaggtatcagaaattactttgcaggaagaagagcttttagcctgtgtgtgtaataactaggtaggaaatatactttaagggatggctaatggagttatggaaggatactcagctctttgcacttttggattagagaagcatgctgtcagccacctagaaggtatggaaatatttctaccccacactgagagatgagactcccttgggggatgggctgattggctttggattgccttgcagtggaatgcagggtaaaagcattgcactctcttctcccattgcattcccctctttttggggatccaagatgtcatataaaaatgggacccttaatttgggggatctgtttttgccttccagctatgcctgcttattaggccctagaaactacatgctctcctggctctgtttctataagggctccaccctgaagccagtaatccaatgaagaaacttaaaaattgaaagataaaaaaatcatataactaccggatccccttctgtctgtgtatttatatgtgttgtgtgtgtgatgtttatataaaacatgttaatgttcctattagttgacttttaaagaaaaaaagtgctaaaaaaaaattgtcagaaaaatagaaacattaatgcatttaggtcacgtgactctaatctttgaaaaataaaggcaatttaaaatattattggtaaagtaaaatgtcttcaacatttatacatttggtctaaattaggcaggtcagatactgtttgctagatgctttaagcccataaactgcttctgtgatttttaataattgtttgacttgtctgttttacagccattggattctagataaggcctggggacacgtggaattagccaggtgccctagctaggctgggaagagtcagacattgtctgcagctctgtctttgtcctgggctctataatctaatacatggttaaaattgcttacctatcagatattacaccacaaattaaagctactgagaattaacattgtaatatactggagaaacaattttacttataaggtatacaaggaaaatagaatgtatttttggtaaaatgttataagaaggtatggaaatacggtttttgttaaagggaaggtaatgttgtctagttcaggggattttaaggatcgtcttaacctaaaagagcgataagacaaaactgcaagtttaaacaagcgggaggatcacaaggtcaggagatggagaccatcctggctaacatggtgaaacctcgcctctactaaaaatacaaaaattagctgggcgtggtggcgggcgcctgtagttccagctacttgggaggctgaggcaggagaatggtgtgaacccgggaggaggagcttgcagtgagctgagatcggccactgcactccagcctgggtgacagagcgagactccgttcccccctacccccaaaaagaacaagctataaagggtttgtgaaggattgatcttgtaaaggaagttctgtgtgtatgaggaagttggctaagatttgaaggagattatttcagtttttggtaaattaaacattaaaataaaagcacactgatacagggctcaaatctgggcccatgtgtctgaataatggttttcttaggaaattaatcagctgtttaacagaaaattataaagggttttaaaaggtttttgaaaattttacctgatggtcaaacgaattaagattatatagatttgtttataaggttttattaagaattgggtttaacattaatagtacacaaatgcaaaggtgaaattttgctttttcttttaaacaagattttcgtgtaatattaagggatacaaaaggtttttgtttgcccctttgagtaaatggcagggaaaaggaagaggggaaaggaaagagattcagttggcttcatgctgtcttcattgggtcctgttgtttggaaagctgaggctcctatcaaagtaaagattttttccttcgtaaaatttttgagttatcattttggctaaatgaatgacttaggtatggtgacctgggattctattttgtaatatctaatgttttaaacctttgatatttgacaaacttgccaagatcaaattctaggttatgttttaaaaaaaaattaggacacctaaagtccaaaagagatatatttggcttattcaatatattaaaaccatgcaggaagcattgtcaaatataaaatggtgtttaactttctttgggttatattcatataaatatgttattagtatgtgttacaaacttgtgtaagattcctataattctgatgtttcagtgtatgttatcattaataattataattgttatgttaaattgttgtgtgtcacagagacgaccagaattccttgttgattgcatctttatggctgtcctgagacttgtgtcatccatagacaattattgtcttgtgttgctccttttcagaaggcagttgttatattcagctataggactctgacaggtactcttgaatgcgggtctctgataagtttagaaattgtgccattggaataggaaaaaaaaaaaaaaacttttgggactctcgtggagagctgatgtgttaaacattgctaatccctttgttattcagaatcaagaaaatgttttctttttagctgtttaccacttttagcaattgaataagataaacttgtgcaaaatttactgtgagcaaaatttggagcatgttactttttctctacctgatttctgcagaatttatagaaactatttgagtattctcaacttatggcagtatagttatttgcataagtgcagtaagaatctgttctcttttgtaacagaacagaattagaaacactggttattttaccaaggctttgactggaatggcatgcattcaaatataaacagactgctttaaggaatcaaagttgacttacagagccaacaaaagcccctcaggaaaacgcctcataccttgtgcggtttctgtacagggttcctgacttgtggtaagtaaagaatgtcattttctggcgggcctagggagccccaagttatcttgagaccttgggtggaggaaagagcctattatggcaaataattcttcttgctgcactttatacaaataatcagtccaagcataataagactaagacttattttgcaagtaaatttgtcttactatgatttgtctttaataaaaatggggactagagagagaaaaattatgtttcaaaaaactataaacttcttgagttttcattatcttctgttaacactgaattctttgtgggctacaagtccccaaactaatgctttcaaatttttcttccacttttctaacttggactcagtaaaatgctactaccttgttcctgaggccctgcaagctgaagcttattcctcgtaatataggcgacaaaaacgtttcagattttcactgcctgcctcatctataacgaaagaggcctaacccacctgcattgccacctcctgatatgggaaacagctgtttaattaaacatctagtctcaggactaggaaactgacctaaaaagaatatgggatgatatatgtaaaatgtgttctttcctgtccatcccaatctgtctgtctaacaaccactggcccaaatctctctgctagccgccccatgtctgattggttctcagagatgttcacctgggtccctcagagcttaaggtccagtctacaaaggcttcggaagctaggacttccactctttatcctaggaccttatagctcactgttcacttcaatgctgtgccaaaactacagatgaccatcctaatgcctttgtcatgcaagccctgaaaccccaaccaggcacatgtgagtacatgcagacagctgcaaaggggttccactccttttaccttggggtctgcagctacacccactatgcccactgtcagcaggaagaagttagggcagtcgtctcttctttttccatcttcatagcccacaccttaagaataaggtgttataaaacccaaagggagggattgaaaccacctttgcaaaaattataactgagaacatgttgacagtgagagaaaactgacctggctgactgtcttgcttctagctcacaggttgactgtctttgctcattcctggccaagctaacctgggggaaaaatttagtttatagtttcaatgataatagtccttcccccaaactaaatgttgttgtaaaactaatgaaaggctaccaaattaggatgagaggggcttgaattctaaataatttaccattatgccattatgccataataatttgccattatgccggcagtcaagatttgcatcttccccttgaagatagcatcactgttgtagaacctaagattggcctttgagatgtcttttcaggtgttcgcatttctgacaaccagattgccccacttggacctgcgaacaaccggtcctgtggccccccctactgaggaatgactcagcataagaggacagctacaattccctatgatttcatctccaacccaaccagtcaggatgctccctaccccaccccactgctcaccaaactatctttaaaaaccctaatctctaagccttcggagagacttgatttgagtactaataaaactccagtctcccgtacagccggctctgcatgaattaaactctttattacaattcccctgtcttgataaatcagctctgtctaggcagcaggcaaggggaatccattgggtggttacattactcttaatatttgtgaataattgcatctacaaaaatgattaagtggctttgcccactgtaatcctagcagctgacaaattactctgtagactccactgtgtttcctagggccatggaatgccttcttatgcaagacacgtttccatggattcaggaaatcattttaatggttcagctatcttaatttaaacaaaagttcagggcttattgttcagctgagtctctaaaaatattttttgactgcagcggctcttttacattgctaatgtgtatccatgtttaaaaaaagaatctttatgaaacagtgaaggccagcatttctttgaggtgttggcagtctttgctttaggaataataaaggaaaacattagtttcatcaaataataaaataaggaagacctgaataaaatgtccacattagtagaggatgaaagtaccctgaaactctgcaaaacagtaatgtctcatgctttgatgtgatctcattaagtgagagcagcacattttgctggtatgttgggaccccccaagaccaccctcaggcccagtggtttgctggaagggctcacaggactcagtacctgccacacttacggtttattacagtgaaataatacagatgaaaatcagcaaggggaaaaggcataaggcacgaagtccaggtgaaactaggcacaaccttgcaggtggccacccccagtggagttacagagaagctgttaattctcccagaagaatatatgattggccatgtgcgggagagtggccagccagggaagctcacctgaaccttggcgctcagggtttttatttgggggccattcctgtgggcatgcggcccatgccgaggggttcagaaggaaaataggagaatacaaggctatccacaccacttcaggcccaggccacatggaaatctgggtgaggttctgtatctgtcgttggtgcatttatgcatttgttagatgtcaatgataaaaactaatttctaagaatgtgtaggagtgggtaagtagctggagaacgtgatacccaggcctttcatatagaaaagaatagcacatcaccctggccagctgtgtggcatgaacaattgatcctcctccaccaagtatgtccattctccctttgctaaatacagtggtgtaggtttgcagagcctctgctcacatgggaggttatgaaggggctaattgttcaattaccaaccctctcataactgtgctagttgcaaacaaactgtttgaaaagactgttttgctaaactgttctcttggtgtgattataaccatttacagtagcaaaatgcaggaatccagaagttcttacattccagatgttcataaccattccactctcctggttccagtgcagtttcagttgtacgatcttttctaagtttattgttctaaattaagacttgccattcttatgctcattaatttgttacagggagaaaaagcaattagaatgaaaatcagttgagtatttataaattacagttgtttaagtatacatcttgttcagtgtagtcaaaaattctccattggtattgacacccacaaaaatggtcagattctgttgaagatgcacataagccttaaatttcacttcctactttaaaaattggtgacgatgtgaaaatgtctaagagagtccacatttcctgttttagataagatgaaatagccactcaccaaggtgcctgtcttccgagtttattcaccgttacattcaagacttgcctgctctgaaattctactgtgaccttaaaagtgcccagcattgatatgttttatgccaaattctattccctttcttgctttccagaccgaacagcaagcgagttgtctggactgtcagacacaacactgtccctcttccccgaagtctctgtacatccctttgctggtgcctccttctccgttcacttctcaactactactgtcctcaagatgatgttctttttaccctcccacatctgtgcctgtagtaatatgtcactctcttcctcctgaagtctgagtcccatccccagtctctctgctgatcccccaagtctgagtgtccactcccaatctctccagtgactcctcccctccaagtcacggtgtgtatccccaacttctccattgccatccatactgatattttgaatgacacttcacgagcactctttaatgtaaacccacacttggtaccatcaccatttccctaccacagtctgtccacttcaaagacaagcttcctctatcctgtgattatgtcactctttgccttagtccattcgagctgctatgacaaaataccataaacaacagagatttttttctcacatttctgcaggctgggagtccaacatcaaggtgtgggagattcagtgtctggtggggacccgcttcctggttcatagatggcgccttctccctgtgtcctcacgtggtggaagaggcaagggagctctctggggtctcttgtataaggacactcatcccattcatgagggctccaccctcatcacctcccaaaggccccacctcctaatgccatccccttgggggttagatttcaatatatgaatttagaagggcggagagaagcattcagaattagcactgtttagtagaaaaacatcaggattgtgttcaaacatttttttccatgttatctttcctactgcctccttgtcttcagttccctccccaccacctggcacccagatatcctacccttgtcagtgttacctctatccccccatcactgttttgttgtagtaacaatatctcacatttgtcaagcacttgctgtgtgccaggcatgattctaaatattgacagatgaaactgtttattcctaccaatccctaggaagtagaaacagctccatcctcatttacagatgagaaacccaaggtactgagaaggtcctggcctacccaagtcacttcaaggaggtcatacagctgggattcagaacaccatccatctggctttggaatctttctcattttttcatttattcaacattcattgaaaataatgtaataaaaattatatatgtgtatctatatctacctatagatgcatatgtatatatgtatatatagctatcatgtgctacgtgatgctttcaaatacagttggccctccatatcctcaggttccccatccacaaattcaaccaactgtgactcaaaaataaattgggggctaggtgcggtggctcacgcctgtagtaatcccagcactttgggaggccgaggtgggtggatcacctgaggtcaggagtttgagaccagcctgtccaacatagtgaaaccccatctctactaaaactacaaaattagctgggcatagtggtgcatgcctgtaatcccagttacttgggaggctgaggcaggagaatcacttgaacccgggaggcagaggttgcagtgagctgagatcgtgcacttgcactccagcctgggcaatgagcgaaattctttctcagaaataataataataataaattggaaaaataatacattggaaaaaacaaaaataacaatacaacaattaagataatacatatatttttaatttttaaaagtggcagttttattagagcaagtatgaaaatatgaattaaggttgcaatgagcagcgcagcagagaaggggctgcctgccctcctccccccgcccgatatatatttcatgtgtgggacagggtctcactgcattgcccaggctggaatgcagtggcatgatcttgcctcactgcagcctcagcctcctgggctcaagcagtcctcccacctcagtctccccaagtagctgggaccacaggaatgtgctaccacacccagctaatttttcgtagtttttatagtggcagtgtttcaccatgttgcccagactagtctcgaactcctgggctcaagcgattcacccaccttcgcctccaaaaaagtgctgggattacaagtgtgagtcactgcgcctgacctatttattgttttttaaagacagagtctctctctgttggccaggctggagtgcagtggcacaatcatggctcaccgtagcctcagcctcctgggcacaaatgatcctcccgcctcagccccccccccccccccccccccccagtagctgtgagtgcaggcacgggccaccacactcaactaattatttttattttttgtaaagatggggtctcattttgttgcccagtctggtgttgaacccctggcttcaaatgatccttccacctcgaccttgcaaagtgctgggattacaggcataagccaccacacccagtgccaatcttagttctttgctcgttatctgaattttcaccatatttgcatacacctggagtattttcttaaattgaaacagttgctttttattagatataccaatacctgttagtttacgagtttcatttagttctattgttcgcataacatacatttaaatagctattaaatttcaaacatttgccctcacgctacttaaaattattttgagtaccgtcagaaatgtggaggccacaagagagtacttgaatgcagcagttgtcaccttttctccagcagcttgagaaagggcatagagtgctatctgagctggatttgaaccagaagtttttaggcaaagtaagaagagcacttcaagaaaaataaagagcaaaccccagcatttttgaggagaatgcgccatcttggtgatgcggacctaggacacatgatggcaggaaggaggaaaagatgctggcaagtagggttagtggcacattaacaccagctgagacacgggaacctgtccagttagaagccgttgattcattgttgaaagataaaactggatgtagtgtgagtaaaggatgacctgcctgcttggtgaaaaattagtaaccacagaggtggctgtcaaaaccaaccagcaaccagggaaaatgcttatagtgtgctaggtaaaagagaacagggatacaatattctgtgaccatgatgattatacatagaaattaagacgcacaggccaggcgcggtagctcacgcccagcaagtaatcccagcactttgggaggccgaggcaggtggatcacctgaggtcaggagttcgagaccagcctggctaacatgaaatgaaaccccatttctactaaaaatacaaaaattacctgggcgtggtggcatgcgcctgtaatcccagctattcgagaggctgaggcaggagaatcgcttgaacctgcgaggcggaggttgcagtgagccgagatcatgccattgcactccagcctgggtgacaagaatgcaactctgtctcaaaaaaaaaaaaaaaaagaagaaagtaattaagatacatagagaaaagggactggaagaaatcccccaatgtgagaacaggagttgtgttgattgtttaacaatgtgagttaatttctccatcttccaaattgctttctcttatattcccaaagtcatatcttgacttttgtttgagtgtgatttgcaatggtgctatccgtcgtaaatctctggtttagcattcatgctgtcttccaatttccaaatattgaatccagaattcatgagtgttccaaggtgctggagaccacactgtagggctggaggacatgagcgtctctgcacctagctcttcctagtagctgacttgcagcaggagctgaggcttctcctggcatcacctccactacaattctctgtgagcatttccaggaagcagcaccccctaccctagccgaggcccgtccaaggttgtctcgttgtcctagcccgccattgccctgggaggaagtagccacatgagtttatggcctgagtaatgcttttccctcctggatgctccccacatctagaggatatgaaaatagtcttggcaagggtgcctggtctgcgcttgtcagcggcctgagctgtattcagccaccacccttggggtccaggccagatgttatggcaaaaccgtattttaacgagatccttctggtatttcttttggacgccgtccgaggcagcttcattttacgctaaattccatgttatggtgggtcatctcaaacaggtctgcagcgcataaaaatgttctcactgcactctgttttctgtagcaaaatgttgttggaggttaggatgggagttgaggactgggccttgagggtttttttcatataaacacattaaaatggaaagctgatatgaacacgttcagtgatatagactgcaaaggcaaaaagaattctccccagcatatttttttttctttttaccatggatgtaattggagtttacatatgataagaactgcttcttgggcagaaaatgtaatcctctggtgagactaatccatcattgttgaagtgaagggaactggtagtgaattcgccccacagatgaagataggatttctaattccctcgccttttctgtttactgttcctaactccgtgagagtgtgcgtgtgtgtctgtgttttcttcaccatttgatttttcatcccggctcccacttcctcatccttggcctctctcgcatctttatttttatcacaccctccccacctccaccaccttgtcccagcactgagaggaaagtgggcagctttccaggcagctgcagtcctgctggagaaacctttatgatccaggaaatattgactgaggagaagctgtgctgactccgctatgaataaggaggttggaaaactgtcagcatttgcagaaacaaaaggaagtgctacatatacgttttggtttcataatgactgtattgtaaaaccccttctctttagcctactagattggacaagtgtgttaaccagtggctgtttggtatccattgatcatagagctagaccaacaaccaaagttgtttacctctcataaggtggcttttgcaggcgtgccaaaatcatattatgaaactcccagccacaaattctgacatgtattttcacttcctatccaataagggatatccccacccctttactccccgactactgtagtcataaaggtacactcctagttcctccctctctctttctcagcttctcggtccctgtgtgtgataaggtttcttgttgccctgtgtggcatggtgtggcacgccccagcatactcccttccttgggaactgagtaataaattctttcaatggcattagcctctttgtgttgtcactcagtcacctccataaattaaaacccttcaggttttgttggcactgtaaggtaatttattttctctacataggattttagaattgaaagggaccttgtagatcattgaattccacctgtccatgggtcagaaaagggagctggggaaactgttagggggcagatccaggccttggagcacctggttaaatgtgttctccccataagcctaagaaatggtaccaaattcttatgtcattgcatccaatatggtccttccttctttcttctcttctgtttctttcctttgctctcaagactggtgtatcactttgtctcccaggctgaagtaaagtgtgtttgttatattgcagtggttttttattcgtattattatcatcatattgttttttgttgtttttttctggatatttttgatctgtggttggttgatttggtggacgcagaactatcggatatggagagtcaactgtatataaaatcaggtcagcacacttttcctgtagaggagcagatagtaaatatcctcagctttatgagccatgtggtctctgttgcacctactcaactctcccattgtagtgtgaaaatagccatagacaacacatcaactcatgggtgtggttgtatctcaataaaactttatttacacacactggcagtgagccagacttggtctgtgggcctcagtttgcaagcccatgatctaggcaatgcacagatagcagatggtgtccctcagctttggatagctgtaagtattacaagtatgtgagtctgttaaatacttaataaaaattccagttttaatgttacaaattgatacccttggtatttgttttagctgaagatgcaaaaccaactccacagctgcctgagtattaaattctacttttctctgccaaataagcagtatttctaaaggccagtgattgataacttagcagattttgctgatgaatcaggccaacattagctgagcatagtagtacactgtataactcaaatggtttgtgaagtcatttgtgaggggtgtggtttagcagtgtcataattgcaagaaacgcaatacatgtacttggtttgttttaaatgtttatgttgcctagttagatgagacaaattcttatacagactgtttcctctcttgtgagactattacacgttttattccaaatggacaggactttacatggaagatcctaccatcctttataaaatgtcatcctttgtgtaagcctttcagtttatcatgattatactcttttttttctccctgggaataattttacctcatctggttatgctctgttactgtgtgttatgttatctaaggtctatgaccaattgcatgcagagggtggcttgcttttcaatagcaacaaccaagaaccaagcagaaatgtaaggagagtagagctgggggtagtggcctttcagggtgtcaattccccaaccatggtggggttgatgggacaatattggaaacatttttggttgttacaatgggagtgtgctactggcatctagtgggtagaggccgggggtgctgctcaacatcgtacaatgcatgggactgtgtcccccacagcaaggaatgagccagcctaaaagtcagccatgctgtgcttgagaagccctgctgtcaagagattcatcaggaatacgcctcctaagtaggtggcaagcctagcgtcttcaggaatgtctctaggctagcctactggtgacaccaaggacactaacccatcaccctcacacgatctttcatcgaggtaccaccaagctctttgttctcctgccctttaactacttctgcacctgccgcaggggcagtccttggtgcttcgtttatcattgacattctggtctttgttcctacggatgtcttgttgggcagaagagatgtgttcagagatgcgggaaagctgaggaggcacaaggcaccgaagtctcaccactctggcagactgcatatgaatgtgcccattagccctggagtccaagtgggaggggtgagatgctggcaggtgtggaggcaggcattaccttccgcagcaccctggcacctggttctggcaactgtggcctaagaggaagtggtcaagcagcctctagtacatagtccttgggcattgtcttagttagtatgggctataaccaacaccttagactgggtaatttatatacaaccaaagtgtattgctcacagtcctggaggctgggaagtccaagatcaagacgccagcagatttggtgtctggtgaggtcctgtttcacatggatggctccttctgtgtcttcacatggtggaaggtgcaggggagcttgcttgagcctcttttatagggacactgatcccattcacgagagtggatccctcatgatttaattgcttcctgaaggccccaccccttaataccgtcactttggggatttgtctcccacatacaaatctgggggggacacaaacattcagaacgtagcaggcatcttcctgtcccagaatgaatatcagaactagcaaatatcctagcagccatttcatctgacatccttattgttccaacaaggaaagctgggacagcaacctttccactcactgtggtctcctctccatcaaatgtgttgggggtctggctgctgtcccatctatgtgtctcatcagcacctcaaggtactttttatccctatatcacagaggaggaaatgcaggcccagccaaatgaagcgacatgggccaggcaccagtggcagaacgaggacagaacccagccatcctgcctgctgctgacattttctccatccagccctcctgcttgccttcatgagaccacatggccagaaatcagtaagaaaatcttgcaagcaaatggactgaaaaaccattgctctagaggccatgtagagatccattcagagaaatgcagctagtgaaaatttcagcaaataggaggacttctgttaaccatggcatggaatgcacatctcccaggtctttatgaaggtgcctaatttccagtcatgacctaccctctccaaaagaggacccaagctgatgaaagaccttcgaggtacccctgtagaactttatcctgcacatttgtcattgtgcatctgcacaggatattcctttcggcagacgactttcagctctttgcagaagtctcagacgccacatccttagtccatctttactggttcatctctttgttccaagaagacttaattgaatgtggatactgttgtccacacgatctagaaatgaaatctgtgttggagagcataatcatgtagagagataaagttatacagccaaaacatgtactcaacattaaaaacccagatgagagagaaatcaagggcacactccctccgtgggttagactgagctttgcacaccgttctttgtgagttgcctgagctgcacccacgctggctgctgtccagagctgccagtggtctagctgagcagccaggtggaaatggagtctgtgtccatgcagggaattcaagaattttggttcctgtgcttgtgggtgggtcttggagtgtaaagtaaaaagcggaatctcggagtcacatagtctacggttcacagtttagttcagcgtcatatcacatgatccttgggcgggttacctgatgtctccaatgtttgtccttatgtgtgaaacaaaaacagtaccaactccaaacagctgctacaaagactgaggtagtggacagagtgcccaggtttggttgaagatggtaatgtggtcagaatcggctctgtttcacagagcatgtgactgcaagtaccagttctgtggcccagtgctgcttgcgggaatgaatgagtcagagtggatgaatgaaatgtcccaggagcacgagactttccttccacaattgctccatcagccatgaggtttgcttgtcaggtgccgtcatcagcacataatgctgcattctggtgcattcagtagatgtttctagatactgtttcatggtggctaagagtggtttctggcacccaggcttagatctcagccccacccctacaaactgagcaacaggaggctgtcagttaccctcaaaagatctcagagactgattgatcaaggggaaagcggcagtgacagaatgatgctgagaagcttgaagccatttagtaggagccacgtgagtggcccccatcagccgtgagagtcatgatgtctatgagagaggaatcactgtggcccagagtagataaggaagattccatgtagtggatcgtcaagccaagaatgcagtgaggtcccgctttatccattgactggggtttttctcttccacactttgccaaagacctcaatgataaaagcttgcaggtaaaactctgtatagcattggcagagaatagagtcgttggtgaacccaagggtgggttgcttcattttggtaggagtgggtaggagaaaaggaaggtggatagagagaaagcaagttagaaggaaaaggtaaggttgttgtaaacagccttggcttatatcctccaaaaacacaggggcggaggaacccttggggataggggaacctggaagggcgtcctttggaacctaatgtaggcagttatagttctgtaaagaaatatgcaaggctctgtgcaattgattgtaaaattaatagcagctaccctattactctgttagataaatctcaactacacatttgatatgttctttacaacctggcggtggggacagaacagagggtggattgaggaggagggagagtagacagagaaaagtgaagtgtaagaaagcagcaaggagagcacagcgcagagctcgtctcctggaggaacattcccatctggtgagcgttttgtttattgcaaggtcagtttgcatttggataaggcgaggcagaagggcactgatacggaagcagagggaagccggctgccactgcccctcattggctgaatgaaaggcggcggaagaggagcacctgtccagcaaggctgacagtcctgcctcctgggataagcagattctcagcctgcagagtggtctaaccagggaggtagagtggctgctttccgaactccctgcttcctgctcatttgcctcatgcatggaagttgtaaacagtgtgagagttgaaagccacaccatgggaatgccttggtgtccaccccacctgttgccaggaaccgagcactgggggtccatgttcctcacacgagatccccccatgatgtccacctcccaaggatttcaagctcctgtgcaccctcaggccgcctctgcaccaagcaaagtgacccagccctgccaggcggggttgcctgttttaggaaactccctgcagcagcctaggcttgctggcagtgggatgccacctccctctctctccttgatgaagggctgtcgcagcttcctcatcacccccagacctccacatagatgccctgcatcattgccttctttccttgaagcaggcgccatccacaagagcaaggcatggctttctgtgtattcggtcctgacccccttcccaacagcttcattcaagagccttcatccaaagctgatctgaaaacacctttaaattgccaagcatcattgatagcagcttcctagagcggcagtgaaagagatgcactgggggaggagaggaaaagagccagcatcaattagcaaagagaaaattcccagtgttttgagaaaatgactcagtgccacaccagtcagtccaggacggcctcttctccgtcttcagttgttgagttgtgatacacttgccccgcgtgccaggaggactcagggtcagcgtttgctgttccctcatcttgggctgaagaaaggtgccctgtgtgctttcagggggtgacacagagaggcttcagcatgagcttctgcacagtcttacgaaccacggagttttggtggggagcctggagccaaatttgagtaacagaaatgtccaaccggggcatgcagggcaaactattgtctgttctgctttgttcttaataacactgaaacggttctaccatttaagtcccttgtttcatcacataccaatcctggtcttcctgggtctgaagtccctccctctctccctgccctttcccaccttactgaacccaaatcagaagcatccctgggcattctgcagccgtgtctgtccctgcaaattaagtgtgtttgaagtctgcgggccaccttcagatctcaatggctgcacctccctccttcaattcgggtctcactcaacctcagctttcccctcttgccacaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggtacgtagctgctgggcccggcccccaaacagcagagccctgggaagctgcaggagcttggaacacattggaagctaacatgcatttccctcaggcatttgggattaattccgcggcagggtgcagtggctcatgcctgtaatcccaggactttgggaggccgaggcaggaagtctacttgaccccaggagtttgagaccagcctggacaacatggtgtaacagcatttctacaaaaaacaattttttaattagcccagtgtggtggtacgcacctgtagccccagctctcgggaggctgaggtgagaggatcagatcacttaagcctgagaggttgaggctgcagtaagctataattgcaccagtacactccagcctgggcaatgcagtgagactccatctctaaaattaaaaaaaaaaaaaaaaaaggaagaagaagaaagtaagttgggttcttttccactttgtgttaataccggttgtgtggacacacagcagcaagcttccagtgcccctcccacatggctctgtgtttttgacttaaatgtagaatcactggctgttagttgatgtaaacacttacaccgccacatctgaaaaagatacggcagatcttcagctgctctgggcttcggagtggacgtttgccttgcacttaatgcagacttgctgtctcttcttgatttctggagcaggttggttagagaggggccccacacatggtcaggtggaatctgtatttcagcagaacccggcagagggcatcaccagaggctgcgtcagggcagagaggtgatggctctggtgttaatgaggatctcaagggatgccttcattaccgggctcgttgtagagcagatggggtaggaggatggaaaaataaatgcacattaaaactgtgcacttggcttggaacccctcccactttttacattggtccacagtgaggagttgtgccaattttataccaattttggttttaaaccacacacctcaccctctcttgtcccctcctattctggtctcatgattctgcagtgaagatccccttgacttctggggaataatgggatccacaacctttcttgccgccttcacctgagtccctattttatttttagagactgagtctcacactgttgcccaggctagggtgcagtggcacagtcatggcttactgcagcctcgacctcctgggctcaagtgatcctcctgtctcagcctcccaaagcactgggaccacagacagtccctgttactgatttctcagtcccctgcagcttcctccctctgcttctctttctcctactctgacccaggcgcgtgattctactgaacttttccatactgtaccgtcatccatcccacctggcagtcacattcttccaggattccctctgtcccgtctttctgggaactggtcttgcccttacaaacctttctccttcacagcatgttacactgctttaaaaaactcttttagaaaatcacaaagtaataatatcctgttctctttttcttttcttttctttttttttttttttttttttttaagacagggtctctctctgtcacccaggtgggagtacagtggtacaatcatagctcactacagcctcaacctcctggctcaaaagatcctcctgcctcagcctcctgagcagctggaacttataggtacacaccaccacgtccagataatttttttattttttgtagagatgaggtctcgctggtcttgaactcctgggctcaagcgatcctcccgcgatcctcccgccttggcctcccaaagtgctgggagtacaggcgtgagccactgtacccagtccctgttttctttcttgcacttctgcctgccatttttcgcaaagctgtggctttcgaaactccggtgttttttcctctcttgtgctcctttttccctggcaaaccccttcacactgtgtgcccgggatcttccactgactccttctggccctgtctagtttcctcactgcaaaacacacacgtgtgtatctaagaggacatgtctccaaggtccagccagccatcagatctcaaggcgcctgtgactctgtttttctctgctcattgccttctacctctcatctgttgagaagccttcatagttgccttccctcggcactccagattccagcactctaggggctaatgaaagactgtcccatttgtcacaatggtttctaatcattaaaaagtgagacgccaggggcggtagcacacatctgtaatcgcagcactttgggaagccaaggcaggagggttgcctgaggccagaagttctagaccagcctggccaatataatgagaccctatctctacataaaataaaaaaaattagccaggtgcagtggcacatgctcgtaaccccagctactcggaggctaaggcaggaagatcagtttggtccaggagtttgaggctgcagtgagccatgactgtgcccctgcactccagcctggatgacagagcgagaccccgtctctaaggaaaaaagagagacagtgtgcccgcggagtttaaatgaggacatgttgttactactttggacagttaccgcgttttgtcatgggcttgttcatttgggtgtgaacatatgaaggaggaagggggtgtgggagcgtcttgacccatcggtcaccattgtccactccatggccagaatcaagggccaagagtgcctgaggaggtgatgcagctagttctttacataggttgtattgttttctttattttgaatattgtcttgtaatcagaaatcatctggagtgatgtttcatttagttattcttcagctgaaacctgagcctttcagttcttcctcacttctgaagtaattcaggttcagagcatataaacatgtgtttgcacatccagatacaaccccaaggcttactgaggttcacctgattcgaatatctggcgtgtttcacaaggaaagaacctcctgctgtatttttaaacgtgtgtggaaagttttccatggtaaacggaaatcagagaatcaaagaatggtcaaaaaaacatgaatcaaaacaaaatgatgtcaattgtgtcatggctatggttagtctaaccctgaacccaaggagtcatttcaagtagcagcaagtgcctattttattaaatcccctggacagatggacttggaatccaggcctaaatgctgtgtgcatctcatttgggctctgcttctgaagcgttaccctcccatataatggatggtcatttgcagagattttgcacagtcgcgatagcacgtgggcaggtcttctccaccgcagcactcagtatttggggctgcgtgtttctctgtggtggggccatcctgggcactgttggatgttgagcagcgtccctgggctccacccaccagatgccaggagcacctctcctcccttagttgtaacagccaaaaaagtctccagacgttgcctaatgccccccaaggagtcacagtcaccccccgcccccgccacgttgagaattgtgccatcagggatagcactttctgtcaagaataaatggcctttttgtcctcaatgccccaattgggtttgacactcagaacaaccatcacacttagttcttaccaacagtttgtcgtgtccccttccctgcccaccgtgggatcccttcaccccaggctccaggtccatgccgcttcccccgtggccccctggttgctgggagccagctgtttacgccccacttccctgcgcttctcctgcccagagagcagaggccattcccagagccctcacccccgtgagctgacagctgtaccttggcttgcttccccaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcagtgagtgcaggggctctgggagttcggtgggcctctctgggttcattgttttcttcttgggcaaatccgaatgccttcttaaaaacctgcctgctataaatgtcttagaagctgctctctagtgtttgcttacgatctggccggaagaacttcccgttccattttttccatcacaacccttggacctgagcttcttcaccctcatcttcaactttaggaaatcgtgctgcgcctgctaatctgagaactctcatgtaacacatgattattgcccgtgataaacaaaagtgtttcattcatggacacctttagtctcagcctccagccttccatgttgagggtttttggccaaattatggtataattattgagcttgcagttcctgccaagggcactgggccccagagactgggcataggcttatttggtctttgcaaaaccccaggacatcagtccctgttaggtgattgcctgtgagtatgtggccagtcagagagcccaaaattctacccagagaacctgctccacttagacatactgctctatacacccgtagggacgccacttcagggtgcaagttcagagcgagcatatgtgccgtgcatggcgcaccgtgtgcgcgcatgcacttgcatgcacaggtatgcatgggtgcatatgtatgttgtacatgtgtatatctgcatgtgtatgtgcctgtgtctgtgtgcaagtgtgtatgcatgcgtgtgcgtgtatgtgtgcgtgtgtgcgtgtgtgcgtgcacgcgtatatgcgtgtgcgcacctgtgttcctgtgcgtgtgtgtgcacaagtttgtgtgcgtgtgtgtgcgcacgcacgcacacctgtgcatggtgtagtgtatgtgtgtgtgttcttccttatttgaaagttgttgccctcggagcagccatgcagcccagcagtccttgaagatcgagctgactatgacgttgctgtcttacctggtacgtcttggctccacaacttcctggtgtgtagagagccagccggctgcctctgatgaggctgcagcccgagccaagccctgtgacaagttaccatccacaggcaccagctaaaaaattcttggagaagcagatccagcatttaatggaaggttcacagattgttaataacgtttctattgcaatagggtgacagaaaggccacctgcctcaggtaaaaggaaaagacctcttaccagccttctattgataaggtccacaattgtggggcaggaaaagaagagtctggccctcctcctctgtgcatgtggccagagttcaccctggttgaacttctggaacagccaccccaacccccttctcaaaccctgcatcttgtgcctgacccacagcccagtctatggagacaggagcattggaaggccgcattttgataagaatgaaaatactggctgtcactcctgcctggagttaccaggccccctgccactgcgtggctggctaagatgccagtttccctcttgccatcaccagggacagtgggtctgccacatgcagaaagatgtttttcctctcttccagccagatgacactttcagagcatggaagaaacaccaacattgaagagtcccattgttgtttgaatcttttgtatcaggcttctcgagctaagcaggaccaccaggcgttttcttattttttacataaacagcactcctactcagtgacacgtaacctaagatcacattgcttctgtttcctgggttttccaccagagcacctttacgaaagacatatgacaaagcatgctcaattcctcaccgtattgtgaaactgttaaccatggctaattgtttgatgatcaggctatattgctcctttctcaggagcataaaccagggtctagcaaactttctttacagggacagacagtaaatgtcccaggctttgagggtcatgcagtctctgtcacagctgctgaagtctgtcagagtgcaaaaacagctgtgagagtcagctcaggctgccgtaacaaaaggccacacaccaggctgtttaagaatttgctctcacagttctggaggctggaggaccaagatcaaggtgtgggcagggctggttcctttgcgaggcctctctccttggcttgtagagactgtcttctctccatgtcttcacgtgctcgttcctctggttgtgtctgtgtcctgatctcctcttctcataaggacaccagtcccactgggttagggcccacccttgtgacctccttttaccctgctcaccttttcaaaagccctatctccaaatacagccacattctgaggcccctggaaattggggcttcaagatatgaattttagggggacatagtttagcccataacagtagccatagacaatttgaaaacatgggcagtggctgtgtgccagtcacactttatttatgcagaagcagccagggactaggtttggatcatgggctgtagttagctggccccagttacaaaaaataactgtcacccaggctggggtacagtggcacaatcatagctcactacagcctcaatctcttgggctcaagtgatcctcccaccgcagcctcctgagtagctgggactacaggtgtgcaccaccagggctggctaacttcttgttgttgttgttgttgttgtttttatagagatggggtcttgctatgttgcccaggctgctgttgaactcctggtctcaagcagtcctccctcctcagcctcctgaggcactgggattttaggtgtgagccactgcacttagcaaactgtttttattcctcaatgaaatttagagactgtcaaaatgtaaagaaacctaaaatatttactaaattgcactaaagccacgatttcgttagaatcatcagaggtaggccgggcgtggtggctcacgcctgtaattccagcattttgggaggctggggcaggtggatcacttgaggccaggagtttgagaccgaccctggcaacatggtgaaaccccgcctctactaaaaatacaaaaattagcctggtgtggtggcacatgcctgtaatcccagctgcttgagaggctgaggcatgagaattgcttgaacctgggagacggaggttgcagtgagccgaggtcgtgccactgcactccagcctgggcgacagagcaagattccgtctcaaaaaaaaaaaaaaaaaaagaaaaggaatcatcagaggtagtatttagtacataaaaaaaatgtttctggaaacaaaagagccctttaagtgtgtttctcttgtattggtaagccacttgtctctttgtgtttgctgtgacagataatcacgcgaagccaatggaaatagatggagaggttgagattccatccagcaaagccacagtccttcggggccatgagtctgaggtgttcatttgtgcctggaatcctgtcagtgatttgctagcctccgggtaaggatgtcagggtggggggcgctccagagttggggagatgggagatgcaagctgctcgcccttctctggagttctgcctaaaggaacacacactccccttcttaccccggtgtgtgggcagaccaaggaatgggtggctctatgagccacttctctacatgtctcatattgtggagaagccatagttccaagtcgttttctccatgtggtggtgaggaacacagcagcacttaaattaccaaatgcaaagatggcaaagagggaaacagggatccagagggatgaaaaagacagaagagcatgtgctgaagatgccctctggccagagagcaagctgtggagagcttcttatcccatttgaaccaaacaccagaggctcctgtgtttttattctgtagatctggagactcaactgcaaggatatggaacctgaatgagaatagcaacgggggctccacccagctcgtgttgaggcactgtatacgagaggggggccatgacgtcccgagtaacaaagacgtcacctcactggactggaatgtaagcatcttccaccccctgggcactttgaaattggtaaaatcggccagccaccaggcaggggctgcagcaatggagcccatgcagacataggaggcaggtggtcctgtgtgctcagcccccactctgatgggctgccagagaggtgttcttggcttctttttttattttgagacggagtcttgctctgttgcccaggctggaatgcagtggtgtgatctcagctcactgcaacttctgcctcctgggttcaagcgattctctttcctcagcttcccgaatagctgggattacaggctcatgccaccacacctggctaatttttgtatttttagtagagatggggtttcaccatgtcggccaggctgctctcgcactcctgacccaatgtgatccgcctgcctcagcctcccaaagtgctgggattataggcgtgagccactgcccccggccagtcttggcttctaagagctattaacaaggctgcatttggcaggcagtgagctgtgtattcagtagccgtatctttgcacgtgagcatgccttagcaaaatgagcctgtggcctcatggtgggaaggtaggctgggagccccaaggtagttcttctggagagatacgtcgtgcagcccaggaaaggtgattctccaccttgggatttcagcaccaggtgttctgtgcattgacacatgggatgcacacagtttgactgctttttattttctgcaaggtcttacgatagctttcagcatggtattttcaattctgtcattaaagaacacgcagtggcaaatggttccagtgtacctggatcctcggagaggctctccgagctgcttcggtgctgccgctcctaagttgtttttgtggggttttgtctctttctggccctcagaccaatggaacactcttggctacgggttcatatgacggttttgcaagaatatggacggaagatggtgagttctgtgtccctcgtgctggggtcgggtaagaggagctgccgaacttaacccttgagtgaacagaccatgacattgaggtcaacatgtttgtttttactaacaggtaacctggccagcaccttaggccaacataaaggccccatctttgccttgaaatggaaccgaaaggggaattacattttgagtgctggtgtagacaaagtgagtattagctgaaaatacatccctttgatctataggtggttatatatttttaatctcaaaataacatcgtggtttcttggaactcgtaggctttgtgcttccccttaagaaatgaaaatgatttgtttaggctttgtttttgtggttttgatctttctgttcatttgtgacacatcatctcttaatatattctgctgttctgcagaccctcgtgcaaagcttccctttatttgaggtacatggttcagtggtagagagaggacaatctccacattgcatttgtcagttgctggaaggagccacgtggtatggggcgtgccctgcctgaacttgcacccactgaggggtgagtggcacaggctgtgtgtgttcttcaggcttcggctttcctcatttgataaactgctgcttcccaccgtagaccgcagatttctctgagtaggagtcaagcaacctggctacaagggcacgctcttccgatggcccacagagccaggttagaattgacttgctctgcacctgggcagggctgcagggagacacggtagtgttaactccaggtgcatgtaaaagccatcaatggggtgggaacccaagggcaaagagtaaggggacgcagactccatcctgggcccgagtctgatccagccagcaacctcggcctctgtgcatttcactttcctcacttgtccagcgacaaggctggctggagtcatgagcggagacagccttcatggaacagttgtgcgttcccgagactcagcaggaattctaagtcatggctttggaaaagaagcattatctagaattgagaaaaaaaaaaaaaaaaagacgtgttttcacatgaatttgtgtttctacaacaactggaaaccatgcctgaatactggaggatgctcgggcctccacaaagctttgcattttgtggtgatttcaggataacttgaaaacttactaggtcttgaagttcgagaccagcctcgccaacacagtgaaacccagtctctactaaaaatgcaaaacttagctgggcatggtgtcgggtgcctgtaatcccagctacttagagactgaggcgcgagaatctcttgaaccagcgaggcagaggaggttgcagtgagccgagattgcgcctctgcactccagcctggatctggaagaagagtgagactctgtctcaaaacaaaacaagacaaaacaatacaaaacaaaacctgagtcagagctctctgttctttctagttctgaaagttataaaatgatagagttggccggtcgtggtggctcacgcctgtaatcccagcactttgggaggccacggcaggcagatcacctgaggtcgggagttcgagaccagcctgaccaacatggagaaaccctgtctctactaaaaatacaaaattagctgggcgtggtgggggatgcctgtaatcccagctactcaggaggctgaggcaggggaatcatttgaacctggggtgagcccagatcgcgccactgcactccagcctgggcaacaagagcaaaacttcatctcaaataaataaataaataaataaataaataaataaataaaatgatagacttgacctctgaacatcatcccactttgggagaaattgctaaatgaaataattgaatttggcaaactgtggcccacataggccaagtctggctcctcacctgtttcttaaatttaaataaagttgtattgggacacagccacacccctttgttgagacttctccatggttgctttcatgctacaatggcagagatgagcagttgcaagagagaccagatggccctcaaagcctaaaattctactacctggcccttcacagaaaaagtttgcggactcttgcactagggtataactaggtcaacaaatcattcattcataattgctctccctctcttttaagccaagaaacctttcagacttagtagcctggtttatgatattttaaaagctgagttgctgtggttgacacataaacgttctcatgtagctactatcagatctttgccaagatgttctaattcaagtaacatgcatacgcagcactttgctgtgcattcagtaggctctcagtaattgctgcttgagttattaaaatcactcatgaaaatgacagcacttttctttatcaagcagttcactactgcatgtgttaatccatccggtactgccaagataggaggcaggcacaagtatgatcactcccattctatagaggacgaactggaggcctggagagggttattaatttgcctagggacacacagctggtgcagagtacagagggatgggaactcagaccctggtcaccagtaactactgccctttaacttccgtagaattctaaatagctgtttgtttcctggcctccttcctacctggagactgttaacatttgtgattgtttttctcactgattatcagtcttaactccaccaggtgatggactatgtgatcagtgaaaatgcatatgtggaattatgttagtctcttgggctgggtacgatccaccatcattacttagtcaaccacagcaggagtgaaaataacatccttgtacataacactcagggagaaaatgtaacttaggggatgctggtgttgaccaacacagagtgactaaaatatatgtcacattcttcaaatgtttgcataactgttttcttttgtccaatgtacatttaacataaacatcaactaagagaccagtcgctgatgtaatatgtgaaatggtatcagaactgtgaaagagtttatatattctctgcagtgttagatttgtttttgcatggctaaattaagaagagttataccccaacaaagaaatgttaattggtctagaactgacccaaaacccaggagtaccaagtttcaaagacactcactgcttgctttcctctgaaaatgtctacagtcaacacaaaatagaactctttcttcttaaagcaaaatcttgactgagcgtcagtaacagagaggtgtaaagtttccaattaagttgaaaattccagttgatgaagacgtaactccaatgctattcattgagctggttctctatcttcctagcgtcagtaaattcataaaaattcgtgatttcctttgctttccaagggagaactcaacctttctacttactgttagaccagtacattggtgcctggccccagtgcaagccaatggctctgccatgtctagtgcccccatttcatggagggatgggcagaggcattttcagaaatgctcgtctctgcagcccttcacttggaacaaatgccacaaagatctctggagatgctttgttccaggtttttcaacagtttctgcatttggggatgaggaggaattcctaccaattttggtagttcttgcaagtattggttagggatgctctgtccttaaacccatttatgcctagtttccattatcggaatgctgagcatgtgggagttatttatatcctgctgctcagggtcatcgccaaggtctgattgcagaaattcaaaaagttgcaacctcaggcataaatgagttaagggagatgccagcatatgtggctgataggttcatcaaatgtggccgtccagattgctgagtttaaaacatgctgtactttaatgatgtggtatgggagaaaaagaaggcaaatatcccagtaaggttttgatactgattacatgttgaaatggtaatatttgggggcatgttggagttaaatataatagattgctaatgaattttaccagtttctttcttcttaatgtggatcccagaaaattgaaactagcccataaggctcactctctatctctattggacagtgccggtttataaggagaagggctgtcttttcttgtatgataaatgtttccagagaaaactttgccagaatagttactaactttttcctttgtttgcggaacacagacaacaataatttgggatgcccacacaggagaagccaaacagcagtttccttttcattcaggtgagttttttgttgttgttgttgttgtttgtttttttgtaattcaaaaataataattcaggtcgagcccagtggcttacgcctgtaatcccagcactttgggaagccgaagcaggtggattgcatgaggtcaggagttcaagaccagcctgggcaacatggcaaaacccatcactacaaaaaatacgataactagccaggcgtggtggtccacacctgtagtcccagccacttgggaggttgaggtaggaggatggcttgagcccaggagatggagtttgcggtgagccaagattgcgctactgcactccatcctgggcgacagagccagaccgtgtctcaaaaactactaataataataatccaaaattaggctgggcactgtggctgatgcctgtaattccagcacttcggaaggctgagacaggagggtcacttgagcccaggggttctagaccagcctggacaacaaagcaagaccccgtttctacaaaaaatataaaacattagtcgggtgttgtggtacacacctctagttttagctacccaggaagctgaggcaggaggattgcttgagccaggaaatcaaggttgcagtgagctgtgattgcaccactgtattccagcctaggtgacagaatgagatcctgagatgccccttaaagtaactgaatgcgccgagtatggagcccaggaggcctcattggtcagaaggagacccattttgtggcaagcattgattgctcttaaggtttgcaagatagagatgacctcggcacccacctgctcagagctctgaaacacagcagtgagccagccacagaagcagtgcgggctcctttctcttgctgttctaaagggatgctgttttgggggctccctgaaaccactcccaggattggtggtttgctgcgaggacccccaggactcaacatactcacagctaagatttctaacagcacaagaatttagtgcaacattagcaaagggaaacggtgcacacggccaaatccagagcttcgaaggctcctctcccagtggactctcacaggccatgctgaattcttccaggaataagttgtaactatgcctgtgaagtgttttataccagggaagctccatagagtctcagtgcccagagtttttattgggggttggccgtgtaagcacccagtgcctagtacaagccaaaactgcagacccccagaaggaaagcaggggcacagcataaacacactgtttgcacaaacaagtgttagcagagtgagccgcttgcgtctgttaggggagggtgggaactctccggaaatctaaaatctcagtcgctagccaagggccggccttgcaagcaagcctctgtagggagatcagcctcgggcctgtggtgttagcaccttcctacacagatgtgtggccgctgctctggagccaactacatccctttgtgcactggagccaggccaggccacatgcgttacccagggctctggagtctgtagagattccgattttccagattcccacctgattcttcgtgggtcgttttgggtttttttgtttgtttgtttggagacagagttttactctgtcacccaggttggagtgcagtggtgcgatctcagctcattgcagcctccgcctcccatgctcaagcgattctcctgcctcagcctcccgagtagctgggattacaggcatgcaccaccaagcccagctaatttttgtatttttagtagaaacggggtttcgccatgttggccaggctggtctcaaactcctgacctcaagtgatctgcccacctcggtcttccaaaatgattcttcattttctttcccacctccctcctctgtgtaactcagtcctgatgttagacgtggcctcttaaaacaaagacagatggccacccgcagagctaatagactattggaagtctttagactggcttaaagtggacagaagtgggtaggtgccacttcccttaagggcaaatgtctgatccgtcttgaaggaatccctaaatatgtgggacgaaagttaactattctatcagctgtccctggggcattgtccaggaggagatctgagtgtctttcttgtcatgcagcttggggtgcttaaatgatgttctgaatgggagggctaactgcaacaaccatccaaggcagaacagccatcggcgcctggggagggctccaggcaggggacatgggccctgcaggaaacaagaccatgaaccgaaggtcccgtcgaggcacgattgtgttagatgcataggcacccacgtctgttatattccatgcagtacttcagcagggactcctcatacaggcagctcagagagtgagggagactcagggaggacgctgtttctgctctgctgccctggagagggagagccactcctgcacagcttgggacccacaccaaacacacctctcagggttgccggtgaaatttgttactggtgttgctttaattgacactgttgatgaaggtgctgagcatacgagagacaaaaggctcccaatgcaggtagcacgtgtactaggtcctccagaaagtgttcttcaccccaaagggaaaccctgtacccattccatctttccctggcaactccacctacagcctgtgatctgtgtgtcatctccatgccagacacttgctactctgtgctctagactgcaaatcaaagcaggtggctagtgagaatagccttcctaatggagttccgtcacgtttggcttaagtgccaaaacctacctttgtaggcaggaaggatgctatgacaggttcacagccctagacacgcagaccccggggggtgaggcagggatgtctaatgcagaaagctctggcttctgtttttcagagaaaaatatgcccgaggtaaacatcaataaggttcctctaacacttgtgtcttaagaattcatctgtaaagtatttcagcagaaaataatctttcccaaagtgtccccaggccctatggaagggtttcctacccagctgacccaggaagaccacaaaccacattgttctgaattgcgtgagcttctcacctgtgatctggctggccatgaggtagacccaattcccgtcggcaggtcagacatatctaggcgttacttgctctctttttggtgtcaatcagtgtgttaaagaacgttcaaaatgaagagaaagaagctcgctcttccaggtgaaacgcagctgggaagagctgtgaggagcgcctttctgtggctgtggcaggtttggtgtttaatggggcgataggagacattgccttgccccactagcttttccccagtaacacctcgtgggggcgcccttggtcaccgtcggcaggaagccttagctcagagcctcgtggtggagtgaaactcggccgcagaaaggaatgaactattgatgcacgacagccaggagagatctcaagggcattttgccgagtgacaaaagccagtctcagaaggttgcatgctctgtgctttcattgatgtaacgttctcataatgctaaaatgctagaaacctgggacccgtcagtgctgtgggagttgagggagcatgtgaggaggttgtgtgccgatacagtagctgagggagatcttagtggcgacggaacacttctgggtctcagttgcagcgatacacatctacccatgtgataaaatgacagcactctacaggcaaattgcaccagtgtcagcttgccagcgtcgatacaacgctacggctacgcgaaatgtaaccctcaggagaacctgggtgaaggagacacaggacctctctgtgttacctttgcagcttcctgtaaatctctaagtatttcaaaaggaaactgactggctgggcccagaagaatgagggctattgaaccaaactggcctatgcatgggagggagggcacagaggcccccagtgtagctcagccctcttaccggccattcacccacatggttccaagcattgtggctgcaggagctgactcagagtggggctaaccacctgagcacgggggagcctctctttagatcaggaatgtccagtcttttggtttccctgggccacattgaaagaagaattgtcttgggccacacataaaatacgctaacactaacaatagcttgatgagctaaaaaaaaaaaaaaaaaaaaaaaaaaagaagaagaaaaagaaaacaactcttaatgttttgagagagtttacagatttgtgttgggccacattcaaagccatcctggaccgcgggttgaaccagcttgctttagatggaggagtcatcagatgctggtcgccatctcttggaccgctcaccagattgtcacatttccaggtatattaatcacatgccgaaatgcagaggctggaccagaagtttgctgtttagctcaggcgatgttgtaaacgagaacgaagaaaatgcgtcaagaactgtggggctgtcatgaaacacgctgctggggatggaacagaagagatgatctcagatgtggaaaagaccattgctgacacccgcgtcctcccacccacaccttccgcctgcagggggagctggatggggaagcgaatggggtccctgtgcttatggaggataaacacatggaggcttgcacctcttatttgaagaccgaggaagaataggggcaattgatggttagtattcagagaaagctggattcttctcagttcagcgctgactgcctttaagaaacacacatggctgggtgcgttggctcattcctgtaatcccagcactttgggaggccaaggtgggagaatcacttgagcccaggagtttgagaccagccagggcaacacaccaaaaccccatctctgccaaaaacatctttgaaaaaatgagccaggcttggtggcgtgcacctgtcatcccagctactagggaggctgaggtgggagaatcacctgagcccaggagattgagggtacagtgagccaagattgtgccactgcactccagcttgggtgacagagtgagatcctgtctcaaaaaaaaaaaaaaaaaaactgggcatggtggcacacatgtatagtcccagctactcgagagactgaggcaggaggattgcttgagcccaggagttcgaggctgcagcgagctatgattgtgccactgcactccagcctgggcaacagcaagacttcatctccaagaaaaaaaaaaaaaaaaaactcacataagatgagtttctatattggtcgattggtaaggacatggtggccagagcctggcagaagctaaccctctctttcccctagaagcaatgcttcattattggctaattcagtgtttacagctaccttggagaacataacttggcaaataacagaatggaccatagtatctaggaaaaccaatgagagttcttggctgggcacacttgtagagttgccctaaccctgctgcctcctctcctgggggcatcatggagcccactcagtagctaaaagtaatttccatgggcttgcatgggaagcgcagggttacgagaggtggtcagatgcggacgactagctctcgaagtcccaagctctctgccccgtaaggcattacccccttaaattagcatgaaccctgggaagggaggcactgtccctccatttcacatgtaatggagcacagtacttttcacacccctaaatcattccttttgatagtcagggttccggacacggggctggttgtggaggtcctctccacacaagaagcctcatgatgatccttaataagagggtggggttgctcagaaccttcaggggaagggaagagatcaccagagaagggaagggaagagatcaccagagaagggaagggaagagatcaccagagaagggaagggaagagatcaccagagaagggaagggaagagatcaccagagaagccgcctcttcccctgtgcccttctgtctcggcatcgcatggccttttctgctgctcatcagttctctggcatgaggtgggaagaagcccagggaacatgatctgctggtgtggcccccgcagtggaaagagaccggagacctgagcacagcgcccttcctggcccctaggaaggcgggtgacccctgcagtccgtggacgcctgagaggaggtggaacagatgctcgctcccagccgcagacccactctctgctagaggacaggagtgagcagttgaagccatgcttccccagaagcagaagaggatgagagtgcacgggggcccccaccgtgggaacttccacacctccagcgcactccctgtcccgggcactgctgatctcctgagatgcctcggctctctcccccttgtctggggctgcttgcaacatccacatctgtagctgagactccaggaagccgtcaacctgcagctgcacatcagtaaagaggcagaacgaggaatgaggtccatttgctaggacttcagtgcccttgctgtcacctgtgcttccagtgcctctcagggcatggtccagccctgtggaggcagacgctctgaggacagaaccagggcctggcttttagcgagtgccttggccattttggtacattgggaagttgttggattcccagctgccatcctagaaaataaatcagaaggtagagaatgagacccatagctgtaactaaactacaaggggaggtcagctccccgttgttctgtctttgtgaccctgaaccacctggacctgagaaaggcccaaagtcagggagggtgtcggtcacaggccctgaagtgtgcgttccgtttcatcccaaaggggtttttattgaccctaattatcccctagtcaaggggatgccttaatgtgttacaggagagtttttttcatattgaggtatcttgaacataggacatgaaatctttcctctccttttttctcctctttgtccaaaattaaatcaaatgagctcactgcagagatgccgctggaagcagcaaggtacagagcaggcagggcggccctctcacctgcccttcttaactgtgccatgggagcgggagattctgcaggctgtggggtgcaagaagtgtcacggagcctctctcccaggacatcttgtcatccctgccaacgtggcaggagagggtctttaaggtcttagaaagagactgtgttcacgcttgagacgtttttatcatgttactaaatggggcttcttggctgggtgcaatggctcacgcctataaccctaacactttgggaggccgaggcgggtagatagtttgaagtcaggagttcaaggccatcctgggcaatatagcaagaactcgtctctgcaaaaaaaaaaaaaaatttaaattagctaggcgtgatggcatgcgctattcagaaggctgaggtgggtggatcccttgagcccaggaattctaggctgcgttgagccatgatcgcaccactacactccagcctgggtgacagagcaggccctgtctctagaataaataaataagtaaactaaagaggcttcttgattgtgctgttcattgttgtaaatccatggagctgtgcaacagtgagtaactccagatgtcctccctccctactgcagcccctgcccttgatgtggactggcagaacaacacgacctttgcctcctgtagcacagacatgtgtatccatgtgtgcaggctcggctgtgaccgcccagtcaaaaccttccagggacacacagtaagtgagagctcttgtcactggtctcgagtttgtgagaatgtgatgtgggagccgattcttgtgtgcctagaattaaaagctactgcagcagcagaccagctctaatgtgccccttggctatttgagctgtcatggttaccccatggtaaccatggtggttggattgactcagtttggggttggcagtgagaacagttcactcagaaatgacctagatggtggatttggcaacaaagcctttaaggtagccatgagaaacatgtagaggacatcaaggaaaggatgctcacaataaatgaatagacggggcacatctgcagtgaatagaaaaaaaaatcattaaaaaacaaatggagactaagtgtggtggcttatgcctataatcccagcactttgggagtctgaggccagaggattgcttgaggccaggagtttgaggccagcctgagcaacatagcaagactctgtctctacaaaaaattttaaaaagtagctgcgtatggtgatgcacacctgtagtcacatcccaggagctgaaggctgcagtgagttacagtagcaccactgcactccagcctaggcaacagagcaagaccttgtctctttaaaaaaaaaaaaaaaaaaaagaaaagaaattgagaactgagaaatataatgtctgaaatgaaagtcttaataggtgggtgtattaggcagttctcaattctctcattgctctaaagaaatacctgagactgggtaattgataagacaggaggtttaactggctcacagttccttaggctatacaggaagcatggcagcatctgcttctggggaggcttcaggaggcttccaaccatggcaggaggtgaagcaggagcaggcacctcacatggccagagcaggggcaagaggtgggaggagtggggggggtgtcacatacttttaaaggacaaaaactcacgaagacagcaagccacgagggatctgcccccatgatccggacacctcccacgaggccccacctctgcatcagggatgacagttccacctgagatttgggtggggacaccgatcctaaaccacatccgtggatttaccagcagatgggagattgcggaagtaaggttagagagcatagaaattggccaatttgaagaacagataaaagatcgaaaaaatgcataaaggcttaatggcttatggaacaatatcagagaccctaaacctatatgcgtgatggggagagaagaaagaatggaacagaaaaatcatttgaggcagtaacagccaagttttcctaaatttggtggaaaacatcaacatttaatccaagaagctcagcaaatttcaagcagaacaaatataaacagaaccacacaaacagaacagaccatatccacctaggcatatggccatcaaacaccagaatcaatgacagagaaaatcctaaaggcaagcagaggctgacaaatccattatataccagggaacaacaatgggaacaacagctgacttagcaaattccttagtttggcctctgaggcgcttcccggtctttcaccaaatctccctcagattagccaatttctatggtctctaaccttctgcaatctccagtctgctggtaaacccatttactagcctcgacctcctgggctagtgtccaaaaattccctgtgcctctgtcctcctaaagacacgtgcagccaagcaccttgccccgcgctgagccctgcctggaatgctccctgccttagacccccacagcagctctcggtccaaaacagaatcctccccagtctccaggcccattcacgtatcctctgcacgccctggggaggattcacggcaccccctgagctcctactgcccacatgaatgccacagccctggcagtagctgctggcctgcgtgtctgcctctcccagaaaacgcagagtgcatcaatgctgggaccatggcatcttgcctttctctcaccagcacccaggatatctctgtggtggggcagggtgggggtcccttgttaaagcaggagaggatggtcacagtccctggagatttgccattgtgccactaacttaactgatgtaaattcccttgtcctgattcccctaatgcccacctctccccacccctggcccaggggtccctgtcccaaaggaaggcgcttttagagcacaggcacctatcgtcctgttaacatctgtttggctccaaactgactctcttctcccggtctaaacttatttctcctctaaccctggactatccacaagtttttaatagagctgtacacactatctgcagttcccaggtgtcctgcccaggaccttgccaccagcacaggccttggccctttaagtgggtcttaatgtggctgatggccctgaacaaagctccagctcagtggggttgagtggagacccatgagccggctctggaggcggcccaggaaccggggcttgcattgcagagctagggatccgctcccaggaagttatttgttcctttgcatgggcttggctagggacagccagtggtgaccagctctacattcctgggcccatgagttttcctctgaacagctgcagtcagagccacccttgctggccttgcatacacattcacactcatagacacccatgcgtgtgcacactcacaaccctcagccccctctccagtcggccccctccaccctcccgggctctcgcagcagcctgcccctgggccgcgaaacttcttcctcctccctttcctgggccacgtgtgcctcatggaacacagatgtggccttgtcactgtccagttcacacccttcaaaactccatgttcttagaaagcaacctgaccatacagttaatccaaaccggagcccttaggagtatgaaatttagaaaattcattatgagtgtgtcattagttaattgttaggccgggacagcaggtgtcacatggtgggactggactggacatatggggccctatagtcacccctgagggagccccaagctggtacgccatgtcccctcatttctcctgggtaggctgttccccagctgaacctttgccacaggtggttcttttacacatgcctgtcccggtagtgtccccgtctcccttggcccctgggtacattcattcacctttatcctccagggtttagcctcgtggtccccaggtgtcctgagcctgtgcttttcgctacctggctgtgccgatcacgagcccccagccaggattttgcctgtgtcatgtgtgtttgtgccactcagcatttgcctctcacttgtgttgcacatgtgtgcctgcctgtgtgtgcatttgggtcgcccatcttccacctggatcagcccttaccccgcttgaactccgtaataggtgagggttcacttctcatgtttacccctccctccgcctccactcacctgcaggagagaaataccttctaatgggtgtggacactggaggaactgttacattaaaagtgcataagaggcctggcatggtggctcacgcctgtaatcccagcactttgggaggtcgaggtgggaggatcacttgagcccaagagttcaagaccagcttgggcaaaaatcccaaaaaaaaaaaaaaaaaaaaagggcatggtggtgcctgcctgtagtcccagctacttgggagggtgaggcaagaggattgcttgagtttaagaggtacatgctgcaaggacctgtgatcctgccactgcactccagcccgggagacagagtgagaccctgtctgaaaaagaaaagtgcataggaaagtgattttcaaaggccaatttaaaaagtaactggttttactggttttatttgctgcgttttatggtatgtgatttcttcacttgccttccttcctagcagggaaggtttttttcttaatgaagtatggatgagagtggctggtgttgtgtggtatagggctgtggttttatataaatgaaaaaggcaaagtgagaaaaagaggaaactagatggctggttgggctgtgccctttgatgtcaggctgaagccgaagaccttctgcagcgccggtggcgcgctgctgccccctgctggaaggtgacctcatctactcacaggccctgatgtctttttcacactcttctgctctctttcagaacgaggtcaacgccatcaaatgggatccgtctggaatgttgctggcatcctgctcggatgacatgacattgaaggtagagtcggcatggcaaggggtgggctgtttaatcctagacaaccccgggcacttgatgccagtctcacggtcactcttacatgaggattatttattactgaccaccctcccttcctctgtcatccggtgagctacgatttctcagtcatagtcccactgagaatcgcagcctccctgcagcctttctcaccactgtgcaccctccaccctgccctgggccccgtgtgcacccccgggaggaatgattccacatcgttcccggatgcaggaatggcttttgctcatgttgtgtctggtgtgttctgtagatctggagcatgaaacaggaggtgtgcatccatgatcttcaggctcacaataaagagatctacaccatcaagtggagccccactgggcccgccaccagcaacccaaactccaacatcatgttggcaaggtaagggcaggcaacacagctggcacagctcggtgttacacaaagacaacaggaaattctgctaaagcgcgtccatgcacgtgtgttgaagcccttcagaggaagcaaagcggtagctcactttgaaggggccaggatagaattaccgagtaacacctgcctttgaggtaaggatggttttgagtcaggcacagtggcttacgcctataatctcagcaccctgggaggccaaggcaggacgatggcttgagcccaagagttcaacatcagcctgggcaacatggtgaaaccccatctctacaaaaacttagccaggcgtggtgacgtgtgcctgtagtcccagctactcaggaggctgaggcaggaggatggcttgagcccaggagattgaggctgcagtgcgcggtgatcacaccactgcactccagcctgggtgacagagcaagaccatgtctcaaaaaaaaaaaaaaaaaaaacagaagaagaaaaaaaaccacccaacatgactgcagagccacagttgagggacagcaagccaggcagcaccaactcctgttgacggtgctcgaattaaggtcatctcttagagaggacaggatggaattcctgcatccactgagagacggaaccaaaaaaacaaagaacacataggccgtaattctcatatttcaagtaattgtcataaaatccacttaaagtactgtgatatagtgtgatatagtactacacactcgagttgttttgtgatgactcagaaggtgcttttgcgtcgcgtggtactattaggagcataaattatccttttagtcagcaagtataaaaggggcatcccggtacctaatgggtccctgttgaaagaaagcaagccagacaatagctttgtgatagatattactgttctaagtttgaaaataactaaaatttgcagctttcaataatgtgattacgtatgtggatgtgattgtattttaattcttgtttgattaaaatttattttctatttagagacagggtctccctatgttacccaggctggtcttgaactcctggcttcaagtgatcctcccaccttggcctcccaaagtactaggattacaggcatgatctactgtacctggcctaaaaagttttttaaatgtttattcacttaatttgctatttttccaaatatggctgtctgtattaatttagttggtaataatagatgtcatgttttaaattgtaggggcattttaggaaacttgataaatattctacaaaaatatttaccatttacgtctataggaaacatagaaacagggctgggcgcagtggcttacacctgtaatcccaacagtttggtagggtgaggcaggaggatctcttgagcccagaggttcaagaccagcctgggcaacacagtgaaaccccgtctctacaaaaaataaaaaaataaaaattagccgggtgtggacctatggttgcagcttctctgctgaggctgaggcgggaggatcacttgagcccaggagttcgaggctgcagtgagtcatgatcacgccactgcactccagcctgggcaacacagtaagaccccatctcaaaaaaaaaaaaaaaggtgcagaaacaaatgtagatatcaaattgtttccctaataagaccattaaagctttttttctgtttaatgactatggctttgtttttaatacttgtaagtagttacagtttagaagacaaaaagctttttagttattatcttttgaaacgtaaaagctgggaaaaacaactcctggagatctgatacacattatggagaactgtttgaaaccaccgtgtgtatgtgattttgctttctctcccaccttgctagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcaggtaagctcccgacccctacaccaaatccttttagtaagggatgcccaaatagccacgactccagtgcccttggctcagagcagtgccccggagggagttgagcaagctcaggctccccgggcagacccagtggatgctgtccacgtgcaccccacgtgggctgtcagctcttcccccaccagacacctccggcagctcccctccctgaggaagggcgtcgtgtccaccgtaatcatggctcttggccatttgattccaaaccctcaccttggcacacgttcttccttgaaggagccgctgtcttctgttcacttttctgagtccatggcacgaaaccttccacctgcctcttcctcttcttagcagttatcaccgaagtgctgctctctagatactgaggttagaaggtgggagtgggggaccagctaacggggtcaaggccacaccagctcctgcagctcccttacggagcagaccagggagtgggaaggaatgtgctcttgctgttgtcatgccacttcaatttttcttttctgttttgttttgttgttgttgttttttgtttttgtttttgtttttgagacggagtctcactctgtcacccaggctggagtgcagtggcgcgatcttggctcactgcaacctctgcctcccagattcaagcaagtctcctgcctcagcctcctgaatagctggaattacaggcacccgccatcatgcccagcttatttttgtatttttagtagagacagggtttcacatgttggccaggatggtcttgaactcctgacctcaggtgatccgcccacttttgcctcccaaagtgctgggattacaggtgtgagccaccgtgcctagcctcaatttttcaaatcaaagtaggttctgtttgaggacataaggtatgtcaatattgggttgtccttttagcagggattgaaaggacataggatttaaataaaggtggctgctgtgggtatcttgggccacacctgaggatagaagaattccagctgtaaagtgtagaaatggatgggaagtagcactgcatagcataaaggattgtatagggccatcagcacgtgattctagtctaagggaagagagaggtgataatatgctaggagctgttgaaaataaggaaggggtccctttcgcctcaggaggggaggaatcacacagccttccccctgccccctttcatctgcactgccttcttggttccttttggcttggttgacattcaggtggatttataccctcaagttcattccccctgtggactcaatggtgatgagccctgttcactggcaaggggtccactgagatcacaggcttcccagggacctcatgtgaaccacatcctctcagggaaggaagggaaatggtggaccctgcgtagagccaacccgacgccaagcccagccccacagccctagatagctctccgggaagcacgcatctcagcactagtgtccaagagtctccgttcctgaaatcctcgctagaaatagtaatgggtggatttgtaaaaagaacacatcaattatcaaaacaatgacatgatcagttaggtacagcctgttgtcaggaactcactgaactgtttcaacccttttttataaatcaaagaaatccttaggacttttcttttttttttttttttttggatcggagtttcactctcgtcacccaggctggagtacagtgatgccatctcggcccactgcgacctctgcctcccgggtttgagcgattctcctgcctcagcctcccgagtagctgggattacaggtgcgcaccaccacagccggctaacttttgtatttttagtacaaacggggtctcaccatgttggccaggctggtgttgaactcctgaccccaggcaatctacccacctcggcctcccaaagtgctgggattacaggcatgagccaccgcgcccggccaagaaatccttaggaattttcttaagagaaatcttaaagcccactttaatctttctccaagtataaaaatacttatctgtaatactgccgacacacacctttctcagttcatggaacaccaccctttaaggggcccaattgagcagaggatttgggacagccctcctggtctcggtgttcagatttctcctgcctgtcaccatagtgaatcatgagtgaaggcttattcgactctttctctcttttttattttttaaaattaatttttgtagagacgaagtctcactgtgttgcccaggctagtcttgaactcttgggctcaatccgtcctcccgcctcggcctcccaaagtgctgggattacagggtgagccacctcgcctggccttattcaactctttcaaaggcctcaacttcccctacctcttagatttgtcaagttaatgctgttttaaaccggaaaccaatggtctgtggtgttttccattacatgtatattatgcatttcttctttcaaatgtccaaaaatacgtacattttaatgtcatggcatattattacatttaatcatgaattacagtcaatttaattgctactggggtgggtgtattcattatgttgtattcattcaggtcctccaaagaacagacaccagaacaggattagatgggcgagagatttattgggggaaagagctgtgatggaaacagggaggaaggtagggggaagggagaattcagaccataaggccagtctgaccctgggaaggagacgggaagggtaggaagagtcagggatggcccttacaggtctgtagaaagttttggtcgtgctgatggagagtccatgagccacttacccaccagatgagtctgagtctcagcaggtgactgccatggtctcccgcctccatcagtcctcagctgggtgcagcctcagaatccacgcaaatgtggcagattccgcaggcataagtaatcaggttcactcctcgtggtgggaagtcctagaggcacatctccatggcccccagagtccttactgaaaacccttaaatttcaccatgcttgaaaatgttcatgacgaaacgtcagggccggaggagcgcacattccacacctgcatctgtcgcaggcgccccttgcgttgtaagtgacagctgctttgctttgcagagtggaaatcttgtccacagctaccgaggcactggcggcatcttcgaggtgtgctggaacgcccgaggagacaaagtgggtgccagcgcgtccgacggctctgtaagcaacacctctggtttgctggggagtggggtgttgggggcagctgatgcctaagtgagcttccagggcgtgtgcagcattcgtgtcctgaagggcctagcccagtgccaaaggaagcttctgggctggatcccatcggagttggtaccacatctgggaatggccttctccttgtcccttccagagtgtccttctagtcaacattttctcagtcaaattggtggttctcaaccagggtgattctgcacctctaaggacattagacaatatctggagccattttaggttgtcactacagtcatgtgtcgcttaatgacgggaacgttttgggaaatgtgtcattaggcacttttatctttgtctgaacatcatagagtgactgacacaaacctagatgataatacctgtcccacaccgaggctgtgtggtacagcctattgctcccaggctacaaacctggacagcgggtgaccatactgattcctgtaggcaaccagaacacaatggtaagcatttgtgcgtccggatctatctaaacatagaaaaggttcagcagatatatggttataatcttacaggaccactgcggtctgtgcggtgcgttgttgctggaaacgtcattatgtgacgcgtgactgtgcttagatgaggatgctgctaaacctcctactgtgcacagggtggccacaattgtcacccatgctgtggctgagaagcccgggcctctggtggccatcctgcaggtctcctgggccctcttctcttcccatggggcatctggatttcttattttcccctggacttgaggttgccctgacctctggggcaagcggccgttctggctgaacggccaagggtcagagtagtccccaaatgttgtcagaggctgtgtacttgggctcgtattgtcatctgccccacgattgcaggtgtcccttctgggacctctgccactctgttaattcctatcattacccttaacctggcctttctgctctgtgctgtttgcttcagtttgctcggtccgatgtccagatgccagtctgttatgagagcttctctgacccttcatgacgatgttccaataaactttactgacaaacatcggtggagggctagattgggcgtgggggccgtagcttgccgacttctcactctaaaggcatctttgtattgtctctcaagatgacaggtgctttatctttccttccaggtgtgtgttttggatctgcggaagtaaccacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggattttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagtgggtagggtgcaatctggtgtgtgttccagcagtgagacggtgttattgtgaaggtggcattcatctgcggagccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcct

SEQ ID NO: 2955 - DNA, 256445 bp, human
ttgcatgtaatacctcagcatcagtctgcacaagcccagggagcccaggagcaacgaagggcaggctcaagggaaggccccaccatgtccttctggggggccttgaatggcaactgatacataataagacacaatctattctgctgattcacaattatggagactgtgtaagtgtgtatttttttattgatgtcctctaatgatggtgtagcaacagtcgttttgcatcattgacgttttacagcaatattttgcagggtaattttgaggtccgccgttttggtggaggaccggcctcttaaaaactcacctccggccgggcacggtggctcacgcctgtaatcccagcactttgggaggccgaggccggcggattgcctgaggtcaggagttcagaccagtctggccaatatggtgaaaccccgtctctactaaaaatacaaaaaaaattagctgggcgtggtggcatgcgcctgtaatcccagctactcgggaggctgaggcaggggaattgcttgaaccagggtggtggaggttgcaatgagccgacagcgcgccactgcactccagcttgggcgacagagcgagactcctcagaaaaacaaaaacaaaaacaaaaaaacaaaaacctcaccttaggtccccctccccctacaaccagaacaacaaatggtctagagttcgaggaagagcaagtgaggttatagtttagattgctgagtgtaccgggctcttagcacgaagctcattatatagtaaaggaaggggcaagaatatttgaaaaatattcaacgaggctgaccccagaggtgctggggagggggagtggagatctgtttaactgaattaaggctgcgagtggttgggagtagcctacgtggaggggaggaaggagcgctggggacttaggtacaccggggccaggccgtgtaagccattgcaacataaagcactttgcaagggccagagggctgatgcctggggggttggggtgggagtgatgaggcccgagtgcccaggtccccccaacctcctcagcccccacacccgagttcctggcgcctatgcctgtgtgtctgagtttgtccctaagcatttctggctcttcttgggaggtgttttgcaaaggtcgaggctccgccggaacccccactttttgagctggggtaaagactactggggtgtcttctaagacgccgattttgagggagattcaccatcgggcaggtggcagggggttctgttggggcagccgggtggcttcctttttggggtgggggagggtaacactttagcagtgatcgaggttcccctgccccctagaaactgagggggtggccgaggttcccgtcccctcgaggcagtcgtggaaaggctgggtttgggatgtgatgggggtagccctggggtcctctcagtcccacggaggccacggggaagggaccgggaccagagcaactagggagaggcccgggttcccctcacccaccctaggcgtgggggagcggggcgggcttggtagggacgctggtcccccgaccgtgggacaggggctgggttgggacgcgggtccccactaggagccgcgggggaggggcagggccggagtccctaccctcgtaggggaggggctggttcgggacgcggctcccccggggcgcaggggcggggccgggtggtacgccgggtcccctcccacggccgtgagggaggggccggcggcgggggcggacccctggcggtcctcctggctggggtccgcgcgctcgcggcagctccccgtggaggtcactgtccgtgccagtccctcccgctgtcccgccctctcccgctgccgccgccgccgccgccgcgcccgcctcagcgcccccactccgcgcttgggagcgaggagccgccagcgcccccgccccgccgccgccgcagcgccctcaggccgccattcgccaccgaaactttccagcgcccgcgctctctccgggactcggcggcggcggggcgggggcggcccgggggcggcgcgcggctgctccggggcgccgggccctcttcggccgccgcacggccgggactcggaggctgccggctggagggaggttcggagcgcggccgggcgcgcggcgccgccacaagttgcgctgctcgcgacgaggtgagtgcgcagggctcggcgggccgggcgcggggtccgcaaacttctgcggggaggcgggtcccgcgctgaccctccagggtccggccggcggctcggggcgcccgaacgctccacccgcccctggaactcctgtaggtgcaggtcgccaactgtccccgcggcgctcggactggggtgcggcgcgctcccaggagcctgaacaataccccgaggtggccgctccccgaagtgccggcgcgccttgcggggagagacggaggtcggcggggggctcctttgttttggggagggggaagtggccggtaagtttagggaagcgctcggcttttcctccggtgcccctttgtctgccgattcaggggcttgctgggcaaacctgcgccaccgcgggctccggggaccggggtggagggcggtggcgggatttccccgctgttggggagaagagccccattcatacccgggacgcgggccggccctcccggacccgggtggaagcgcagcctcgcggagtggggcaagcggcgggcgaggtggcgcgggccccgtgtctgctcagtttctgacgcgcagaaactgtcaaggaagtcgggagccccagtcctccgcccatctccccggcctgagcgcacggctgggctgggggcacccttggcccgtcgagggtctgcagagcgccgcccggggagagcgcagacctgttgctgctcctgggctctgacggggcgggtggggtgggtctcgcagatcctgggccccggccttgctatccagggggaccttccctaacgatgggaccggtgctcggagtggagtatggggagtgcgccttcgggagtcggcgctggccggatatgtgacaactgtgggtcgctggaggcccgcctgcgctgggatagggcctggacttcacgtgcgtcgcctgtgttccgtcagaccggggccggggctcgctccctgcaaggcctcgtgttcccccagccagctgcgttggacgttccacaaaggtagggactgacgtttattctcgagtcagtgatgttctggagcaaaacctaaaaagaaacaaaaacctaccctctattgtatttgcaactgtttctgctttgcattgtcatgtgtggtttgacctgccttttggatgttttcctctcctgaaacatcgcccagtccctggtttaacctggaaggcgagggggaaggaaggcaacctccctgctaaggttccaggcagtggctttggtgttggaagtggcacttgacgattttatgaaaagtttacaagtccttcctagaaaagatgtaattaggaaaaataaaatacagaagaacgttgagtatgacgcgtttattttaaagggtagtcctgtctcaaatgtgctgcacatttttgtggaaagccaccaagctgggtaactaatgcaaacaacaaaagttgttcatcactggatcaccggcccttaaggcgattccagcccttagtagaacacacacctgtagggcaaatatggagatttgtggtgtagtgctgccaccctcgctccccaactctcaggcattttgcccctttacctcagagaacttctctctgtcagtggttttaaagaggaaacagtttgcaaaaataactttattgtagacatacttagaagtgaatgtttcaatttctggagttttcccatcaattatatcagtaccactggttctgtacaacatcatcttagttagaagattttttttcaccttttaaggtgacgaacagaggcgggaaaatggtccctgcagagggaggccatctccagcaggtcccgagggtcaggaattcagattatccgatctactcctgctggataggagcacacctccgctagaacctgggtccggccccctcccagttttctgcagggcgtccagattccggtgctctgccccgcagcagtgccctgtgggcctcctggcttagctgatcagcacagcttctctgcccagcgaggcaggaccatcctcccactgctttcctgatgccttggatttgctttttttcctcccttaggaaaagcaaaaaaacctaatatgctacatccgagaagttgttaatctttcactaccacatgcattgaaaaatcagttccacccaggaagcaacactaaaggcatattgtaaacacttttttttttttagttggaaagataaacttttttcccccataactatttttagttagccggagactggactcgagtttttacctccggtcttgccccctccactcccgccctcactttctgtggggctcgaccacatggaccatgctggccagactggcaaacatgaaacccaccagaaccaaaagaaaagctggatatgggaaggggccgaagaagtccacatgtttctaaagggcaaagagcctaggctgaggagagacgtttcagatctccaggggagaaagacagccgttaaggagtccgccgggctgctgcctgcctggccagcgggagcctgacttcagatgcctgcgcctcccaagctggccccctcccacacagccatcgccatccagtatttagggagaatccaccgcatgcctgaaggttgcagaagtgaattggaaaccgttacaaatggaattggaacaaatttaaagttaagatggaagagagaatatgttgagttttcagaggaagtcgggtactgcttccttttcttgtctaggtttgttcttgtccgatgggatcagagagatttgagatggggcatgataggcggcgggttcaggagaaagggaagctttagaaatgaaggtagaaaagatgcttgcttattggaacagtattttcaacgttgagctctggaatgttgcagccaactaatggttctcatttgggacagttttgtcccccacttttgaagggagcatttgccaatgtctggagacatttcccttcctgcaactgttaaattagcaaacaggttgagccagctgggtgtggacctgcattttcctcgtggaggccctcttccaagtgtcagtaggaaaagggctcccagagtgtggtcctgctgcgggaccttggcccccacgtccaagtgagccccagaggtgccccaagccctgcctggtcatggggaatctgggctcccgctgaacttgggcgctggggacagctatgagggaaacctggtttgcagctagcttgccgtgcactgactggagctttgggcaaatcagtgaacttctctaacattaattttctcattgagagaggaggtgggtaggagtatatatatatatatgtaattatatatataggggtcgggtagagggagagagagatttcccaggctccttgtattaaaggagatagagttattatatttctcatttagtttttatttatttgtttattttgagacagtgcaattattatagctagctgcagcctcaaccttctgggcttaagcaattctcctgcctcagcctcctaagtagctgggagtaccaaatgcgcactaccatacctggcaatttttttatttttatttttagtagacacaggctctcactgtgttgcccaggctgctctcaaactcctgggctccagtgatccttcctccttgacctccccaagtgttgagattacaggtgtgagccactttactcagtcgaccgacatagaattattataatgcttggagcctaacatgccttttttgtttgtttgtttgttttttctgagacgaagtctctctcacagcccaggctggagtgcagtggtgcgatctcggctcactctgcctcccgggttcaagcgattctcctgcctcggcctcctgagtagctgggattacaggcatgctccaccacacccggctgatttttgtatttttagtagaggtggggtttcaccatgttggccaggctgggctcgaacttctgacctcaggcgaccctcccgcctcggcctcccaaagtgctgggcttatgggcatgagccatcgcgcccggctagcctaacatgcttatagtttcctgttttctgaagttgggaattgggtctggaaaggtatcaccatcagtcacgatggtgtctagtagtttgctttgtttttttccttatcttttccctcttacattttagggctgtatctatataattttattatttaaattaccatatggtaagtttgtctctttgggtgcattatgagtcttgacacatgcatagattggtgtgaccaccatcatcatcaggagagagaacaatctcctcagcccagagatgttcatggctctgtctcccacagttcctccacagtcaccccccccagccccgaatctggggcacccagccatctgctctgctctggaagtcttggggatcccatctgaatgtaacacatggtggaatgccttaggtgaatccatccgctcttccagtaccacctttgcctcctctctctgatgacacatgaacttcatgcctttgtgtgctttggccaaccgcttttcttagaacagcacattttgcactgtagatgttatcacaagcaaggaaaaaacagctttgctccttaatgtaagaaaccacagtggaaaaacatcaggtgtgttgttgaggctgctaaagctttgctcctttttaaaattttttaaaaatttttctggatacgtaggtgtatatatttatggggtgcattagatattttgatatagtcgtgcagtgtataatcacatcatggagaatgggggtatccattccctcaagcacttattctttgtgttacaaacaatccaattatactcttttagttatttgctcttttttcttttattttgagacggagtctcactatgtcgcccagggtagagtgcggtggcgcgatctccgcccgcaagttcaagcgattctcctcctcagcctccggagaagctgggactagaggcatgtgccaccacacctggctaatttttttgtatttttagtagagatgggtttcaccatgttggtcaagctggtctcaaactcctgacctcaggtgatccacctgcttagcctcccaaagtgctgggattacaggcgtaagccagcacgctcggcctatttatttcctctttgttctatgccagttagttcttgatgcctcattgtttcagatgggacattttctaatgtcgtgtttttgtttttgtttttttgagacagaatttcattggtgtttcccaggttggagtgcagtggcatgatctctcctcactgcaacctccgcttcccgggatcaagcaattctcctgcctcagcctcccgagtagctgggattacaggcatgcaccaccatgcccggctaattttgtatttttagtagagatggcatttcaccatgttggtcaggctggtctcgaactcctgacttcagatgatccactcgcctcggcctcccaaactactggaattacaggtgtgagcaaccatgcccgacctctgatgtccttttagaggatgttaccctcacctttattgcacagtcctaccaaaaggtacttcatatgtgaaatgtatcagaaggttatagtcatggctttagtttaaaaacaggatacatgttcattaaggacctttgccgttttcccaatgggttaatcacgtaaatataaaataggctaaaaatatcaagttgtttttgcctttgttgtagaaataaaaaaatgaattcctacatctgtgtttctatggagctgctaacctgtgttttactctgggccatatgtcgctttctgtgatctcatgacgtggcatgttttctaatataatccttgtcctggcattttggtgacttttgtcctgcctgaggtggtctacctggttgtgtgaagtcacagaacctgtgcatgtcctaccgtgtagagttaaagggctggatgagtggcctcaagccttttcctccctcccaggtgtgaagatttggtttggaagatggaccctgcttcaaggtctgggaggccatgtttttttcagactggttaaggatgacggttttatgttaactaaacattgggatcaagtgacagttgtttatgtccggtgcctagagtatcagttttcccatgattaaaataagcgatattttggtaaacattgataagttagttgcgcattttagttcagaaacccacagcgagtcagaaggcgctttgtgctgctgggcgcctctgagtgattccggggagtgcggcagttctccagccccaggagaccctgtgaaagaagcacaaacaatgctcacggcaaaactcacagtgtttattcttgacctgggtgtctgccttgaattcttgtcatttttcctatcgtggtggatgtagccggaatgctttaaagaaaacatgagagttttttctgcctgtttcccttgagcctggaaccgattatgaccccagatagcctgcacagggctctttcctttctggaacacctgcccaggctagaatatgggagtagggaggaggtgaggctctctcctgcccggtaaccttcccggccagctctccaagacgctgaaaccttccttcgggtctgttgaaactgcatccccagcaccatcatgtcggagcaagaagagaagggcatgtgtcccctttaggcttgactctttccaattagggacctgcctgttgttaggatttagagtccatgtgaatgtgcagtattgttcagtgctgcgagcatttttgcttgtctgaatttcctgatagaagggaatttggacaaaaagaagcttattgtacatggtgccattttattccttaaatcaataataacaaatactttatttatgtatttttagagatggggtcttgctctgttgccctgatcatagctcactgcagccttggctttctgggctcaagtgatccttctgcctcagcctcccaagtagctgggccgacaggcacaagtcagcatgtccagctttttttttttctttctttttttttttttttttaattttcaatttttttctagagattgggtcttgctgtgttgcctaggctggtcttgagcacctggactcaagcaatcttcctgcatcggcctcccaaagtgctgcgattacagttgtgagctactgttcctggccaacatatactttaatatggcaagaccatataaaataattttaagaggccaggtgtggtggctcatgccccccagcactttgggaggctgaggggggcagatcacgaggtcaggagatcgagaccattctagctaacacggtgaaaccccgtctctactaaaaatacaaaaaattagccaggcatggtggtgggcgcctatagtcccagctccttgggaggctgagacaggagaatggcgtgaaccatggaggtggagcttgcagtgagccaagattgcgccactgcactccagcctgggtgacagagcaagactccgtctcaaaaaaaaaaacaataattttaagaactggaggaaaattcagcaggactgagtcgtgatttcagtttctggtgcactgtgggtaattgggtaattgtcagcctggatgcttgtgctcctttagttgtcactgttaccttgtcatctatgtgaagatgagaaatgaagttgagtggagaactgtcgccaaagtctgccatgtaaaaatcggtagtgccaatgtgcaaaggtaattcccaggtgctataaaagtccaggtggcttcacagtttcagattgtatttcccgaaagcgtagagaattgatatccctgaataggaaattgacgtccctgccatttggttcatttggggaacagaataaacttgtgtccttgccttcagttcttttttcaacagaatcttatcaagcatttgaatcgtacacaactgtaatgccagctccatgttgataaaaactcaagaattcaaaattataaacttgaaaacagcaattgccaacttctgacagtagcaggagagtctggaggacctgttcagaggaagtcgggtactgtttccttttcttgtctaggtttgttcttgtccgatgggatcagagagattgagatggggcatgataggcggtgggttcaggagaaagggaagctttagaaatgaaggtagaaaagatgctttcttattggaacagtgttttcaacgttgagctctggaatgttgcagccaactaatggttctcatttgggacagttctgtcccccacctttgaagggggtttggtttaattcccaatttgattatgaagaaaataccagattcagcttgcattttcaagacacagtggttctatgtcaacttcagccatttccagggatctgtcttaggatacttcaaaaagcctaacctttgagatgcactcagctcataagttcgtgaaaataagaatgaataatcttccctgtccagtacatgacagaaattattgtagaccagatgagagcaaggagagatacttgttgatattacatgtcacgggatgctctgttaaattttatgggactctgagtgtaattcctttaagccagtagtctctaaatttgggggaaggacaggggacagaaatgacttgtttcagattttaattcccaaaagggtcttagtgagtttcatgccctctggcaggtgcacagcaagatttattgggatgcaggaagaaattatgaaaatgtccattaagaaaatctctaatacttgtaaaaaatatatttcttgtccatgaaatgcatgttacttgagtattttatatatttaataaattacatgagttaggagcaccttctgaaaacttttttgctgaaaaggatatatgatgaaagaaacatttatgatgtaggtccccaaaggctggaagagggggtgataccaacgtccctgcctgcaggtaggacacagttgtactcccctttcctctgacttcagctactaaggtatgtgtgcgtttgcacgcacatgtatgtgcgttaagtaactttgagatccaccagcttaaggactggacatcgttccagaggtacaggtattagtgatttgacttagggaagaaagaatatgcaataacagggaaccatgcacatactggatctattgtattttgcgtgttgtttttaaagctgaaaaaatgcgcttgtttcggaactagatgacagtacctgtttgcaggtccacaaggaaaccttggaacaatgctatgctttttaagcgttttatgactgcattgttttcataatcactgaattctgtttataaatcagctgatttcattgacggatgccctcagggctctggagaattaggcgttttgctgcagaaatggttcagaatttcaaagacatcaacgtgagattgtactggaattgagttgtgataaaagtcctagggtgctttaaatctttaaatctggttatttgtttgtttgttttttgaggcagagtctcactctgtcgcctaggctagagtgtagtggcgtgatctcagctcactgcaacctccgcctcctgggttcaagcaattctcctgcctcagcctcccgagttgctgggattacaggcgcctgccactgcacccggctaatttttgtatttttagtagagacggggttttgccatgttggccaggctggtctcgaactcctgacctcaggtgatccgcccaccttggtctcccaaagtggtgggattaccggcgtgagccactgtgacctgctgtttttgtttttgagacatatttcatctatcatggttattaagtgttttgtttttttgcatttctcattggtgttttttgtttgtttgtttgtttttttgagatggagtctggctctgtcgcccaggctggagtgctcagctcactgcaacgtctgcctcccaagtttaagcaattctcctgcctcagcatcccgagtagctgggattacaggtgcccaccaccaccacgcctggctaattgttttatttttagtagagatgtggtttcaccatgttggccaggctggtttcgaactcctgacctcaagtgatctgcctgcctcggcctcccaaagtgctggaattacaggcgtgaaccaccacgcctggcctcattaggttttttttttttttctgagttgctgctacactactggtgttacagagtgaataaacataaaaattatattcacaactcagaccacattgtgggctgtggaggtgagaaataggaatcatctctaaatttaaggtcttctggctgagctcatttgcttagaatggctgaaggtttggttttcatgagatgaaatgccaacctcaagtggttctgggtttccagaccagtttttagtttgtttaacttgagagaattgatatgtcagctttagtttttgtgtgtaatttttggtgtttgcatctgttttcttctttgtgaatattgaattcgcaacataactttgttatatgaaatgatgctcatacacttgcgcagtgcattagaaagcctgccaggagcagtacttgtagatttccgtgtaccagcaggatgcctaatgccgaccatgattaatgctcatcagaatctatgtagacctccatttgtcctttgataagctgaaatatttgtgtctactttttaaaaaacctgttgcttctctttatggtaatactcagaaggcactcactgtgaagagaggagaaacaggaagtagaattttttactatctagattgatgcacctatctcccctctccagagaccaatgcatttaggccccagtaagaaatttagttgtaatgaaccataaagcagatgcagagtatatttgggaatataccttatctgactccacagcccaacccctttaagaggaaagagatggcacaatatattttgctttaagccttagactggtcttgacttcatattggaaccactgaattgcttcagctgtgaactggaatcctctcctgtctttgttgttgagtgatgacactcttaattaatcatttgcttatttgccatccaaatcaccctatataatctttcagaagtgtatctcagagaatgaccctaagtcggctgacctctgaagcctgtaccagaattgactttatttcttaagcgcacacttcctgtgctttcaaggggcagctgtctaggtttagtttctgggagtttgaggcacagaggtatgtaggggaatgggaaggccaaatggtaaaagcccctgggacgtggaatctgtgagtacactaaccttgaaagagattatgaaaacaaactttagagcattgttgaagcaccatctacataatttatatcaatgaagacagtaacttattaggaagacaggattattaaaattaaccattttcatctttctacaaaaataaaaatcaaatcaattttagttcagataattgtatgtgaagctttataagtgaaaatttgaagttagcaaaattatataaccttagttaattatattagtgtactcaaactaaatatagaataagattagctcatggaaacattgcatttttatctcagtcagtactgctcatatccacccagtagttagtttctagttacgttttgtaattttttgaatatcctggacatggttttagaaaagttagttgaaacaagatattgtatgctttcattatttcccagttcatctttaagcataataaaaacacagagtaagttgtcctttttgaattttctttcctttctaatatgtgtctggcacaacagaggaccaagcccagggatcattaatcccatttttctgcatggcgtttgctgtgagagaagtttgggctggattcgtagtttgctatctaagagtaaatgttcaaccttctctaatttcctgttttgtttgcttttccattcagtgttctatatttggacaacaaatatatttttctgtatgggtttctggtggcccagatgttcattggagtggaaattctttctgtccacaccactgagttgggcagttactggtgtttggctttctctatctcttggagttgacttagatacattgtgtattcaggttgggcactcatcccctttgcaagctctattactttgttccatttggctttgccataaatgtttgcccttggcttgccaagacgtcagctttaagagatatgtcatttaacttagaactcttgagtctgacttaaaattaagtcagttttcttaaacattgttattgaggtataaatgacatgccacaaaagtcacctctttgaggtgtaccattcagggatttttggtaaatttactgggttgtgtagagatcaccatgatgcagttttagaacattttcaattcccaataagatcgctcctactcggttctcacccatttctgctcccacctccagccacgggccaccatgaatatccttcgtgtctctatagattccccttttgtggatattttagagttgtgcttccaagaatgagtatctctgtgcttggtcgaacttcccggatggtgagacctgatttagtgactttgccttccgccccttcatccccaggagaggaaggtggggaaaggggaaagacggcaagtatagtagtataacaggcatcgtgcctcagtttcctcatctgtaaaatcaggataaccatggactagtttcaggctctaaatgtgaaactctgtaggaagtaattagctgggaatctggcatagaggaggagctcattgtttgcgtgttaacagtgggaaatagttaaggaggtgggaaaagagctacctgtagaaaggtggcctaagtccctggagagctgagcacaggaccccagggcacacacccccttatgcttcccctgtctttcatcttgaaagcacctgcctgtgaacctcaggcttggagggaatctggatgttttcccaggatctacctctgctctatggtcctcaatccaaggtagttttgaaaccgcctttgcaaaaattatatcaatgagaaaattataacagtatgttaagctaacccatcccccatcttgcctttcccttaatattcttgggctattgggccaggtgaactttggaggacttttaggctacggtttaaatgataataggccttgtcccaaactcaaaacttgccccaaactgtaacactaatgggaggccatcaggatgggggaggagaggagcctgattgctgctaaggcaaagacatgaaccattgccagattgtcaaatacgcagattcccagttactcccgcagataacatcactgttgtagaacctaagattggccttttgagatatcttttcaggtttttaaaattttcttttctctgaactacctttggggagattctagatcttttaaaaattccttaccaactctttggagatacctcctgcgttcatggttaatccatccccttagttaaggcttattgattgcacataggaagttccctttagtaaaaggttcaaaagctagaaatgtcctggctgaaatccggtaaaaagagattttaaaatgatttttcttttgagagctctgtagttagaaatcgacttaattaaagctgatatgtgtacagatactgttttaaagcccctgttctccctctgaaagcttctgtcaatggacttctgtcttgattcttcattcctgtctttctgtgtattcttctctgttatgtagtgtttatataaaacagctctaaataattggcgtaggccaggcgcagtggctcatgcctataatcctagcactttgggaggccagggcgaggtcaggagttcgagaccagcctgaccaacatggtgaaaccccatctctactaaaaatacaaaaattagccgggtgtggtagcacacgcctgtaatcccagctactcaggaggctgaggcaagagaatcgcttgaacctgggaggcggaggttgcagtgagctgagatcacgccactgcactccagtctgggcaactgagtgagactctgtctcaaaaataaaataaaataaaattggcttaaagaaaaataagcacttaaacattgtcagaaaaatggaaactttaatggcttttacatcacatgactctgatctttcaaaaataaggacagtttaaagattatttgtaaagtaaaataaaaatgtcttcaaagttaacacactttgtctaaattaggcaggtcagatactctttgctggatgttttaaggtcataaactgcttctgtgacttttaataattgtttgacttgtctgtcttacagccattagattctaggtaaggtctggggacacatggagttagccggctcccctggctaggctgggaagaatcatgggttctgtagttttatacatggttaaaattgcttatttaccaggtttttcaccaaaaataaaagttgctgaaagttaagattgtaacacgtataattgagactactggagaaacagttttacatgcaaggcgtagaaggaaagtagaatgtgtgtgtgtgtgtgtgtgtgtgtgtttgagatggagttttgctcttgttgcccaggctggagtgcaatggcatgatctcggctcaccgcaacctccgcctcccgggttcaagcgattcttctgcttcagcctccccccggcgtagctgagattaaggacatgcgccaccacctccggctaattttgtatttttagtagagacagggtttctccatgttggtcaagctggtctcgaactcctgacctcaggtgatctacccgcctcggcctcccaaagtgctgggattataggcgtgagccactgcacctggcgggaaagtagaatgtgtcttgtgggaggctataagaaagcatgggaatatggtttttgtaaaagggaatataattttgtctggttcggaggattttaaggatcatcttaaaagagtaatgggacaaaactgaaagtttaagcaagttgaaaaaggtttgtaaagggttcatcttgtaaaggaagttctgtgggtatgagcaagttggctaagacttgaaggggattatttagtttttctgtaggttgaatattttttgtttgacttttgaatgaatgacagaaaaacgaggagagaggagcctcatactgtctttattttgtcctgtttggaaagttgagtttcccctctatcagtgagtgaagatttttgccttttaaaaattcttgagttattatggctaaataaatgacttctagtgacttgggattttattttgtaatatcaagggtctaaacatttgatatttgacaaaactttccaaagtcaaaatctaaattaagccacccccccccccgcccttattttaatctggttaaccttccagatattaaatactgtaaagtccaaaagagacatatttggcttatttgatatattaaaactataacagtaagcattgtcaggtatgcaatagtgtttggctttctttggactgtatttgtatgaatgtgttgttagtatgtgtttcagaattgtataagatttcctgtaattctgatatgttttagtatatgttatcagtaataattatgattgttaagttattgtatgccacagagatgatcagaccttaactgtggctgttctgaaacttttgtcatccacaattgttttactttggttattttcagggtggttttataatcagctataggactgtgacagttttctgataactttggagattgtgacattaaaatagacgaaaaagcttccaaggctcccattaagagctaatgtattcatggatatcgagcagaacaggagttaattacatggactgaagtaatggaagaccgaaataaactttttctggcttttcgtttgaaacattgctcattcttttgtttttcagagtccagaaaaccttttttttcttttgagctatttatagcttttaacaattggataaagtatgctcttgtgaacaaaatctgaagcacatttctctctctacctgatttctctagaatttgaaaactgtttgcaagtatacttaatttatgatgttatagttgtttgttaaatacaaatctgttttcttttgtagcaggacacaattggagacactggttattttaccaaagctttgattggaatggcatactttcagattgctttaaggaatcaaagttgacttacagagccaataaaagccccttgggtaagctggcctcataccttgtctacacagtccctggacaggttcctaagtaaagaatgtcactttctgacaggtccaggagctccaagttatcttgagcccttgaggtgaggaattcacccaattaatacaagtatttgcaggcacagataaatccgtggctgggctaaatgctttgaagtctaatgtgagatttcttagggaataaagttgcagcaaagccaattttaaaaaggagcatatatggcaaataattgttctagctgaccttatgcaaacactcgggccaggtatagtaagaataaaacttattttgcacataaattagtcctaatgtgatttgtctttagtaaaaatagggactggagagagaaattatgtttcagaaaaaaactatagaacacctgttgttagaatctagtcttgttcactatttttgaatttttattattttctgtcatttggactgaatcgtgaattctttctggactacaagtcccaaactaatgctttcaaatttttctttcatttctaacttggcctcaataaaattgctactacctctttcctgaggtcctataagctgaagcttattatgagagaaaaacatgtcagattgccaccaccttcctcgtctataactaaagatgttttgagtctaatgtctggataaattgtgcccagtgttaatctttgttttttttccgtgtctatggaaatgcctcttacagaagcttagcccatctgcagtgccacctcctgatatgggaaacagctgtttaactgatctagtcttaggacttggacactgactaaaaagatatgggacaatatatttaaattcactctttcctgtttatcccagtctctctttctaacaacatatagtctactgttgacttaagtgttgtactagaactgtgagtaagaacattaacatctttgtcatacacccgtgagtacatgcaggtagctgcacggtggtgagctcactcctattcccctgggaccaacccctgcaactatgccccctgtcagcaggaagaagccagagtgatggtcaccctttttctatctctatagccagcaccttaagaataaggtgtatgaaagccaaagggggtattgaaaccacctttgcaaaagttatatcagtgagagaatgatgacagtgaaagagatctgagctaatccaccccccatcttgcctttctcttaattattcatttcccttaattattgcatttcccttagttattccatctcccatgtggtgtggctggccttgtgtctgttaaactctttctctactaaaatgcccatggtctttatgcagccggcaggaagaacccctcaggcggttacagttttgctcccaggggacagttttggttgttataaatgaggaaggtgtgctcttggcatctagcaggtagaggccagggctggcctcctgaagtgcagaggaaggtcccctcctctttcaagagagttatccagccccaaaaggtcagcattgcagaaattaagaaaccctgacttagaagctttgcacctcgtggtagctgtaaatgaggtatttacatcctccatgaagacgtaaggaagttgaaggaataaaaatctcatggggctttgaaagcaatgcaagcatcttttagttttcatacattccatggaagtagggatttttttctaaagcaaaaagaccaacaagactttggagctcagtttagaagaaaaaagtgactttcaaaccctttagaagtattcatttacaaatgaacaatgaaatgactgtgtagatggagaaaccctgagcgccccttggctttgatctggtggtcacgttcatccgtgtctgttccctgaagaaccagtgcccacatttgcctgccttctttacctaactccccccaacaagagctgaccctcctcccatcttctcgcctggttggtctttttcctccctccccctgaagcctgcctgcctctgctttccaccctccgacaagccctgatctgtgctctgaacaaactcctatgcgggtctctttgaagtctttttgcctgcccctaagtgcatccctcccacccccacccaggtgatactgaatctatgtgaatttgtggagttctcccttccttcccctctggcagaatcaccaggattcagtctagagtacaacattatagatgttttctagcacttttcagctgtccatacgctaatatgtagtcttgggtctttatccgaatggagtcctattatatttgtttcacaccatctgctttccttatttttgtatctttactgaggtatattgaagtacagtaagctagacttgtatgaagtgtgcagttttaatctgttttttcttttttatttctttgtttgtttacatacattttttagagacaaggtctcactatgttgcccaggctggtctcaatctcctgggctcaagcaatcttcctgcctcagcctcctgagtagttgggactataggcgcatgccaccacacccggttaattttttattttttgtagagatgagggctccctatgttgcccaggctggtctcaaactcctgggctcaagtgatcctcctgccttggccttccaaagtgctaggattactacgggtgtgagccaccgtgcctggctcgttttttcatacacacacacacacacacccatatttgtgaaaccagcaccacagtcaaagaatatttccatcactctccaaagtttacttgtgcttttttgtaatgtctctccccctccctctacccctttcccaggcagccattggtgggcagtctgtgactattgcattttctagcaatttatattactgaaatcatatggtatgtactcattattttgcctggcgtctctccctcagcatcatgattttggggcttcatgttgttgcacatgtcactaactcattcctctattgctgcgtaggattccttcctgtatggatgcactatggtttgtgtatccattcaccagttgttgaatgtttgggttgtttgttttttattgtgacaattatgaataatgctgctgtaaatgtttacatggctgtacagtggttctcaaacttcatcatgcatcggaaccacctgcagagcttgttaaaacacagagcatccaggcacggtggctcatgcctggaattccagcaccttggaaggctgaggcaggaggatagcttgaaccgagaagttcgagaccagcctgggcaatgtagagagaccctggcactaaaaaaaaaaaaaaaaaaaaaaaaattagccaggtattgtgtgcacttgtagtcccagcttctcgagaggctgcagtgggacaatcacttgagtccaggagtttgaggctgcagtgagctgtgattgtgccactgcactccagcctgggtgatagagcacaagaccctgttgcataaatactccccccaaaaccccagaaaaaccaacacacagagtggcaggccccatccccagagtttgtgattcattgaattaggggctgggttaagactctgcctttctaatgggctctcagctgatgctggtgccaatggttcaaggaccacatagacttcgagggctgctgccttaaaggaagtctttgtaaattatgatagttaatcgtttgttagttgttccaggtatttctcttctagaccattccttgccatgtaatgttgcttatggtttgaagcatcaagctcgcatttttgtgtagtcgaacatgtcagtcttttctttgggcttctgggcatggcttccttccagcaaggggcagataccaagaataacttggagtaggtgaggcaggttttgatgttagcaaaactcaaaccatgacactcccccaaatgggagtctgccctcattgggcctaattgtgccctctgctgcagatgctgggatggccttctgatgggatggccgggctgtgttgtcagcacccgcccacatgagacgagtttgtagctgtgcctggtgccaagagctctgaggtgctactatgccccctggaacctttgggcaaagcatagctagtcatcaggcttgcctttcacaggcaaaccaaatccatcctttcttcatccccctgccctgccaaaatcaaccagtctcaaatcaattcacgaaagggggccaatttgcctttcgggtgtctgatctaacaagccttggagcagctaggaagctaccagaagatgtgtatgatcaatgtatttgttatttattttattttatttttttaagtttggggaaaggtaatacttttggtcaaccatctgaagggactccctcctctaggccagggcactccatagttaacctgaaaaactggttcagggcatgacaggaagggggtttgaacatgcttcattatgccctcctcccttttggaattcatgaacagccgacagcatttaacacagaccttaagtctgataagaaacagttacaatctattttctctgaagcctgctacctggaggcatcatctgcgtgataaaacctaggtctctacaaccccttatggtacctggacatttttttctattgataatagcttttttttttttattattgagacaagtgctgttgcccaggttggagtgtgatggcatgatcacagctcactgtagccttgacctcctgggctcaagcgatcctcccacctccgcctctctagcagctaggactacaggtgtgtgccaccacacctggttaatttttgtattttttgtaaagacggtgttttgccatgttgcctaggctggtctcgagctcctggactcaagcaatctgcctgccttggcctctcagagtacagcgattataagcatgagctaccaggccttgccgataataactctttcaaccagttgccaatcagaagaattttatcccagaacacacaccccccccccacgcccccgccgcctcaagtcttcccacctttctggaccaaaccaatctatatcttaaatgtattttgatatctcatgtctccctaaaatgtataaaaccaagctatgccccaaccgccttgggtacatgttctcaggatctcctgagggccatgtcacgggccatggtcactcatattcagctcagaataaatctcttcaaatgttttgcagtttgacttttttcattgacagagagcagctttaaattactgtggactctttgttgcaaaagcatcttcttgaatttgataataaagccctactcttccagtttgtccctgagtgcattctgcaggtacctccggtcaccgcttcttatctttgctgttgacctcagttcattcctttcagattcttcactcaggagaagtcgtggaacagattcctggaggattccaggctctgtaaggaggcttatctccttaggatggttaaattttggatttgcagtgacttgtaatcattggctaatatcctagtttcttcttctcttttttaatgacaactttactgagcatacacacaactcattcctctaaagtgtgtaattcaggaatttcctagtatttttacaaagttgcacaaccatcaccactgtctaatttttgaacattttcatcactcccaaaggagaccctgtacctgttaagacatcactgccccttccccttctccccagcccccctggcaaccctgaatctggtttctgcctctatggatttatctattctggacatttcatagatacagaatcatgtgatgtgtgaccttttgcgcctggattcttacttcatatttctgagtttcatccatgttgtagtatgtgttgttctagtttcttgtaaatgttctgtcaaaaccccaggtgattaaggaaggtggaacaatgttctgagataagtcagccagagacacaggctgctcctccctccaattacatttaaaatggaaaatcgttcacaaatggaacattgttcataaaattgtttatagttcagcttctattctagcatgaacggtaattttctctttcgcatttgctgtagttcctccaaatttctcccactttcctatacctaaaggtcaacgtagaaaacaattttcgtcagctagagctgggcctgcaggtctctcttgtgttgcatcttttgggtggagtcagaaggtcctttcttggtgtaagagttaggaagcttgcatttcccaaaggggttgtgtggtgttccttccagagctgaggttgtgggattccaagcagcaagacttaggctgttttctacggcgtccccaaagtcacaaccctgactgatgcaggaacagaatcataaggttgtttacttttctgaatttatcaaaccttttgtctgtgtttgaccaaaattacttttcccgggttgggttggagaatatggagggtgattttctgaaaccattcatgggacatgattttctggggcatctgtacctgcaatgaagggcttactgataagactgaaggccattgtactttactggttggtgttataattgatcatattcatttcttgtcctactgtgacaagtgactgcacatttactggcttaaacaaaaactattatcttacggttctgaaggccagaagtctgaaatgggtctcactgtgctaaaatcaaggtttagcagagccacaactttcctggaagctctaggggagaattggcttccttgccttttccagctcctggagactggccgcattcctgagcttgtggccccttcctccatctgcagaggagcagcgtagcacctctctgactgtccttccataggcatatctctctgagaccatagctgggaaaggctgtccacttttccgggctcctgtgattacattgggcccatccggaagatccagaataatccccacatctcaagagacttaatttaatcacatttgtaaagtcccttttaccatataaggaaacatattctcaggtcccagggattcaggcatgagcatctttgggggccattattctgcctactacattgtcagtcttcaaggacagacttacttcctttgtttctgtctcttaatttgctcctctgaagcctgcaagattcataggcttatgtaacgtttgtgttttgtctctcgaataattgagaaatctggtactgttgagccatttggtttgtattgctcactcactgagtcgattgattggttggttgattgagtgattaatagagacagtctcattttgttgcccaggctggtctcaaactcctggtctcaagcgatcctccctccttggcctcccaaagtgctgggattgcaggtttgagccaccatgcttgccctcagtattgattccctctgaatgagccaggatttgctttccattttggagagcccctagattgctgaacagctcagagacacacttgtgtattgaggtcctctttcctgccactcttggttttggactttatcagggactctgccagagctacttttctggacttggagtctcagagtctgtgtcagctgtgggtaaggaatgagaccaccatgaagcaagcagaggtagcgggtggggcctggcttccaggactttgcagatgctgtgtgtggatttctggggcctgaatcaagagcccctgggtttgtggcttcacagaatggtggaggaagactggtggagttaagggacagaagactcaacaataattagcttgttaatcagcattttggctcaaaaatagtttgggagtatactggtcagctttctgccatgctaatgttgcataacaaacagcccccaaattcagaggcttaaatcgtttctttcttgctcactagtcatggttagctgtgtctctcctgggcttatatgggaataggaaggcctggtcaggttctgggctaggcttagggttgaaatgatgtgtctcctcatcaggggaccctggggcatgttgtttgtgcctctcccatcaggtataggaagccaagataaatcatgcaggcacatttaaagtctctgtttgtcactacccctaacatcccattgaccaaaacaagtcccatggtgaggtccagcctccacgggttggggagggctattctagtctgaaagccctgaaaagtcacatggcaaagggagcagccatagacttccactatgggaggatggaagagttagcattgcagtgcctctgccatgtttgtgggtggaagggaaggtgatccctgtggaagagactgtggatacatccagtcataccctagaaaatcagctctataggtggatttttgaagcactgtgtgcttgttatctttttattattactttatttttgagacaggatctcactgtcacccaaactcgagtgcaatggtgagatcatggctcactggtgcttctttcttctgggctcaagtctcctcccgcctcagcctcccaagtagctgggaatacaggtgcacactcaccacattcagctactttttaaacattttttttgtagagacagagtctcatcatgttgtccagactagtcttgaactcctgggctcaagcagtcctcccacctcggcctcccaaagtgcagggattacaggtgtgagccactgcacctagccagggtgcttgttaaacctgcagcttccttgattccatcttagagccctgttctcacctgaggagaggggattgtgccccttggggaacatttgacaatgtcgggaaacacttttgcgtttcacagctgggtgggggttgctcctggcatcttgtgggcagaccccaggggttccactaagcactgtaatgtgcacaggacagcccccctcaaagaattatctggcccaacaaatgtcagttctgctgaggccaagaaaccctgcacaaacaggcaattttaggtgattttcatgcactttatagtttgagaaccatgtcttgcaagactgttccaactgggaaggggaattggtgattctttccatataagtagacacggacacatctaggaaggaaggtttgatatctcgcagatagttgtgtggagaggcgaattcaaacccaagggtcttagttagatctattacttctgtaattaaaaaatatgttctgctcatattgtattaattctttgttgtattaagtatttactcttgctgtttattagtagcttaataaatggaccgtttatttggtgtgggaagaaatctatgttttattagatttctattatgagcttattttttttctaagtggccttttgccagctgtttcttctgtcctgttattcctgctcaccagcaagattataaattcttaaaaaatttgtttttaattttttttttgagaggggatctcactctatcacccaggctggagtgcagtggctcaatcatagctcattgcagccttgaacttctgggctaaagcaatcctcctgcctcagcctcttgagtagcttgggactataggtgcatgccaccatgctctgctagtttttaaattgtttttgtagagatggggtctcactgttgttgcgcaggctggtcttgaactctagggctcaagcaatcctcctgcctaggccttccaaagtattgggattacaggtgtgtgccactgcaccaccgcatcaccgcacttggccagtatatttatatatatatatatatatatatatatatatattttttttttttttttctttgagacagagtctcactgtgtcatgcaggctggagtgtagtggcatgatctcggctcactgcagcctcgacctcccaggctcaagtgattttcccgcctcagccacccgagtagctgagactacaggtgcataccaccacacccagctagtggccagtaagttcttaatagcagtgatcacgctttatattttgtttctactctgcacagtactcagcatacgataatgatcagtcagttgctaatggtatcaattgcaatgtgagttgcgctctgtggttaaagactcatttatgaggtatccgtggaccagccttttatactttgctataaatcctgtttctaggcttttggggctgaatggttggcatattgatgctcggtttctgtgtggcaattaggagaaaaggtccttgtcactggcaagctgacagcctcctttcttctcctaccctcaagttgttttggtgattgaaatgtttcagatattaaaaaaaaatcaagaattgcttgctgataggacaacagaagtacagttcagggagttaaagcttctccattccccacctcaattgtacacagcaagcatggacagatttccttgtagaaagcatgcaagcagcatttctatggaggatgctgtgtcacctgaaatttgctatgctcagatcagccaagtattgcctctgggggctaccagcaagttatagaaataactttgttatgaaatacttctttaagggggtgttagtattgattcactgaagtggttctccttgtgtacatggagtagttgtgagacgaaggtttcttttcttcctggctccccatgtgggaaggacgcttagtggtttgtgggatgcagggagaggaacagagtccatccttcagttgctctttttactaatttattaacttgcctctcatccccttggctgttaagacactaagctggtgtgtctgacaagcagatgacctaaaaattcacgcgtagtaaaagggaagatgaaaatagaagtatatgaactaaattaggaggaggacttggcttcattaaaaaaatgagaaagccatgttgtgctttttttaactgccacttttccaagtgcaggactaacagtttcagatgtcattatgctaccagtcttggtaatttctaatcatgttttgtctaaagaatatttacattaaaatgagccagcctctttaaagtcacattttagtagtgagaaaaccaatgtccgtttttggaaagggagcccttacctcagctggtgtgagcgttttgtggaggtctgcggtgtttgtgacttgtgccagaggccttgagctagaggcaacataagaaggaatcaaacttccctttctgttcggtatgcctctgtaccaagacgttttgttgattgattcatggcacggtgatacagggtgcatggtatcagatgcagggagtggaatattgttgagattggggctagagggtgtgtgtgtgtgtgtgtgtgtgtgtgtgtgtgtgtgtgtgtgtgtgtgtgtgtgtgtgtaggggaggaaggaatggaaggatgaaaccatttgggaatgtgctggaagacatgcttttgaggacaagcaatgcgattttggcattggctgggtttctgagccagtgatgaatgtagtgcattgctatgtgactgggagtgtgatagagagatattccgctggttatttccctccacctgcttcttatcagtgccatagggcagagtctcaattccacttgccagaatgctttctaggaactctttatgctcaatggaggtgatgttttcccacttgctatgctgtgccttagggaacaggaactggtattatcacataagcaatctctaagtcccttggaagattgtctcattcatcaagagggagaggattctgattttcctgcctggctcctccaggaagtctaacttcttgcaggggacctgttctctcggcccacttgtacagcatgtataaaaggaaatgaagacttttggggatttgttgattcacttgtttggaaattggggttatgtaagcccaatttgagttccaggactcatctatgattgcctggattaaatcaaaggacacccatgtaggctggacgtgatggctcatgcctataacccaagcactttgggaagctgaggcgggcggattgcttggacccgtgagttggagaccagcctgggcaagatggtgacattccatctctactaaaaatacagaaaattagccaggcgtggtggtatgttcctggtcccagctacttgggaggctggggtgggaggatcacctgaacctgggaagtcgaggctgcagtgagctgatatcctgagatcatgccactgcacttcagcctgggcaactggagtgagatcttgtctcaaaaacaaaacaaaacaaaaaaaaccaaaaaacaacctgcgtaattgtagatttttgttgttgtttgatatactgtctcttttcctggaaagaaccctctcgtgggaacagaaatgttgaatttagtcctgatgctgtccctaaccaccccgtgacactggtcccaggaaaatataggaattgtctctctttttctgtcatctcagagcttgagacaaatgttctctgaggttgttttagcaccacactgtgattcatcttcgagactgttcacagcccttgatctgaattgatggagctgtgggggatcataccgccactgccagtgctgagagctgcatgtggtgcggtccagtggctacagcgttgtctttgggatcttcacttggcaccacagcggatttgtataattattatgttgactggaacttagagtgactcaactgccttgaacaggaaccaagaaagagaggaaccaaattccagaagagaatttgccagaacattccagcatattccatactctagggttgtcttatagggtctgagggtacttcttggttatctactcatgtgcgtctgacataattaaaggccgacttagaccctatcagagaaaatcaagttcagacacttagtctaaatggaagtaaggaaaacgattacctttatctcattatcttagttctctttggaagatatataagcttgaaccatggtgacaggtgttgcctttaaacatggtgacaggtgttttcctttaaagtccttggcaaatcaactcatagacttcttcaacttcaaaaaaaaagtttttttaaaaaatattttaaaaatatttaacttgaggatcttcattgaaaattggtcatctttcgtgaatttgcttaagtaggctttgatctctttttaaaggattccttcctgcctgatacatttggtccttttagaattcgggctagaacaattctccatgaaggtggacgtgttaaaatctatttggttcattgttaggatcactcacattacaagagaaatttcggtcttgagtttttgtttttgcttatttgctttcttggaaatgtttccacatcaggtcttagaggagttgtaaaacaggaaggaggagttgacatgctgtttcataaccaatgcttgcttctcgccttggatactaacattttttccatccatttcccacataaaacatggagacaaacaccagagctgctcctgagaggtgctgagtcataggaattgaagggggctgttgggccctcgtgtgtgggatgggctcaagagctatcagtctacagagggaaaggttcatctctgtccctcattgcctgcagtttctctttggccctggctttttccgttcacagctgccctcgacgttcattttaatcaaatttcacctgcataaaagggctatgggcagagagtcttctctgtgatggagcgcagctatcctacaagtatgtagccctgatttagtagagaagaggcaggaattgtcgagggcggaggagcaggagaaatggtgcacaagggagaggggataatgacaggtcattcagggatgtctacggaatgtgaaaatgcagcaagatgggtttcggtttctttttttttaggtccgacagagattcctgggatagctgcatcttcatgttgtacacgcatacacttgattcccattattcactggagctatgttctgtaaagtcgctgagactttatagaaagcatcaccccagggaaaatacacagtgaggcttctgcgaacctctggtcacaatgttgttgtcaagcagtcagtgcataactttgttgtatgtatttctattgtgtgtttctgttggttcctttacattgcactcacgccaacagcactgtgactcacgcctggccgaacctcatctaacgcacgtattttccccataagacgcatcccagccttgtgcttcaggacatgagacagcactgcagcatctgggggccattttaagcagcaaagtcacccagaaactacaacatttcaaaaaactggcactgtgaatagactgcgaaaaggacacttgtttacggagtgagagccttgttcaccctcagctgggaacatgtgcatttggtgacacagccacacgctgcatgtttgagaatgaccatgaaagcgctgcaggtactgattttggagctacaaataaatgttagccaataggcaaattcacagacacggaatccgtaaataacaaggcttggctgtgtgtgtatacatagtgtagtgttgatagtgtgtatacacaatacacattgatattttgggagagattttgaagaagtcaccatgaaagccagtgtgtccgtttggccctctggaaagcgtgcggtgaggaggagtcagggtacaagtgtttaaattggggacatggcctgaggagatgaaagagaggtggggactgagtagggaaagctccacaccacaatgcataactgataaggttttggccaacaagccagagaaccctagagcaaagagtgccccttgcttacagccagagggccttgctcagtgaatatagggggctaggagtggggaggcatctccaaaggagcatcgtggatttgcaactctgtctttctggaaaggatatgagagtcttgccctctcccccagggctgacacagttgtaaaccaaacttttgacttcagttgtacatatcaattattttgcacccacattagattgaaccaaatgacactggctcttttaaattaaaagtggtcaaatgctggcagcctcttagggttcaattcaatggaatcttttaaaggtgcaataatgctgtttgaaatgaggagaacgcctgtgttttgtttgctgagagaaatccactatctctcatccagaagatgattagacccataatggaagccagtcagtggcatgaggaatcatggagatgattctcacctggttgattggatcagacgttcctagcccgaatgagggtggaaagggaaccaagagatgaagtggattgttgggtttatgagaggacggtggttgtctgtctatagttaaggttgtttaaactcatgaccatgagaatgagctttttctggataactctttccttttccttctgatttttgagagtgctgaaaactcaagtcctgtatttaaaaattccatcgttgaaaacatgtttcaaggacagatgacacacttatgattatagcatctgaagtgatgggaatattaaataacctttggttggacatgtaaccatcagggctccacttggtcttaaaaccaaacacacacagttcttgtcgttaaagatatccatggcctggcacagtggctcacgcctgtaatcctaacactttggaaagccgaggcgaggggttaacttgagcccaggggtttgagaccagcctgggcaacatggtgaaaccttgtctctacaaaaaatacaaaaattagctgggtgtggtgttgtgtgcctgtagtcccagctactagggaggctgaggcaggaaaatcacctgaacccaggaggtggaggttgcagtcaggcaccatcctgcgattgcactccagcctgggagacacagccagactccatctcaaaaaaaaaaaaaaaaaaaaaaagacttacacagagaaagcctgaagcccacaagagcaattagcaaaaggaaccctgacataacaaatacggtggtgtcattagcaaccaggtagttaagctcaggggttgctatgtgtcataaacttgaaagctacattggccacgagtaacacaaatgtaggtgctaatcacagatagttggtgggcatttcaaactttctcttcatatctatggatacccaaaacagtgtgcttccatttagaaggcttccattgggaggctgagacaggaggattgcttgagtccaggagatcgagattagcgtgttcctccctccctccctccctccctccctccctccctctctctctccctccctctctccgtctcttcctccctccctctcgtttctttcttttttcttttctttctctctctctctgtctccctctctctccctctccctccctccctcccctccttcctcctcctctctttcttttgaggtggggtctcgctaagtttcccaggctggtctggaactcctgggctcaagtgatcctcctgccccagcctcccaaagtgctgggattacaagcatgcatgagccactatgccaggcctattttccctttcctgctatttcctcccagctaacgcgcttttaaaatttgatacaaattaatttttctttttttgtcttttgttcaaataatgatttgatttctgttctctgtctgggtcgcttcaataacatggatacctacacatagttttatcagtaaaggtcattgacataatcagtgtgttgtgagaacaaagataggccctcatttaagctgctccattactcattttataagtcagagaaggaaggggacagcgtcctctgttttcagatggctattgaagtgagtcagagtgacggtgagcagcatgcattgaattctagctggaaagagggtttttaggcctgcgtttgagcttgccctgaatgaataaggctggaaacctataggccctggagaacattaatgaggaatctgctttccctgacagctccttgataaacgaaatgatggatgtgcagcgtgcagccctgagcaaaggcctggcagctctgtggctgagccctagagggctgagctgggccagggctcccagtagtttgttcaggagcactgagagccacagcaggtgctgatccagctcttgccttcttcgcgagtatctgacaagtctgcagagaccgcaggagcctggctactccttgagttcactgtcttggagcaagcctgtgggggaatcacatgcccccccactctagtgcccattggggacatggaggagggagtttccctatttgcagttaggttttgcgtgctgtccgcgagcttggtttcccctttgggttgcacagtgctgagatctgagcccaaggcagttgggacattaatgatgagacagaggaggctttgctgtgttccacatctatcaggctgctttgcccagggagacgccccccttgcttggggtcttgggcttgggtaggggttctggaatgtctcccctccagcaggctctgcctccttggcttccttgattcagagagcagtgcagtggctttgttgaggagcagcccctgtggaggcgctcatgggtgacaggctgtggctgaatagtggacagccctggtcactgacattaacatggtgcaatagagccttcttatgtgttccttggttcccactgccctttcatggtcgggtgtcctgattgtctgtggctagactatgccaacgtgatcagtgtccttcccagaacccctgaaagagggtcatagattgagatgtctgtcaccacccctgtccattgcagagtcacatacatgctagagaccagctcgcccttgatgcgacctgaggacctcgcccgctagtcattacagggaggggaaagacaataaaaagatgaaagagagtgctgtccctggtaatggaagttactcatcattgtaccagtgggcagccacatagggataggtcggaagagaaaggggaaagagtgaataaaaaacgctgatgtttgtgaggccgagagaggaacagaactattactgctggtcaagggggccatccacttaaaatgttcacatcctgtttcagccacaagctggccaagatcatcacataaagggacaaacgttggccccagaaagaacgcatggtcatcttgagtcaaggctgtctcatttgatgtcagaattcttaagagctgctctggctaggtgcagtggctcatgcctgtaatcccagcactttgggaggctgaggcgggtggatcacctgaggtcaggagttcgagaccagcttggccaacatggtgaaaccctgtctctactaaaaatacaaaaattagccggacgtggtggcaggcacctataaccccagctacttgggaagctgaggcaggagactctcatttgaacctgggaggtggaggttgcagtgagctgagatcaggccattgcactccagcctgggcaacaagagcaaaatcctgtctccaaaaaaaaaaaagaactgctcttggctgggtgtggtggctcacacctgtgatcccagtgctttgggaggctgagacgggaggattgcttgagcccaggagttcgagattagcatgggcaacataacaagaccccatctctttaaaaaattagccaggcatggtggtgtatgcctgtggtcccagcaacatgggaggctgaagcaggaggatcacttgagctcaggagttggaggctgcagcgagccatgatggcaccactgcactacagcctggacagcaaaggaagaccctgtctcaaaaaaaaaaaaaaaaaaaagcaagaaaaaaaaagcatccaggtgtggtggctcacacctataattccagcactttgggaggccgaggcaggcagatcacctgaggtcaggagttcaagcccagcctggccaacatggtgaaaccccgtctctactaaaaatacaaaatattagctggatgtggtggcgggttcctgtaatcccagctactcgggaggctgaggcaggagcatcgctcaaacccaggaggtggaggttgcaatgagccgagactgcgccattgcactctagcctgagcaacaagagcaagactccgtctcaaacaaacaaaaaaaactactctccaaacagaacctgcacctacccaattgtggtgggtgcccctcctggggctcctgcagtagcggtggtgtgggaattgagaatcttgcaagtgctatgagggagctgagacactgagtgtggcagggccatgtgcccagagcatgcacaacccatcctaacgtctgccggggaaggtgggggatttctgtgcattgcttttcaaccagaaaggtaatttttgttccccaggggacactcggcaatgtctggagacagttttggttgtgacactgggttaaggagtgctactgtcatctaatggatggagagcagggatactgctgaacatcccacagtgcacagggcggcctcacaacaaccaagaccacctggcctcaaatgtcagtagggctaacatccagaagctctgcgagtctgtgggaagccctggatgccccaatcctctttcattttcttctcaccacgtaggacagtttagctggacagtacacaggactcattcaaggggtcatgagaggagacctcatagcataagggtcaagtacaaggactttgcagtcagactgacgtgggtttcagtccctacccatcctagtggtgtgaccgagagcaagttgggcatagtgacatctgtcttgattgactttggagtttgacaggcagtacatgcaaagttctctattcccatgtcactcagagtgagtgtgcaaaacatactattgttggcatccatcgtcataagagtcactgtgaacatgggtgagcttagcaccttgtggcacggggctgtggtgagggactcagacagctttatgattgagtttgggcctcagcgagatggcaaagctatgcttctcttgctccttggaccatggtgacctgtgaggacccctgggggctgccttctccactgttgcagttcagggagctaaggccaaaggctactgcagtggtggactctggggtccccctggtgacaaggaagggactttgagctttggaatgccctgggctgagtcttgccacctgcaggtttgtgaacctcatcatgccttgtttttagcacaacaaaatgggataatagtgactttattattgatatactattatgctgttttcaggtatgtgacactgctgctattttactgtttcttccagatttccgtgagggtggaagaaaatcataccatatcagatgcctcgcagagcaccaggcccaccgtgaaaggtacagcaaattttacttccctcttcttgcctcgttggaaattctttcctgtgagatttcctcccctccgccctccgcgccttctgccatagcctatagcctcctctgggagttcttggataattttgttgccttatacctttgcaatttccagtatggtagccatgcgccacatgtggctgtggagtgcttgaaatgtggccagtctagattgagatgccttgtagaagtataaaatacacactggatttcaaagacttagttcaaaaagaaagaaagcaaggtatcttattgataatgtaatacagtttacatgttgaaatgatcacttggatacgtggagtaaaatagaatgtattattaaatgtaacttcacctgttttcttttgacatttttttgtggacccagaaaattgatagacaggtggatttccttcacacttacacacttgtcttgctcaagaccagccctgcttcctcactggctgctcagtcaaatgcctcctccagtttaagctgtccatcacggggccacccattatgtgtccatctcatcttctctgctcagtgcctgtgcaggcagctggtgttcctgctcctcccgcccagctttgcttatgatgctagtcttgagtgcaggctgctgagcttctcacctttcttcccatacatgtagaacctctcctccagaaacatggggtacttaccagctggcaaggagcagagctggggttcacattcatttctgtcttgctccaaatccatgtccctaatagattactgtctccaattgctttgtggatgtaaacacatagtaagttcctagagagcagggaccatttttatttctttcatctctgctgttcaagacctttctaaagcttttttgaaagaattaagatttctagtctcttgcccttccactttctgctatgtgaagacacagtgttcctgccctctgccctctggatgctacagcaacaaggtgccatgttggaaggaagcagagaacatccctcaccaaataatcaatcctgctggtgccttaattgtgaacttctcagcctgcagaactcacgaaggtcatcaccatgtaggctgattgatcttggacttccaagcctccagaactcaaatcagtgaatttaaaaacattttatggagggcggggccaagatggccaactagaagccacggtgttgggaggctgctatcagaaaagaccataataagcgtgtgaatccttcatcagcaaccaaggtatctgggttctctcatcaaaattgactagaaggctggcgtgacccacagagagaaggaagaacagtgtggtgtggcggcccacctgagagtcacatgggaaagggaaccccctcactccagataaggcaggaggtgagtgagcacgctacccagccggggaaactgcttttccacagaactgtgaaacccacggattggaagatctcactcgtgaacccacgccaccagggcctcgtgtcccagccccagaacacacagattcttacagcctctcagctggaatccgcttaagcttaccaaactcctcggggaggggtgaccagtaccagctgcagctgcctgctgtctaagccctttgaactcctgcagggaggggcagcagccagcactggcaactgcctaacatgctaagctccctggacagggggaagggtggcacccatttctgtagctacaggctacgcttttcccctgctagagccagggaggctggacagcttggtcccaagacttgtccccacagcccaacacactggctgtggcagtctgcggctagagtgcctcttcaggcccaatcccaacccatcctttcttagttggggtgtgtgtggggcggggcgcttccctgctggatctccagtaactccagccagaggctaagggacagaatttggatctcctgggcctcagcccataggggaggggtggccgcagtctctgctgaccagcagatttagcttttcctcctggtagttccaaggaatctggacagcccagatgagtgggtttcccccaagcaaaacacaccctctccaccaagggacagagtgctccattaaacgggtcctgctccctgtgtcacccaactgggtgagacccttcaacagggcttgtcagataccctctgcaggagtgatcctactggcatcaggttggtgccccttgaggtcagaggtcccagaagaaggagtaggcacccatctttgctgctctccagcatccttaatgacatctccaggcatgggagcgaatcagatgaataaggcctgaaggtgaaccaccagcaaactgcagcagccctacagaagagggactggactactgaaagaaaaacaagcagaaagtgacaacaacagcatcaacaacaacaatcaaataaaaggtccccacaaaaatctcatccaagggtagcagcctcaaagactgaaactagacaaactcatgaagatgagaaagaatgaaaaaatgctgaaaacccaaaaggccagagtacctcttctcctccaaatgattacaacatctctccatcaagggcacagaactggacggaggatcagatggatgaattgacagaagtaggcttcagaagatgggttataaaaaactacaatgagctaaaggagcatgttctaacctaattcaaagaagctaagaaccttgataaaaggttagaggaattgctaactagaataaccagtttagagaggaacataagcaacctgatggagctgaaaaacacagcacgagaactttgtgaagcacacacaagtatcgtgaagcataaacaagtatcaacagctgaatcgaccaagtaggagaaaggatatcagagtttgaagaccaccttactgaaataagacatgcagacaagaatagagaaaaaagaatgaacaaagcctaccagaaatatgggacctcataaaaagactgaacctacgattgagtggagtaccagaaggaggtggggagaatggaaacaagctggaaaacacacttcagggtattatccaggagaacttccccagactaccaagacaggccaacctgcaaattcaggaaatactgggaacaccattaagatactctatgagacgatcaaccccaagacacataatcatcagattttccaaggtcgaaatgaaggataaaactaagggcagccagagagaaaggctaggtcacctacaaagggaagcccatcagactgacaatggacttctcagcagaaactctacaagccagaagagattgggggccaatattcaacattcttaaagaaaagaattttcaacccagaattttatatctagccaaactaagctttctataaaatcctttccagacaagcaaatgctgagggattttgttaccactaggcctgccctgcaatgtctcctgaaagaagcactaaatatggtaaggaaaaactggtactagccactgcaaaaacacatgaaaatataaagaccaatgacactacaaagaaactgcatcaactaatgtacaaaataaccaaatagcatcatgatgacaggatcaaattcacacataacaatattaaccttaaatgtaaatgggctaaatgccccaattaaaagacacagactagcaaattggataaggagtcaagactcattggtgtgctgtattcaggagacccatcttacatgcagagacacacacaggctcaaaataaagggatggaggaaaatttaccaagcaaatggaaagcaaagaaaaaaagcaggagttgcaatcctagtctctgacaaaacagactttaaaccagcaaaaataaaaacagacaaagaagggcattacataatggtaaagggaacaattcaacaagaagaactaactattctaaatgtatatatatgcacccaatacaggagcacccagattcataaaataagttcttagagacctgcaaagagacttagactcccacacaataatagggggagactttaacaccccactgtcagtattaggtcagtgagacagaaaattaacaaggatattcaggactcgaactcagatctggatcaagtggacttagtagaagtctacagaactctctaccccaaatcaacagaatatacattcttctcagtgccacatggcacttattctaaaatcaaccacacaattggaagtaaaacactcctcagcaaatggaaaagaactgaaatcatgacagacagtctctcagaccacagtgcaatcacattagaactcaggattaagaaactcattcaaaaccacataatttcgtggaaattgaacaacttgctcctggatgactcctgggtaaataatgacattaaggcagaaatctagtatttctttgaaaccaatgagaacaaagagataatgtaccagaatttctgggacacagctaaagcagtgttaatagggaaattttgcactaaatgcccacatcagaaagctaaaaagatctcaaatcagcaccctaacatcacaattaaaagagctagagaggcaagagcaaactaatccaaaagctggcggaaggtaagaaataactaatatcagagaagaatcgaaggcgatagagacgcaaaaaagccctccaaaaaatcattgaatccaggagctggttttttgaaaaaattaacaaaatagatagactgctagctagactaatagagaagaatcaaatagacaataaaaaatgataaaggggatattaccactgaccctacagaaatacaaactactatcagagaatactataaacacctctatgcaaataaattagaaaatctagaagaaatgaataaattcctgcacgcatacaccctaccaagactaaaccaggaagaagttgaatctctgaatagaccaataagctctgaaattgaggcagtaattaatagcctagcaaccaaaaaaagcccaggaccaaatggattcacagctgaattctaccagaaatacagaggagctggtaccactccttcagaaattattccaaacatttgaaaaggaaggactcctccctaactcattttatgaagccagcatcatcccaatacccaaacctggaagagacacagccaatatcatactaaatgggcaaaagctggaagcattccctttgaaaactggtacaaaacaaggatgccctctctcaccactcctattcaacatagtattggaagttctggccagggcagtcaggcaagagaaagaaagaaagggtattcaaataggaagagaggaagtcaagttgtctctgtttgcagatgatgtgattttgtatttagaaaaccctatcatctcagcccaaaaacttcttgaactgacaagcagcttcagtgaagtctcaggatacaaaatcaatgtgcaaaaatcacaagcattcctttacaccaacagtaggcaggcagagagacaaatcatgagtgaactcccatagacaattgccacaaagagaataaaatacctaggaatacaagtaacaagggatgtgaaggacctcttcaaggataactacaaatcactgctcaaggaaataagagaggacacaaacaaatggaaaaacattccatgctcatggataggaagaatcagtatcatgaaaagggccatattgcccaaagtactttatacattcaatgttgttcctgtcaaactaccattgacattcttcacagaattaggaaaacctattttaaatttcatatggaatcaaagaagatcccacgtagccaagacaatcctaagcaaaaagaacaaagctggaggcatcatgctacctgacttcaaactatactacaaggttacattaacaaaaacagcatggtatgggtaccaaaacagacatatagaccagtggaccagaacagagacctcagaaataacaccatacatctgtaaccatctgatcttcgacaaatctgccgaaaacaagcaatggggaaaggatctccttattcagtaaatggtgctgggaaaactggctagccatatgctgaaaactgaaactggaccccttccttacaccttatacaaaaattaattcaagatagattaaagacttaaatgtaaaacccaaaaccataaaaaccctagaagataacctaagcaataccattcatgacataggcatgggctaagagttcatgactaaaacaccaaaagcaattgcaacaaaagccaaaattgacaaatgggatctaattcaactaaagagcttctgctcagtaaaagaaactatgatcagagtgaacaggcaacctacagagtgggagaaaacttctgcaatctacccatctgacaaaggtctaatatccagaatttgcaaggaacttaaacatatttacaagaaaaaaacaaccccatcaaaaagtgggcaaaggatatgaacagacacttctcaaaagaagacatttacacagccaacaagcatggtaaaaagctcaacatcactgatcatcagagaaatgcaaatcaaaacctcaatgagataccatctcatgccagtcagatggcgattattgaaaggtcagaaaacaatagttgctggcaaggctgtggggaaataggaatgcttttacactgttggtgggaatgtaaattagttcaaccattgtggaagacagtatggcgattcctcaaggatctagaaccagaaataccatttgacccagtaatcccatttctggatatatacccaaagtaatgtaaatcattctgctataaagatgcatgcacgtgtatgtttcttatagcactatttacaatagcaaagacatggaaccaacccaaatggccatcagtgatagactggataaagaaaatgtggcacatatacatcatggaatactatgcagccataaaaaggaatgagatcatgtcctttgcagggacatggatgaagctggaagccatcatcctcagcaaactagcacagaaacaaaaccaaacaccgcatattctcactcataagggggagttgaacattgagaacacatagacacagagaggggaacaacacacaccagggcctgttggggagtggggatgagaggagggaactatgagggtcagtagggatggtgctactaattaggtagtagggtgctgcagcaaaccaccatgacacacatacacctgtataactaacctgcacgttctgcgcatgtatcctgttttttttgttttttttttgtttttttagaaaaagccgggtgcggtggctcacacctgtaatcccagcactttgggaggccaaggcggacggatcacaaggtcaggagatcgaaatcatcctggctaacatggtgaaacaccgtctctactaaaaaaaaatacaaaaaattagccgggcgtggtggcgggcacctgtagtcccagctactcgggaggctgaggcaggagaatggcatgaacccgggaggtggaggttgcagtgagctgaggcgacaaagcgagactctgtctcaaaaaaaaaaaaaaaaaaaagatttctagtacattgcctaaaagaacccttggatgaagtcagacacatgggtagtatgagaccccagatagcatcattttgtatgtacagaatcgcttttttttttttttttttttgagtcaggttctcactctgtcacccaggctggagtgttagttatgtggtcatggctcactggagccttgatctcgtgggctcaagtgatcctcttgcctcaacctcccaagtagctgggattacaggcacacgccaccatgcctggctaatttttgtattttttgtagagatggggttttaccatgttgcccaggctggtctcgaactcctgggctcacgcgatcagcccacctcggcctttcaaaatgctaggtttacaggtatgagccactgtgcctggtctagaattgcttttagtggatgattttttgctgtcactgttaatggcgtgcattttctgagttatcagagatggccctgcatgctgcgagtctgtgttgactgtactgttggctgtgtgtgtggagggcaggaaagtgccgtccttgctgtaacttgtgttattaatgatatggacactgtgagttgcttctagagagctacacctcacttctgtgtcagcaaatgaaggcccaggaactgacagcgttccctctagctttaattgcggtataatcaccacaccctaacattctcctgttttacctttggcaacatctagagtttggttgtcacagctgatggggtgggggtgctatggcattgggtgggtagaggccaaggatgctgctgggcatcctacactgcccaggacagccccccacaaattatccagccctaaatgtctacagtgccacaggtaagaaatcctggaccgtagggtagacagatttgactggagtggagaaattgtatcctggggtaagtgggatttggattgcagttagtgcagagcttgtgtgtgtggaacgccttggacactggactaatccaagaagttgggtggggaggaggggggctttttctttaggtcctggaaaccattaaaaacctttgaacaggtgctttagaaagacaaaactggcatctgtctgaaggatggattacaacaggcaccagcagactgtggcccacggggccgtgtccagacttggcacacaaccatgcccattcattcatgggttgtctctggctgctgtgatggttaactttatgtgtcatcttggctaggccatagtattcagatatttggtcaggtacttaggaatgttgttgtgaaggtattttttagatgaaataaacacatcagtagactttgagtaaggcagatgacttccataatgtgggtggacctcatccaatcagttgaaggccttaagaaaaagactgaggtccgccaaagaggagggaattctaccagtatcctgcctttggatttgagactgtgacatctgcgctttcctgggtctctggcctgctctggaaagtttgggcttgccggcctccacaattgtgtgaaccagttccttagaatctgtccatctgtccgtccatccatccatccatccatccacgcacgcacacataaacaaaccctattggcactgtttctctggacagccctgactaacatcactgctttcttgccacagcagccaagttgaatacgtgcttgtaagtacagggattgtgtggcccacaaagtagaaaatatttactctctggccctttacagaaaaaaggccaagcattggatttggtaagtgaagtccttccatgaaactgagaagtgctgagtcagtactcaatgggagttaaaacagagaaactgtaaaagccaagagggctcaggatggtgataatcacggtctttcattcttttctcctgtgcacatttgacccgctggcatgcaggagatttaatctctctaatccagaatgtgttttagggaatggcttgcctggcttgtgggttgaaatgttctctcctcagatgtggctcctgcaatatcagctcacctgatgacaagaagtggaagccatgtaaccacctgagacgcaagttaattagggtttatcagaaagacaacctgaacccctgtgggatgtgctgtgggtgaagaaaagataccagtattctgtgattccaaataggagattttaaaaattctacccctggaggatgggttggcatttgtcttccaaacataggttaaatacgttttatttctgtctgttttgtacacattttaatcattttccagctcacaattacagttggtacttctcaattctcagtgaattgtgtagtggaattgtttgcaacatcatactttggaaatgacgttggcaattaaagttttggtccaagtttaataatgaagactatttgaaaggccaaaaccgatggatgcttttgagatgaaatagtcatttgggaagaaaatgagggcaggttgtctacttcttaacatttatctgtttttttttcttttttgagagggtcttgctctgttgcctgggttggcgtgcggtggcgcgatctcaggtcactgcagcctcaacctctggggctcaagtgattctcccacctcagcctcccaagtagttgggattacagacacatgccaccactcccagctagttttatttttttgtagagatggggtctccctatgttgcccaggcttgtctttaactcctggtctcaagtgatcctcctgcctcagcctcccaaagtgttgggattacagacatgagccaccttggattacaggcatgagtcaccacgcctggccttaacattgatcttgatgacactgaaatcgttgatgtgtgccaagggggttcctttttctaaatggaagctcactgttttgggtatccatgaattcatcatagatatgaagagaaagtttgaaatgcccaccagctgtctgtggtagcacctacatttgtgttactcatgaccaatgcagctttcaagtttatgacacgtggcaccccctgagcttaactacctggttgctaatgtctttggacatcactgtatttgttatgtcagggttccttttgctaattgctcttgtgggctttcagactttctctatgtacgtttttttgttttttggtttttttttgggagatggagtctctgttgcccaggctggagtgcagtggcgtgatccactgcaacctccacctcccgggttcaagtgtttctcctgcctcagcatccctagtagctgggactacaggcatgcgccaccacgcctggctaattttttgtagttttggtagagatggggtttcaccacgttggccaggctggtcttgaactcctgacctcaggtgatcctcccgcctcagcctcccaaagtgctgggattacaggcatgagccaccgcacccggccagtgtaagtcttttgaaacacagacacctagtgcctttcccgtgagtctttcagggaaagattgagttccgtgtcaggttggagttgctgatcaagcgactgactatacggcttcctagccccctttatttgaaaaaccagcgtggtcttcacttttcccttgagcctacaaccacagggtgcctgttcatgtatttccaggaccttatgcggctcctttgctctgcttattccgagaaccaagccttgggactgtgcattttgaatacaaatgaaggcacccggaggaagcccccagagtctcggcacagttgaggaaacaaacaaagcatgctacacgtgcaggaagatccctctttaattcctatgatgacctctctgcttttttattttttaagttaaaaggagtcaatgctttgggttttgttagactggacaaggtagcaagtcatattaaactaacccaggttgttgcttgagttttcactgaacttagactctactgacgagtatagtcaagcagaaattcccctcacgaggtggcctgatggtgtactccagtgggggggtgcagaagatttggagggatctgcttcccgactggggcaggttaacctctttctgccttagttacctctttgcatgtcctaagagcacctgcttatcagatccttaggaggattcactgaattcgtccacttggaatccacatggaaggctgcctggcatgtaggaggtacccagtaaattttagactcctgttatttttgccagttggattcaacagatgtttgttccctggactagtgtttctcacctgggggtgatctgcacctaggggacatttgacaaagtctggagacattttgggttgtcacagcttggggagggagtgttactggcatccagtgaatagtaaccaggtgtattagttttctgtcgctgtaaaggaatacctgagactgggtaatttagaggtttatttggcacatagttctacaggctgtacaggcatggtgccggcatctgcttggtttcttgggaggcctcagagcttttgctcatagcagaaggcaaagggagagcaggtgtctcacatggcaagagagggagcaagagacagagggaaggctaggctcttttaaacaaccagctcttgcatgaactgagggaactcactcagtaccagggggagggcaccaagccatggttcctccatgaaccaaacacctcccaccaggccccacctccagcagtgaggattaccccactacatttcactgtgagatttggaaagggaagacatccaaactatgtcaccaaagatgctgctaagcatcctaccgtgcacagagcagcccccataacagggttacctggcaccagagtgtcagtagtgttgaagttaggctacactgtagttcacttgcttattgtgtgtaggaagaccggaggccagttacctggcaataacaacaacaacatcaaaaccccctcaaacccaaaacaaaaaaaccccacatgacactgtgagtgttttttttttaatttgcaggagattgagtcttaatccagttgaagacctttatttccttgctagttacagagaggtttttcctggttcgttgcctgtgtttgttgcagttagtttttattgacctttctagggttcatgtgtgtcccttgggtttgccatgttttgttctccaaagccccaggagggttccccagtaacagagactgtgttagatttttaacattttcttttactttttgttttaaatgatttcttttgattaattacacactcacactgcgttgcaaacatagtgctgtcagatcccagtactgtgtcctttaccggctttccccaaggggagtggcttctcacaggatcatagagcaggaaaacccaggaaatccacgttggtgcaacacagttacctagccttggagcccttacttggatttcaccctttttgcgtgtactcatttgtgagttgcatgttaaagatgagagtcagtaatatatttccaaatgtcaacagaacataaattgagcagaagagtttataatgagatggaggattgagcagaagagctcatagcgagccagggcgaacaacctggcgaggagctccttgactttcttggaggccgaggtgggagcgttggtgacaacccccgggaaggcagatgttatcaggagttaaaatgtgatgtgtgtaccgctcatgtgtgtatggggtgtgctccttttgtttttgatgctgaaatgagacaaatcatttcccttttaagctccaggcagactgatggaggggggaaaaataacacccaacttactgcaacctgaaatcctttgccttggatccacttcctaagttcctatagtccttattttataaactgataaaacaacttttctctctcaagtgatgatcatcttgtgttttacactaattaagcccatatacacctccctttggaattccttcttctgatctgcttggcctgtttgccagttagtcgccttactaggagaatcaaaatgtaaactcataatagacaggaacccaacatcatcagcacaggatgtggcagaatgatttttctttcccacctcttgctgagaaggcaatgagattggaaatggcaaacaccccagagttctgtaactctgagtgtggaagaggaggtggcagcccttgacctcagtagcggagccagatcatcgaacatccccgtccaggaatctggacatgcactggtcaagaattcagcacaatttcctttggtctggggattgggaagctctttttgtgagtgaggcatggagtgaaattgcagaagcctgcgtgacttgtagaaaccgaagccaggctcgtttactgccttgcacaagggagatatgataagacagaatttatttgtgagtgtcgtcgatgccaaggagcctgtccaacatttatagaggcttttgggctaaacgaaaaagggtttgatctgtctgtggagacagaaagtagatgagtggttgcctaggactggggctttaggcgggtaagaggttgtcactgctaaagggtacagggttaatggaaattcttgaaattgtgctgatggtggctgcacaactctgcaggtactaaaagttgttgagttgtactcgaaatgggtccactgtatggcatgtgttttatatctcaataaacctgtcaaaaaagggtgcaggaccactgtttttgtacatgtcctcaaaatacttcctgtaatctagtgtggtcacagctggttcatgtgcacggacatagtgtcagtgtcattgtggagatagcagtttcagattcactggttccagaaaatgtgtccctgcctgttatctccgtgttgccacaattaagaaccaagggtccataacaagcagtgaaaccatggttcatatcagaggaagtggggtggtgtcatctcttttgtatttttctcttttctctcccccactgcctttgcccacttccttctccaaaataaaacaaaagagagaaagcaagagataagtggctgagctgaatgtggtccagccctttagaagaggggagtacacatactggagggaagataagcgaaaatacagcctttctcaagggccagcacagacggagataaagagagagccacaggcacactggccaagcatcagctcctcaagcatccatctcactattcagggtggggaaatacttgatacctcaagtcctctttatcatcgcagatgaaaactgacataggtgatttcctttcggagcatttagggagaatgcaagggaaattgacaacacacttggtgcaattgggtaaccagtctttgtgttgccctccaatgactcttgcttggaaatgattggaagcccatcgttttaagtcattggaacgactgtccccttcataaagcatgatgtagcaaaatgaaaagcatacttctggttaaaagtgtttttcaaaaaaagcttaccacattgaggaggtcatttcatatttcctgatattcagcaattttgctgtgagctttgtagagttgttctggtgcttagttcaaataagaaaggaattactgaaattgcacattaagttaaaaaaaaaatcagggttttgggtcctgagacttgttacctaaacatctgtcttgctattttgttacagcacaaagtaggaattgtaaaacatcttcgttataaactgagtactatacagtctctgggagagcagaagaaacgtggtaggaaggaaccacccagggtgggtaatgacagagtagagatagtcagatagggccggagacaaggccaggaaaggcgagaggaagagcctgcaggaacgagtttcttgcacgtttgagagctggacctgccaagagggtaaggccaacatctgtgtgtgttctttgaggaaatccgagtagcctgccctgcctttgaccctctgctctttgaactgtggattccttcccatacacctgtgcattctcagtgccgtggtcagatccccaaacagacaccaaaccccgacctccgaggcccaggcaggagcataacccagccccaaggggagataaagacagaaagaatcagtattatagcagggacctttttcaggaatctgccttctgcagggcagtgccctaggtgcattcaagccagcatagcaaatccacatcactagaaagactctttccgttttataacttgggaaactaaggccaaggcagtgacaaatgccaggtccccaaactctgaactgcagatctgcaagctgaatggtggcaggtgggccagtgggattttaaagccgtgtgcttttcagggcaccctggtgcttctccaaatgccggaagggtttccttgaaaattcatagcactactcagtcaggattctgcaggacagtgccctggggagtgcatgagtggatggttctgtgggtagaagccacgagctgaagatagttttacatgtttaaagagtaaagagactgggagcggcggctcatgcctgtaatcccaacactttgggaggctgaagtgggaggattacttgagcccaaggagttcaagaccagcctaggcaacatagcaagaccttgtctctaaaaataaataaaataaaataaaagccaggcatggtggcagtgctcctgtagccccagctatgcgggaggattgtttgagcccaggagttcgaggctgcagtgagccatgttcatgccaatgcactccagcctgggcaacagagccagatcctctctcaaaaaaaaaaaaaaaaaagaaaagaaaaaaacagtaccttgttgatacatggaaatgatgtgacattcagataaagttttactggagctccgccatgcccattcatggacatattttctatggttgctttttcacaacaaggggtgttgcaaccatggcaacagacactgtctgtcttgcgaagcctaagatatttgctctctggtcctctgcagaactagcgtgtagttctgagtgcttgaaggcacgtaccatcttggtggtgtgacttggactttcacctctcctgatcccttcttcatttccaccctactctcatcttgccttgcttgcagaagcctggtattttcataattcgagagtcacttacttcatgtgaagtcttgtcccagttaaagtgccaatagtcctgggagaggtaatacattaaaccttatcagttatttatacctcaggattggaagggattgttgctggctttgtcctataacagctgcgaccagaggacagagcctaagggctgttgcatgaaatgagggaggtgtgggtcacctctgtgcagggcatgagaagagaggaggctgggtcatctgaaagatgacctttgttcatggcctttttctgtatcctcctcagtcacccagaaattgggattgttggtgacaatcttttgggaattggtgttagcttcggagagccacttagcctgaagaccctccttactccgttatcatagaaccagagtggtagccacacaggcagactgtccatgctgacgtgtaaggcagggccttacacctcctacccatgtaggaggtggtggagctgggattttacatggacagccttctgctcccctggtgcttagctacattctagtgccttctgtgcaatgccagcttaacatacatatgaagtgtgctgacccaatctcctgcctttgcgttcactattttagatggttgtgtcaccttgagcctggactagggagataacacgtgaaggagatgccgcgtggtttctgtcttgtccatggtacgtggaacacattcccctcagtaacattatggttgagacatggaatgccacaatgtacagttgccaccatatggtatacttcatatatatacacatatatatttatttagtttattttaatttttttagagacagagtcttgctctggtgcctaggctggagtacagtggtgcagtcgtagctcactgcagcctcgatctcctgggctcagtgatcctcccactgcattgtcccaaagcgcttggattataggtgtaagccactgggcccggcctacttgtatatttttcattgcaaatgtacatttcagttacgttgtgggctttaaaaagcctttctaggctagttgggaatttgaccctattttttacagcatagtttctaggagaaaaacatttctgaggaagtaacaaaagaagacttgggctgtatcccatttttaatttagagagcactgtcatttgaaaatttcttctctcaacatgttttctttttgagacatgaagtaggcaggcaggatcttttttacagtggcgctggtgtctttgggaagcggcttccttggtttgcctttgctcattttctttcttgacttctccaggcattcagctgcaggcatgtacctctgctgctgggagagtggcaaggagagggggttggaggaacggggataaaaattagctagaattcaaaaacggcagtgacagcccagatgatttttcatgctaacctactttaaaagctgccagaataattgtggagtgggaaatctctcatttctcctgtcctactctgacaagatctaaaaataactttgaggagatgggcatgtggccctttgatctccttggcctggagtatttcttggtaggagcagagcttacaagaaggtgttcttcaatgagtgttctggcagtcggagttgtgggtggggctgattactgtaatcttccttcgtcattgaacgatttcatctgcccctggtttccattacttgctgctctaaatattcctctccccgcaccttccttttatgtagccacaaactggaatatgtgcatggaaaacccaaaggaggcaaatcccacttacactgcagaactttggtgctggatttagcggctatttaccaagcacctcctcttccagaataagtagcacagatctttgaccgccccccgccccccaccgagggactgtggtctagttggaagacacaaggcagaggtgtaaaaagggaactctggagataggaattggaaatggggctgagagctgaagagatggcctggggctagagaccagggagatgggaggagggggagttccttggaagagtgtgcccctaagagatcctgaagagtgagcagagattgatgagaggcgagaggagacctagagttatcagggctgcagaggtgtccttggcacatagaggccatagtatccacgttggcttccagggtaggggcagtgcatctgcggctggctgaagatggaataaatgggatagtggctaaaaagatgggggtattgggggaacacctctccttggagtggtcctccttgcagataaggggagacgtagaacagcacttgacagggaagctggtgtgggggaaggatttttttacactaggggagacttgtggttgagttaaacaggttctagaggccaggcatggtggctcatgtctgtaatcccagcactttgggaggccaagttaggaggattgctcgagcccaggagttggagaccagcctgggtagcagcagcatagagagaccctgtttttacaaaaaatacaaaaattagctggacatagtagcatgcacctgtaatcccagctgctcgggaggctgaggtgggaggataacttgaccccaggagttggaggatgcagtgagctgcagttgtgccactgcgcaccggcctgggtgacagagggagaccttgtttctaaggggaacaaaaaaagaagttaaagagataagataaagaatggggggaggggacgtattttttgcaggagggaaattttgagggtttttagccttggaaaaggagcagaacagatgggaaggtcgtaaacgtggaacctttggaagcagaaaggaagatgatttctcttaaaaagttttgcctagagatgactaatgtgaaggtcttggtgttttaagggagcagggaaagccagaggtggtgggtccggtagatgcaggaactgacccaggctttcagattgtacactggggagcagagagtgcgtgcttgggggtggggaggctgctggccagggctgaccttcctcccatgacccctgcgtagaatcagagtagcctcatttagtgtacttgagtcaaggccttctgtttaagagcttatttgaactcattacagtcatcgcttggtatccttgggggattggttccaggacctcctgcggatacccaaatgattgcacactcaaatcctgtagtcctctcagcaaaacctgctgataggaaaagtcagccctctgtgtctatgggttttgcatccccagatactgtattttccatctgaatttggttgtgaatgcagaacctgcccataaggagggccaattgtatttattgaaaaaaatccgtgttgttcaagggtcagttatagtttgaactacaaaaagcaagcaaccaaacaaaacccccaaaaaccaaagctttaattggttaagtcagagcagactaaaaaggactacatgcccagtggaactttctgtgtagtctagtagccatatctggctatgaagcacctgaaatgtggctcatgcaacagaggaattgaattttaaattttattccttttaaatatttatttttgtctttcttcgtttcttttttttttttttttttccctgagatggggtctcgctttgtcacccaggctgaagtgcagggtcgcgatcactgctcactgcagccttgacctcttgggctcaagcgatcctcccacttcagcctcccaagtagctggggccacaggcatgagctactttgcccggctaattttttaacttttgtagagatgggggtctcgccatgttgcccaggctggtctcaaactcttggtctcaagcaatgcttccacctcggcctcccaaagtgctaggattacaggtgttgagccacaatgcccagcctaaatatgtatttcagtagctccatatggggaggtgtcttggacagagcaggttagcccgtgagactctctggtccttgagtgagagggaaggatgagggcttgcagatgatcccagtgggctggttctggaagcgaaacctgcaggccccatggcttggggaaggctgaccatagcaggtgggaggagctctctgaaggccgaggctgagcactggtggagaacagggcccgtgctcacgtatcccacaccccagaacttggtgtgctggattccagccttgtgtgtttctcattatgactatgtaaatgccaggagggttgggactgtgtgatttttcttcttgcttggatgctcgagagttcttcattaattagtgaaggaaagctggctctaaggagaagcagttgaagtggagttcattgcccccacttctctgcagcaggaatgccttgtccctcctgcctcggttgaactcactttctcaggctcccacctttgaatggaggcccttgtcaggctctccatccccagcgactctgttgacatttccccatgggaaaggaaaagaccatctgaaagtttccatctgtgtgcaaggttttctgaacatgttgacaacatgggtttaattttgtgaggtcagcaagagttcttgtggtttgggatttagtaaaaactgtaggctttgtatgggaagaaaatctctctcacctctgtcttctattcttcattctctacacagactctccacttgtctttagcactaaaaacacaaactaagcattatgttttaaaaaaaacccaaaccccaagtccagtagctgattgccctgctttagcttttctccctcgttgtcattcttcaaagaaagactccactcctttcagctgtcaccctttcaccctgatcaccgcatgcagtctggcctctgccccgcttgaaagaagcactcttcccagggcacccgggaactcggaactgtgaacccccagagtctgcccagcccctctgtccctgccttttgagcaacagcgactggtgccacaacctggggtgcccctttccctgggcagcattacccacactgggccaccgtgggccaagtcacccacactgggccaggtcacccacactggaccatatgaggccacgccactcacactgggtcatgtcacccaccccaggccacactgggccatgtcacccacacttggcagggtcctgtctttctccactctggtgtctcctttatcttgatgctcaagactctctcaaaacaccagtggttcagcacagtgtggggacagagacttcagcgaggcgcccccagccccacccttgacgggaaataagcgcaaactccttgtgcctgagactcaaagggtcgtgtgcctttattggcccccttgccttacaccagtgttcttaacctttctgtgtgtgtgcgtggctctctgtagtcatcgagtgaagccgcagaggtctcagaatcacattctaaaataaaagtagaatcataaaggaagcgattaaaagtgcaattgtcaaaatatcaaaaacatgatttgttgaatagtgcttttttcttttctttttattggtaaaatacatgtaatataaaatttagtcattttaaccttttttttttttttttttttttttttagacagagtctcactctgttgcccaggctggagtgcagtggcacgatcttcactcactgcaacctccacctcccaggttcaagcaattctcctgcctcagcctcctgagtagctgggattacaggcacacgccaccacacccagctaatttttgtatttttagtagagacagggtttcaccatgttggccaggctggtctcaaactcctgacctcaggtgatccacccaccttggcctcccgaagtgctgggattacaggcgtgagccagtgtgcccggcctattttaaccatttttaagtgtacagttcagtaacagcaagtacattcatactctgcacagccaacctccagaactccttttgtctcgtagtcctgaaactccatacataactacccactcatttccccattcccagccccagcacccacccaactttctgtttctgtgtgcttcacagctctgggacctcagatacgtggaatcctacactatgtgtctttttgtgactggcttatttcactcagcgtactgtcctccaggttcgtccacatggtagcatgtgtcagaatgtctttcctttttaaggctgagtgctgttccattgtatggataggtcactttattcctgtaactgtagatggatacctgggttgcttccaccttttgactgttgtgaataatgctgctacaaacttgcctgcacaaatatttccttaagatcctgctttcagttctttgatgtgtgctttctaaaccttttttattttttccttttgttttgagacagggtttcactctgtcccccaggctggagtgcagtggcacgatcgtgactcagtgtagccttgatctcctgggctcaagcgatcctcctgcctcagtctatcaagtagcttggactacaggcacatgccaccatgcccagctaatttttgtatttttggtggagatgaggtcttggtatgttgctcaggttggtcttgaactcctgggctccagcaatcacctgtccttggagggagttggcaatggaagtgggttggctgttggagcccattagaatattccagagggatgatggttccttggaccagggtgtggtcaaggagctggagagatgggagtcagttacagacaagacagtgggatttattgggattcttgatttctctcagtggtgagaaatttcgtctttccacacaccttccatggaaacccggaacaccatgggtcccccgtaggcagtcttaagaggatagctgtttttgttctccttccaaattcccattagacttgaggtcagagtcacactttacttgttttgaatatttaaagtagtatacctaatagctcaatagactgtatgcttttatttttattttttgagcctgccttcctaggtatttggacaaatttctccataagagaagtgaacacgtaactctaacttgtaatagcaaataccgcgggaacactgggagccacatattaagatgttattagaccttccctggagtatccaaatggtctataattgcttaataaggagaagtttttgctgagatttacatgatagagatttgctttttaaaaagaaattatccagatttgaatggaaaaattgcatagtctcctgagtgttgttttgcctttgactttgtactgtttaagaactgattatgagcaggaggaaataactcacttcagctgtaatataaatgtgcattggtatttaagcatatgtgacacataaaacaataccaacttggccagaatttaaatgtttatgtaaattacatttttggacaggcactttcctctattttgcagagaaaataattttttcccaaagagattttgtgtttaaaaaaaaaacccctaatactactattaggagtgttagatgccttcgatgtggttttctttcctctttttgcctgaaaggcttgagtgctgaagcatctagcgctattcttgtgtccgggaacgttcctgcctcatttttgtttctagtcttgtttctttctgtgtcagaaataagactaatgcgtgcagctgcacctatagttcaagatgaaggggtctgtgtgagagagagaacgtctgtgcatgtgtgtatgtgtgtgagtgtgtgtgtgagagagaggagagacgggcgggggaggggagagagagagaaaagagagagagagaaaaaaaaacacagcctctttgtaatacctggttgactcagtgaagtctggctctctgagctttactgaattcctccttacttattttggggccggaggtggagatgagttcaaaagtagataaaatttgcctgttacctaaatgagcagaatagattgcgcataatcttttctagatgaagcctgtgtttttggcattctgctctcaagtcctctgagctgatctgagagtgaactggagtgttaagttgagagagatgttgatgactctggtgtggtcttttcctttcggagaagtggaggtgaaacgacttgcccggggtccctgggaagcagagcttgtgccaagatgtaatttttcggttctaagccctgtggtttttcttctgcagcaaggtgggtaccctttttctgtaagggaccagagagtatggattttaggattttggggccagtcttggcaactattcacctctgcaactcagccacattgtgagaaggcagccctgcacattgcataaacaaacaaatgtggctgtattccaataaaactccatttatggccactgacttttgaatttcatagaatattctgtaagcatgtgtcagcagcttcccctgtgcaggtccatgctcagaggtagtcgcgttggggaaagttgctttctgccctcctggagttgatagacttgtggggaggcagatactggaaagcagccacagacacaccaaaggggggagtcagtcccctgtcatgggaattgtgatggggagcgccctcccctgtgcatttagaaaggccccgccacacggaaccactgggaagctgaggcttggagattgcgtgggatttgagatgagccaggcgtgggcagggagatcgcacaggggaaaggaggatcgccgtggatcacacaggacaaaggaggtcctgacctgtccacccccaaagccctttgcttccctagcccacgttggtgtagggtgggccgagagggggcgcagtgtgaggagtgactgtagctgcagctcagcagcgtctcaggagaagccagctgtctctactcaccacgggagtttatttccagtgtgggagagggactcttgagagagaaggacaagatgcccgtttgccctacagattcctttgaggaaaattcctataggggtctcgtctctgttgtatttattgtagtacgacctttttttaagtgattcaccataatctctctaggccgtatttaggcactgaccctaaatgtgcgttaaaaaaaaaggtttgggatattttggtttatttatttgtgtgtatgtatatagttgttaaattggtgtccttggggtgggggttgatcggtggaaccttatcttctctgctttcttgctccaccccatattttggtttgtttttgttagaggtcggcaaaccttttgttgtcaatggccagataataaatattttgtggtttttaaaccctgtagtctctgggtgttatatggcaaaagcagccattgacaacatgtgagtgactgagtgtgtttatttatgggcactgaggtgctgggatcccatattcacactgttccgccaccatcaccgccattcataactcccaaactttttctttttcttggtggaggagtggagcagggtcttgctctgttgctcaggctggagtgcatcacggctccctacagccttaacgatcctcccatgtcagcctcccgagtagctgggaccacaggtgcgcatcaccacgccaggctgattttttaacttttctgtagagacgtggtctccttaggttgcccaggctggcatcaaactcctggcctcaagcattccacccactcctgcctcccaaagtgttgggattacaggtgggagccaccgtgcccagcctcagaaatttttcattatcccaacccgaaacctggtccccatgaaacagtaactccccattctcccttcccccgcagcccctggcacccaccgttctattttctgtgtctgtggatttgactagtctgaggtgcctcatgtcagtggagtcatgctctgtttgtccttttgtgtctggcttttttcacttagcataatgtccttgaggttctcccatgttgtagcctgtgtcaggacatttgcagctcagttcatttccgaggaattgtcctatatgcagggggtcttaggaacacaggtaacttcacttcccatttgaagagcgaggagttctcccgaggccctgaacaggaatagagactgtgaggcattggcgtttggaaggaagtgtctctgaaatagaaacgactgtcagatgaagagggacagttcagtatggtacccgggcctgcctttccagacgtccccagcctctttgcctagttcccactctgggcccctgggcaggtgacccgcagctgcacatgggtttcctgggaagccacagtgctgaggatcttgggagagaggctcaggatcagagtctggggagtgcaggagcttgcggggggagggggtggggtcagtgggggcggggggtgctgctttggggattgggaggagtggactggggcggggtcacagagtctttagctgaacccatgggtgctctgggtctcggcttgtcctgactcaagtcaaggggcccaggcctttgtaaaggtccacattgcccattcactggggcctggctttgggtgagggtggcagctggagatggggggaagccctgaacgggaatcttggccacacactgctatatccgcgacaccaaattctatcccacctgttgttggctgttctggaaaccagcactgaaaaatacggagtggaaaagttttctgattttttttttcctgctttgtttgggttttttggaaaacaatttcaaaattagcatatggcttgttaaaattaaatcacaaaggaagtgcctatggtaacgttttgatcaggctctaggtctgtgtgaaccacggcccatatttgaaaatccagctttattgggacatagccatgcccattgctttctgtgtcctctgtggctgctttagtgtgccaccagggcagacttgggtgggttgcagcagagatggcatggccctcaaggtccaagatgtttactctcttgccggtcctctgttatctctggtctttgtggttgccacagttttcttggatccaggagttaaaggcagtcctgagggatgatggcctcatctccgcagttgcctggaatgctgaatttcagacgtgctaaaggaggggttgcagacattgtgtggaatgcattcagaccccagatgtgggtgcaggaaggcaggcatggcacagccaggtagagactggtttccaggcccaagcagccttcagcagctgtgcgccttgtttctgatgttgtttgggagtaagaataatgtagacatggggggtcatgaggctcagggtaaaaacttcaaggaaacctccatggcatggttgggcgcagtgactcatgcctgtaaccccagcactgtggaatgccaaggtggaaggatcgcttgaggccaagagttggagaccagcctgggcaacataaggagaccctgtctctaccaaaaaaaaaaaaaaaaaatgaccaggtatggtggcgcacacctgtggtcccagctactcaggaggctgaggcgggagcctgggaggttgaggctgcagtgagctgtgattgcaccatggcactccagcctggaccacagagcaagaccctgtctcaaagaaagaaagagagagatagaaagagagaaagaaacctccatggcagatgcatggaggaatgggttaatatctagaaatacgctgagtggtggagtaaagaaaacccacaatagaatacctgatgaatgtggggaaagcacttctgagctcctctagttttagaagacctaaaaagacgatttaaaaaaacaaacaggagagccctgttattgttgatgtcttccaaaacgaacgtgcatttataagccaggtggcattttaatgtcacgagggggtccattctcccatctgtctcctttgcttttgttagagtcagtagcttctaggtctgcttgacattggagaggatactgaatgcagaaaattttgtttaattataatgatttgattttttccttctgtattcaagtttgcctgcttctaatgaattggcagaaatgaagagcttgctcagattttgccaggaccatttaaaagcaattaaaatcaatttagttattaaatttgaaattattgtctggctaaatgatagtttaaaattcaatttatactggcacttactttttaatgaacagaccacatcacacatttttatgttctcaaattatctgtggctttaaagctgtaaaaaaaggtgctcttttaaaaaagccctgcatgtttcctttttcctctctacttccgctaaaatatttacatgtttcttttaaaataaggtgagaaaatccccttgacttctcaattttaagaaactatacttatcttttcatcacaaatgttcatttatctgtgttgaagtcaacccaagaaatcttaaaatataacggaaagaaaatgtttctggattttttcccgagaatacatatacttttaaatggcacgttttacccattgactttaattcctccctccctccattacatttttagatgtgttcaatgaaacgtagtcctccccctttaaaaaaatggaccgagcatcacgtgtgaggctgcaaagaggctccctgccaaagcatcttatctgccgctggtaaagccccgcccctccgtcagcagctaacccttgagcgggatgtgtgcttgtgccgggtgcattgcattaagagaatgcaactgaatagagaaggatcaggaccttttgtgcagaggtggggagtgttaaaaagggggaggcctgggtgggagggtggagttagtgggagatgggtatgcttagtgcttaaattccctgcattccctaacacgaatttaagaaactcacacagtaaatgagtcagggagagggagagacagggagagagggaggggagagggagagttcctttcattcatgacaggatgaactttgcatgcttcagaacaatttacatttttccttatttctaggtacttttttgaactaagaacctggagggtgtgtgtgtgtgtgtgtgtgtgtgtgtgtgtgtgtgtgtgtgtgtgttggtgtgtgttggtggtggggtttttttgccttatatttcataaatatttcttggttgattaaatgtcaataatcgctcatttctggtttgtaaagctgttacctgatccttgaataccacgaatattttgtacattctaaataattgagagaaaataacaacgacaacaaaaagacacaaataaaaagcatctccgcttatttaagaagagtagatctgtgcggggcgctgtggctcatgtctgtaataccagcactttgggaggccgaggcgggaggatcccttgagtccaggagttcgagaccagcctgggcaacataatgagaggctcttttttttttctttttgagacacggtctcattctgtcgcccagactggagtacagtggcactatctcagctcaccgcaacctccacctcctgggttcaagtgattctcctgcctcagtccccctagtagctgggattatgggcgcgcaccactaccacccggctaatttttgtatttttagtagaggtggggtttcgccatgttggccaggctggtctcgaattcctgaccttaaatgatccacaccctccttggcctcccaaagtgctgggattacaggtgtgagccaccacactggggcgcaagagcacgtcttttaaaatcagtgctgtctgtggggtgggaggggaggagaagtagatctggccatgctgaaaggttcgtgcagtggcctcctgagctgcgcacatgcttctggagctttgggtggacatttagtctgcatgtggatctctgtccaagcctgcactgggagcccctgccccaggaagcgaaggctgcatttcttttatgtcaattaacagatttctgccccaccctggacatctgagcgttaactgatttgtaagggaggggtgagggagggtaaaattacaattctatatcttaacattgggggtgaagcatttttaccctagaggaattctatccaaacacattaaacactcttaataagggacaaagggttgggacgtagcggttagggggcaagcccatgagcctcactccttgtgctctctctccaggaattggagagggaatccttttgcttagcattcccacgcctcccacgggcctggcactgggcccgcgggcttgccttagtctcctgggctgccctaacgcagcaccacgtgccgggcggctgtaacagcagcccgtaattctcccacagtcctggaggttctaagtcccagatcgaggggtcagcagggttggttcctccctaggcctctctcctgggcttgtagatactgtcttctccctgggtcctaacaaggtcatccctctgtgtgtgtctgtgtcccctcatctctagtcctgttggattagggcccgtcctaatgacctcattttaccttagttacctcttgaatggccctaactccaaatgaacagtcacattctgaggtcctggggcttaaggcttcagcatatgagttgggagtagggatgtaatatgcctaatgtccagaacaggaaaatccatagaggcagaaagtgggttcctgcttgccagggctggggacgggcagtgtggggtgactgctagccagcacagggtttcttctggaagtgatgaaagtgttctggaattagacagcggttgcaaaattctgaatgtattaaaaaccactgaattgtacattttgaaagagtgaatttcatggtatgtgaattatatctcagtaaagttgttataaacaaaaactgtgagggtaagaggtaaaaggaagggagttgaaagcagcatcaggtgtgaacagcccataattcagcccatagacgagcgcgaactcctagcacagctgtctgttgaagatgtgcgtgaatgcttgctttccgcacccttcggcctgcttttctctactctccaatttcatcatacattctcttccttcctccccctccccactttttcaaaacgtttcttctagtccttacttgtggctacacaaaattccataaacataatgctgcagttcaaagaagtgttctgatggtagggagataacttaggaaaatattttacctttggggaagttttggtttccttctgagtgaaaaccctccatgaaagagaaacttaaatgcagttttcaaatgctcctgagacattcccagccttttctttgtggagaagtgaaggcaggacaatttccaaggcaaagagggacctatcgcagacagcagaccccaagtaaagaaaggcacagtgatggtgggtattcgtgcagtgttttgaaaatgtggaggtcagggatgctagcttaccaggccagcatgatcaagttacgagaaatggagaccaggacactacctctgctgggtgtgctgctccgggctccttcgaaaggggaagcagctggtggacttccttgggctgtggttaaatggggctcccataggtgccatgaaggctctgcagagccagggatgcttgcaccctggagagaccttgctccaggagctcaggagctggtaggggtggtgacagtgaagcaccggcttgccgtgcccagtgcttgggcagtgctgagctccgagggaggaacccagaaccatgcgggagcaagggagggaggcaggcgaggagaagggttgcccaggagcctgcaggtcgggtcggtgttgtatcaaattgtcttttcctgctttgctgtctgatcccactaaagactagccagagagatgtggaggtgaaaaatggtggacagccatttttctccctttcactgtgtctacaatgtctgtttcatatcaacagcaacatctgtgcaggcatcctaatgagtataaataatgtcttcagaaaactgggtttgtgaggctcctgtcatctgaatttctttcatcatttaagtgatgattttttactcattgacatacagttgttatttagtggccacgtattattcgtatagggttctttatgtgctttctgtgtacatttgttttcgtgctcatcgtatttcagtgtggcttatatataataagatgcacctgttcttagctattgtggacttttttttaaaaaaaggtttatagagatatgattcacataccaaacacccatttaagtgcctaattcaacagttcttaataccctaatttaaaaaaaaaatacagtgttgagtattttccttttctcgtttttcactaaagtagactcaggattggggttatctgtcagtcccttggtttgattcttggctgccagtgtttactggggacggatgttggtacctcccttaataggatattgttacagcattttacaaattctggttaaaaaaagtcccacatgagatctcccctcttcccccctctctgagtgtaggcattgtcagctgcagttgtccagcatctccaggactcttttcatttgcgggatggaaacaatgtaccctctgaacaactcctccctgtttctcctccctccagctcctggcaaccactattccactccctgcttctttgaatttcacaacttgaggtagcttgtgtaagtggaattattttaaaagctggttcatgttaaagtgcttagaacagagcttggtgagcatccggtcaacagtaagtacttttattattctttttatattactctttttttttaaagaggccagacacatgggcttctgtcttttcacagcttgggatctgtgcagacccaggcttccagaagccatcccacttgaattcttactcccttttcccctaaaaagaagctctgaaatcctaattgtcaagaaggctttgcctgctgtgcatgcctgagtaatgttatttttgtcattatttgagagacagagaggaagcttccagtcccctgtaaggaaacgaaatcatcgtgcacagatgtggttctgtttatagagggaaggaaatggaggtgaagagtgtgtgtggcttgcagccaggcttgcgagtgtgcagaggaataaacttttttgcctccagagttttaactggaaatgtgtctgaattctacctcctgggcacactggcctgaggtctcccctgcatacctgatcgtgaaagtcttcgggtgtgtttgtaaacacgcagcccccctgatgtgagagtcagcacaaacttctaaagatgcgatgatgaattctatcagagaagtctttctggttttgtgaaaataaccttgcactctttaattatatccaaatgatcaaatctggctctgatgtcttgtcaaaattaatgttaaaggacagtgccctttatattttacttgtctgggtataaacatcctagtctttaaagttgagtctgtaggactacctctctacttgattactctgaaaagagtgtatagagtgagtttttaaaatggaattagtgtgcatacgaggaacagagtgacatttaacaaatccttcaatagatagtgctggtatgaggattggtgaaactagaggtagggaatgagcatttttggttctgtatcatattcccaagacattttcaaatgattcaccctttgccatcagaatggtttgaaatcgatcagcctgaatccactaatgtgggctgcggcacatgaattttaacactagaagcacacggttgtgctgtgtttcaaatgaactctggccatttgaagtgagcaggcataggcagtcttctgtcctgtgataacctcagtacatatcctttctgttttttaaagtaccttacaagctgctgcattacagtcgttattattgggccattacaaaaagctgtccaattttaagtgtcttggataattcttgtttgccccagcatcagaattgagcatttttttttttttttagatggagtcttgctctgtcaccaggctggaatgcagtggcgtgatctcggctcactgcaacctccacctcccgggttcaagcgattcttctgcgtcagcctccggagtagctgggactacaggcatgcaccacgatgcccagctaatttttgtattttttagtagagatgaggtttcaccatgtgggccagcatggtctcgatctcttgaccttgtgatctgcctgccttggcctccgaaagtgctgggattacaggagtgagccattgtgcctggccaaaattgagcacttttatcatgtagtattcatgtcttactggcaatgccctgtaaagttaaataagttacatttgtcttgcacaggtaataattatgaggtaatttccacagaatccaagggcctcattgactttgctataaaatcaaaacagtgaattctgataagactagacgcatgttactcttaaattgggctgtctcctggccactgttgtgcctttaacctcagcagaaggggagctgggctgcagagtgaaattacccggaggtcaaatattgctaatttgacttttatcatagagacattttctcctctcgcaccaaggcagtggctttaatccctctttcagtggtgagacaggtgcaaagcgtttacaaaaggctttctcttgttttgaatgcgccaagaaagatttccaggccgttaagttaccaatccttctttttaagtcttgaagcaattactgtaaggtcaatccactaatttcctttcagagttaccaaagacctctcatgtaatcatttggtacttgttgccatgtagccagtatcactgagtgcttttactgtgagcaaagcacaatgcatcgggcagggagggatccaaagggatcttggtttttacctttgagccatctgtggtcttgagtgatctacgtgcattagcaattaaaaggtcctgatattcttgtttgggcatattgaaaaatgtgctcttacagataggtttcctctctctactgccccccgccccccaattttttttattgtggtaaaatacataaaacagaatttaccatcataaccatttctaagtacactgttcaacagcattaaatattcattacattgtgcaatcctcaccacgatccatctgcagaactttttcatcataccaaacagaaaactgccccattaaacacaaactccctattcttccctccccacagccccagcaaccaacgttctactttctctctctatgattttgacactctagggaccttttatatgtgggatcatatggtatttgtccttttgcgtctggcttagcacaagtttcatccatgtcatagcatgcgtcagaatttccttcctttttaaggctgtataatattccagtgtatggatggactacactctgtttatccactcatctgtcagaggacacatgggtggctttcaccttttggctgttgtggataatgctgctatgagcattggcatatgtttacttctcattgatttaagtttacatagtcatgtgtggctagtggctgctgtattagacaggacaaccctaggcctgatagccctgaggacctagtttgggtgggaagacaggggtgacctgcagcgagttgtcggctgggggccttggtgagagccagatctgggttgtgaggccactcgaggcagggggaatggtgtggcgggaagtgaggcccaaaatgagaatttcagagttgaaagctttggaagtaacatgatgctctatgactgtgaccagactcaactgcaccaatgtgcatctgagatcaggtcattggcgttgaaatcgtgaaatgctcactgcttgggacgtttgcactgtgcttgatgtctggaggttccgttaatgttaaaatagcaattatgggactggagattaggtttaatgtctgggttttttccactgtcttcaaaagcccgggtcttagtagtaaccatgctgctccccattttagtaatttcagcctggtttatgttgctcaatagcagaaaagcggttcagatttcctttggatatcatggaccatatgtttgcccaggtatcctttcttattgggaactatcaaatagttaacacagatttctccaagggcaccgactgggaaattagtttaccaaagataaatttggtaaaaggaaagtttttatgtgcgctatccttaaactaagacacatctgtcgaaatattaggacgtgcccagtctcccatcctctgctgaaactttagactgtacgtccttcagatatcttctctttggtgctttgtttgggaacagattagcctcatacttcctcgcttgtaaaactgctatcccatctcttgctcaatgcttttcttgtaccgaagggtgagggggaggttccagctctgttttctgtatcagtttcctgggtgatgtttgtttgagggtgccttgtgtccagagccccagaaggtgtttccgttctctgatgagcctgaagtctgcatgcttcgcctttggtagggaaaggcagctggggaaaggttgcatggcccagtgccagggtgccagagtgcgtgtgcacctgctggggagaagcccgctggggcccctcctctcagcacaagatgaggcctcagggcagtgcagcagatggagggcttagctgtccttgccagcaaaagctgctgggaacgtggcactcagataacaggacggttgagaagcggtgagttagggttactctgatggggagatactgagaggaggggatgacaatcttgatttctgttccctttgtgaatcttttggtggccaaaatgaggaaaaggatacattgtgtttgaggacaacaaggaacatctaggcacattgcatacttgattaaatgcacaaagagcttcttgtgacctttatcacaagagtgtggttctatgaaggtcgtaggtacaatagaaattgtgttggtctgagagttactcagattagggtgcattgtgtcaccaccattttgcatagctgtggcaccttgtcaagttaaccttttcctgcttgcttttcctaatcagaagaatgaagttgaccgtatgtactctataaggtggttgtgtgaggtcaatgagattacataggcaaaatcttggtgcaggggcacttggtaaaggttagtttctgttataaatttggggtattctgtgatgattcctactcccctcttctcctcatggctaagttctacttattctttgacgtggctccgatatcactttcctcaggaagcccggtttcccacccagatggctttgggctactcatcagtgttctgtaaaatgctgagaatattgtttatagcacttctgggttgttttgtgatagtcttttgagatatctgtctcctcaccaaactgttctttgtgtcatgggcaggcccacgtcatcctcgtctttgtagtcctgcacctggcacagagcctggcacatagctcagtcaaacaggtgaagactgggttattacatcttcccactccacccccttcattatcaagtcgtggtcagggcatgccccaccaaatgcaaaccctactaggcagtacagctgagacttggaactagactaacccagtgactcagaaatgtgccacaggacttatttggctctagatggggtcttaaaagacattcatagttgcaggcagaacagaatatccagaacaggtgcagaataacctgtgtgtacacagtaggtggtagttataatgcaggaagaatttggcacaagaagtgttacagtttaaaatgaagtcatgggccctatccacactggggacagagataatagtaactaatcatcatcactgtcatcactagcccattgtcagaggtagcactgaacacttatgcgttagccaggatttgggttctagagggtttagtgtactagttgggttaccaagacaaagatgcaggcatggggtgcaagttaacaaaggttatacactaggtggcaactgactcacaggagcctggttattgcagcggttgtggccagagccatacaagtgttctgatgcccctcaactgtgttgaaatttgtttgaggccaaccaagtcagctggcgagggggaaggcaagccagagagaaattgtgaaccagaaaggccccacctctggcagtggctcttccattggagatgaagtcttcttgccctgtttttctctttaaaaaagtgagccatttcacaagggaagttaaattaaaaactgtgcttgttagcgcggagctgggacaaccgagggaagtgatgccaaaggcaattgttggtctttccttcaaatatgtgctgacttaggaagagcaaaatgttttatattaacaattaacaaaagactaagtctttcatcacaaacaagtctaaattcagtggttaggtcagtattatattttcctatagttttaaataagatgcttatgtattcactagtgctttggatgttctttggaaaaatctccaatttagtgacaagccccaggaaatattactcttagttggtccagcatcctatattgtttgtgaaatccctcttttattgtcttttaaaggttgtaaaatgctttttctgtcaataatcagagaaggatgccgcattcatattaccccagtttccaactcaacctctcctttccaattgaaaacaaaagtcagaattcactttttgttgtggggcattaagtagtaagcaaagagatttcactcgccagggaaaagaaggagcctgcaaatcagacaatatcaaaacataaccaaaccatataaaaacacaaaaatgttgcttggcagaatttaactataattaattgtactaatttaatattgtagacacaaatgatcataaagccatatggtacaatccttttgttcatgaatttcttattcatcaaatgttaggtacgtgatgtgggaaagccagtatgttgggcttcgtgctaccagggctagagttgaccagttcagctttgtttctccagtgaccaaaaaaaaaaaaaggtatctgccttgcacatgaaaacactggatggttagattggatttagccaacaacaaactgcaaaaatcggttctggctaactgaagctcacagggtttattagagttgttggagcccatgggaactgatggagggcaaggaggcttgtcgtgcaggagcagcaggaaccaaggaagctttgcagagatgagaaacaaaaaacagggaacacagcaacatttgctgtgtcaggaacgactgccactggtggcctggacaccatcacagccgcagaagatacttaagacacatttctgttctagtgttggtagttcaagattcaaagtatgtgtgaaagtgagtgtgtgtgcataggcagagtagctaattggttgagttggggtccatgtgcccacctccaggttggaccaggggacaagccatgcagcgttttggtcacccctcacttggcagtattcccaccaggaatgaccctcgctaggatttgaggggcctggagtcactacttactaattttcttaaagttgacaacgatcacaaacttcatggtctgggaaaatgtgaattaattgcctgatccaccttcatatcttttttcttttcttttttctttttttttttttttaacaaaaatctgtatattcatagattgtctcttcctctgctagtggttttgcagtagcattttcaggtgaggaaacaacaacagagtttagggtccagctctgtcattgccattgttgtagcgatttacaagttgttactgctagtatgaacttttgcctagttaaattttggaaacttgcctgtaattgcatttgatggatgataaaaattgataaatgacttgataagtgataaaaattctacggaagaattttccatggactggcttctggctttgatcctttccaactgtgcttctcctaccctcaggccgcccctatcatgctgtgcttgtctggccccactcaccctgtcctgacactggatgatttatttccaaatgaattgctcctggaagccattccaacaccattacaaccggcggcaacacagctgtcttggatactcctggaccatatagatagatgtaaccacagcattccggtagctcccacttccccagcattttcttttagaatgggggcatcagagttgaaggaggtaactgtgggtagtgtgtcttgtctttggaaattttcatcatgacctgagcttgtgaacactctgccttggccccgcctcgcactttggaagagactggagcaggagcgggcagcgttgccttcgcagcatggtaacttctctcagcgctgtttgtaaagcagaatgggagaggaaactccccagagggaaactgggaccctgttaggtagggctagcaagaggtggttaaaacgtaagcatccgctgcaccagactgtattctccacgactgtatattttttgttgttcataagagccccgaattgcaatgagtacgattttccctggacgctgcagtgtatggagaagctgtcacttgtcacatgacagctcagtcattcgatccctgggtgctgcagagagggaagaattggcctcgcagtggggagtgagtgccagcccgtggcctgtcccctgccacgtgtcaccatactgaacgtttgtgtgtgctctgtgtgttttcaaaacaccttcatgtcacctgccccggactcctccctgtgagcaaggcagggtgggcgttaccatccctctggaccaacaaggacagaacagcttgagacgcacagggtggcttccccatggctgcggaggcatagaaagtgagggcacgggacgtgaatccgtgtgctgggattctggccgcctgtgcctgccgatcaccctcagtgcctccctggatttgattttgtggctcttctgggtgtgcgtgtgagtgtgttgtgggtaagtctgttgtctaggggaaggaacgggaaatcatccggccaggaatctctgtggggtggtcggcttgagttggccatatccaagctctgcgtgtgtctcacttttcagagtagcaggaaggccgggtgactttgaaatcagatgggtattttcctgattcgaagagacttggcttcttcccccgcccctccttctccctcctcccccctcctccctcttgctggctcacaaactcaatggggcatcccagcccacccatgggaggccaggagaaagaggaggcagagctgtcagagtgtggcccttcgtcttgggggtgtgcaagtgaccgctcctgccccttgatggctctcctgtttcgggtataagggatgttgtccaaaccatgtgtgggactctctgttgacagttgtttttaaattgcctgtttaattgagcttctctaaagtcttctttgtgccaagtatcgggacaggtgatagaaatagaaaattcgacacaaatcgaaaattccagtatcaaaaatgacagcgatgtacccttgccccttaacgcagccaagaaacaggggtgaagggctactctccacatatggagcaggccaccacccttgagtgacagtagccgaacacagaacattctctgcagatgtcactgaggcttaaactcattatgttttaaagggataatctgctattcttaagaaaacaaaaaacaatcacaaatctccctgccctccccacccctgcccccacttagatcctggtagggtctggcagggggagttttgcaaggagttggggcaaattactccagcagatacttccaccccgtatcccaagaaatgtgtgtaaatgctgttatgaattaatttaaaggtattccaaactcctactaattattatgtgtttgctcaagtcaagatcaggagaagtacaggcattgctatcccatggggcctgtgaaactctggtgaggtgtcctagtggaagagcttggggccccatggtgtctggaaagcgggctccactggagattctggctgttttcagcttgatgcacacggggtcccctggagaatgccaggcctgcctgagtgtgcagaggtgagggatcctcacactgcccagcatgtacgtggctgggagactccagagagacatgcaaaagtgctgttaactagacggcgtggtacaaatgcaaagtgagtgggtttttttttttccttaaacgacagtgaacattcatttcaatatttattttgcttattttaatattttactcaatgtttatttatttttatgtttttgagacagagtttcactcttgttgcccaggctgaagtgcaatggtgcgatctctgctcactgcaacctacgcctcccgagttcaagcgattctcctgcctctgcctcccgagtagctgggattataggcatgcaccaccacgcccagctaatttttttgtaattttttgtacagacagggtttctccgtgttggtcaggctggtcttgaacccttgacctcaggtgatccacctgccttgacctcccaaagtgctggaattacaggcgtgagccactgcacccagcctcaatatttatttcaatacagaaacggacttaattgggtattttgttgaaggcaaatagtagcaaagtgggactggtgtgaggcagtggaataacttagtgaaatccaaggtttatgtagttattttccccccacttttttttttttttttttttttttgaaatggagtctcactctcttgcccaggctgcaatgcagtggcatgagatcagctcactgcaacctctgcctcctgggttcaagcaattctcctgcctcagcctcctgagtagctgggattacaggtacccgccaccacgcccagctaatttttgtatttttagtagagatggggtttcgccatgctggccaggctggtccccccatttttatggtttgaaaattttcaaaccctggctgggtgtggtggctcatgcctataatcccagcactttgcggggctgaggcagaaggatcatttgaagccaggagttcgagaccagtctggacaaatagcaaaatcccatctctgcaaaaaataaaaaaatgaaaaattagccaggtgtggtggtgcacatctgtagtcctactgcttgagaggctgaggtgggaggattgcttgagcccaggagttcaaggcttgtgagccttgattgcgccactgcactccatcctgggtgacaaagcaaaactccatctcaagaaaaaaaaaaaaattcaaaccctcagaaaagcttaaagaatagattcatggatcgttaaacatttttaccaaatgtatgttttctctcattactctaaggttgctccctttcccccctcactctcctcttctccttcccttcactccatggatgtgtaggacattctcctacaaaaccatagtacttacattcttgaggttgtcacacctcataattaaacatatgatggttttattaagtatgctgtcacatgtaaatttctccagttgtttgatccaagttgtactcatggatagtgtattgtattttacgtctctttagtcttctgtattgtagaggagtcccccaaccttcttctatgacataggagtttggggatttgtctgtttcccgatgtgattagagtgatgttgaacagttttggcaggaacgctgcacagctgatgattatatttcccattgcatcccctcaggaactcagaatctccttctccatccttggtgaaggtgtattcaccagatggctccctgttgaagctcccttctctctgttaccaatgagtaatctgtgctatgatacagtgagatggtgtgattattctgttcctcacagtggttttcctttggtggttttagcatccactgattaccataaattaattagtccagctttggcaaactatggcttgccgtggtgactcacgcctgtaataccaacactttgggaggccgaggcgggcggatcacaaggtcaggagatcgagacccatcctggctaacacagtgaaaccccatttctactaaaagtacaaaaaattagctgggcgtggtggcgggcgcctgtagtcccagctactggggaggctaaggcaggacagtagcctgaacccgggaggcggagcttgcagggagtcgagattgcaccactgcactccagcctgggtgacagagcaagactccgtctcagaaaaaacaaacaaacaaaaaaacccccaaaaaactccaccaagtctgtttacttatgtgttgtctgttaacagttgcttttgcactacaacagcagaattgagttgggacagagaccagatagccaaaaatattttctatttagctgaatcttgatctagtacatttttggtcaaaaaatgatgcatttctaattcttctattcatttttcatttagtagttggcattcttaaagaagagctttctgttttgacctttaaaaatcactatggattcatttattcttaatttttttttttttttttttttttttttttttttgagacggagtctcgctctgtcgcccaggctggagtgcagtggcgcgatctcggctcactgcaagctccgcctcctgggttcacaccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgggccaccgcgcccggccttattcttaatttttaaaagtgtgttatacgttgttgtcattacattattcttttagatacacaatgttgccctaaatttgcccagtgggaacccctccaggctgggcactgtgttcttctgtcacgcccccttcaggatggggcctgggttcttttgttatgctcctctaaggccctttaatctatgtcgtttcatttttttgttgttgtttttattttgagacagggtctcactctatcacctaggctggagtgcaatggcgcgatctcgactcactgcaacctccacctcctgggttcaagccattctcctgcctcagcctcccaagtagctgggactacagatgtgtgctaccacgcccagctaatttttgtatttttggtagagacagggtttcaccatgttggccaggctggtctcaaactcttgacctcaagttctccacccgccttggcctcccaaagtgctgggattactagcatgaaccactgcgcctagcctcgtatctgtgtcctttctttctgggaccggaagaggtttcaggttcccagtggaaattccctgcccctcaccttgaatcagcctttggccaaagagccttggagaatgatatttaatatttaaaaaccaggaactgagaactgagtgtgctcattgctatggggatatcattgctcctgggctccttgggtgcagagacccagggaaatagatgtttctgtgtatgctttcacactgtccctccctctcaagcccaactccacaggatgcttcctcaccttcctcttgccatctagtatcacgcttctgtagtgagaatctgctgcctacagcaacaacatattgacacatccattctcttctataggacacaaaaaaaggtttcagaaatttttacgttggtgctgccaccaccaccgctaccaaagcaatgaaataaagttcaagattccttgagattctcttgtcgttaggatgtatctcactgtgggtgtacagacaatatacaaaagttacttaatttttctccgatgtttatagtaccaatttgataatgtaagttaaattattcatctttattgaattttaagatatgcatattttatcctctttgagttaagtatttttcaaatatagaaaacgtttacgtggtccaaagtcaaaactctgttaataggtttgctcagagttctcagctcccatccttatcccaccaccccatttttactcacctcttcagttcattgccattactttttgccttatcttttttgtgtgtttctttttgcatctacttagtgcttttaagccccccatttaaaggcctaatgctaagtcttacatgtaaaccagcaaaaatgtcacctttttaagtagacttttgtgaccaaaaccttattatcaaagcgtgaaagttgagaccgtctagggagttttcatcatggtggttagacagtgtgtggaattgaaatgtacagcgtttgtacatgcaggtccgttattgagagaactgatccaaaaccgtgacgactgccaataaaatgtactttaccaaatatctgctcaaaatgcccatgtctccttaatgtcaatacccaacacatgggtacatccagttttagtctcaaatgttttaagatttattaagcttggtttgcaggagtttagtgttcttggaattagaaggatttctctagtgatgtggtgagaagagataaacctgggaccttttgtgttttcttgatacgcacatttatgttgtgtgcaacacaggaattgtcaggaacctgcaatgcaatctttcttgatttataatcttgcaaaatgtggaataaaaagtaaagtgcaaagtttaagtggtaagtgttacaattcatgtgaacaatatgatgctttttctcatgcttacttgaagacagcagctggcccttgagttcagtctcagtgcaaacagcctccaaagaaagtgcattgcactaaggaagcccttttcatctcacaaagggcaaagtctggattgcccccctttctctgttgtctttgcctgttgctccctggaccccagccagtctccccaggcctggagctgggtcagctaggtctgtggccaggaggtgggggtccacgtccactgtgctcctcagcggcaggttctgcaaactgcagcccgtggggcagactccacctccagcctgagtgaggccatccagctaagaatggctttgacatttttaaatggccagggtgaaaaaactaaaagaggattttgtcatgacacatgaaaatgatataaaatgaaagtgtcaactgtcatacattttgatttttgtcagtttcagagaaatttattttctctttttattaaatgtcactacataatatacttgattttgcctttctgctcactgaagctaaaatatttactctctggccctttccggaaagagtccgccgaccccctctctgtggaatgagagcttccaaaaagatgcagaagaccgtgcatcccaagcggttgtaaaagccacttactttcgtaggtttaatgactcaaaagaaagggcgcttgttccctcccttccttcctgggcaggcccctttttggaatggagtttcgttatacagaaagttgttctcgctgtacagaattctgcgatgccttcacttgatggctgtttcttcggggataggagggctgggggtcaggatctgatctcacacgaatggttcagagtctggacttagtagctcagagcagttcactgatttgggatctctggaagaaaagggtactgagtcactggcaccttctgctcagctcctgacagcagtgtaaaggatgctttcgtgacacccagccttcagcccaggaggatggtggcagatcagacagctctggaaatgcagggcacaatgcgcagagggttgcaccacaacagcagtcactcggtgcccgcctggagcactgctctcatttccagagtccctgtatttctgatcttggctgctttaaaaaggaggtgtgggcctgggatcccagaagtattcctctgtgattctgtaccacagctttaccttaattgggggtgtagggggtggggagaaagaggaagacagatgaaagcagggaaatccttcttggagtcatagttaaaaggataaaataagagctttagtgtagcctccgtttccagcaatccattttattctttgtccacaaactgaatgaaaataagcagtcattcaaaaatgatatttacgtaacctacaaaaatctcaatcaaccaaggaaaaggtggaatggggcttaatacaatacagggctgtctccggagttccctcccttgatttcaggcttttggtgtaaagctcccgaaagaaagcaactttgatttttattagactcttcaaaatcatctcggtagaatattgaccttttttgtgtgtggaaaaatgacttctacgaattctcttgtaggagtgtacattttggtcattttttggaatgtaggaaaaaaaatgtggggtaccctttattgcattttcaagaccttccaaagaagataattctgattgtaactcattataatctgggaaagtagattgttctggtttcaaggactgcgtgtgctttaaataatcacaggctgctctcagacttgggaacttttggtagaatacagcagtgattctcaaccagggcagttgtgttccttgggggacatttggcagcgtctggagacatttttggttgtcacgttttggggaaatgggtggtgctcctggcatctaatgggtagaggcccaggatgctgccaaacatcctacagtgtgcaggacagcccccccccaaccaagaatgatttagccccagatgttcatagcgccagaggtggaggaactgcctcgggggatgtgtaggagctttactttatgggttttttaatggaaaatatatgtatagacacgtacatatatatacgtgtacatacacatgtagatgactctgctcagcgcacccatgaagtatgcagtgcacctgtcccctgggatctggttatacgatgggtgtccagcctgtgcccaggggatcagtttcctttgtgctgctgcagtaccttgtcagcatggagagggggaggtcagttatgaggaggcccttttggggtagagtggaggaatggtgccgcctggtcaaggcctcgcatggggtagtgttctttgtacagttctaggtgaggcggcgaacacgttctcatgcattcttcatggtggtggtgatgctgatgttaagaccaacgggcctctgttgttctgctcaaggttccaagtagagtaggttttctattttcaaaatgtagttcacggtgtcccaatttttagtgcagcgtatttcaacaaaatgtccttttacacatataaatggcttatgttgcaaggtccccctcagcttcctggtgtggaatcagtgatggataaaggcagagaggctctcaggctgacatatactccctatgaagaggggggaagaactgtgttggcccatgggtgtttggggaaacacttgtattccaaggtatttgtggagaagatatgggatgtttttccatgttgggcttcggatatgaagtttaaggaaggagaatggagtcctggtgcacacctctcataagcacacgcacgctggccactctgctggctccagagtcatccagagcatcgagcatagtttctcccccggagaccctccaatctgatcagatagggaggctgtgagtctggtgacccccactgcagggggcagagctagtgcaggtggtgctgagctgactgggagaagaagggcctgcaggaccggctgcaaagcccttaggggagggaggaagtgaggaatttggtttcctaaacgggtggtccaagagaggccgggttcatcgctgtgcagtgaggtggcactggaaggagggagtcctcagatgggccaccctttggggctataagtctcgtggtttgtttctcttggcttcaagataacatatctagtttgggtgttttgggatgatgaggttggggtgtttgggaattgaggtggccgcgtaggcattgaggaagatactggtgttttgtgcggtcaaagggcaatggtgtggaactcagatcccagctctgaccctgtgtggtcttgggggatcatccaccatcagtctatttctctgtgacttggggataacagtacatgtgagcgtgaaataagagtataaattgcatcaatgtctgtgtgtcaaggttgcctgaggaggagttggctgggcttgcactgacgcttgattctttgtatcactccgacttaaaccacgacacttccaaggcagagtctaaagcctgtcctctcacaatcttctacaggtgagtaggaggccatagaccttgtgagtacagagtcctaaaagaaggcagaaatgtgtgaatctgccaaaagtaaagaaagggtgttactactggtcaaagtcgttgcaagaatgctggcttttacaactcctgtttctgctgctatcacctgctgcctgtgtcttgtttcctgggctccagatcattttcacatttctcaaaatggtccttggtagctgtggtagatggaataatggccctcaaggtgtatctccatcctaatcctggaacctgtgaataggtcattctacatagcaaagtggactttgtggacgtggtttaaggatctcaaggcctggtgccaggggctcatgcctgtaatcccagcacttgaggaggctgaggtggaagggttatttgagcccaggagttcaaggccagcctgggcaacagagagagaccctgtctctagaaaaaaactaaaaattagctgggcatggtggcacgtgcctgtagtcccagctactcaggatgctgaggtgggaggattactgaagtccaggaggtttaggctgtagtgagccatgttggcgccactgcactccagcctgggcaacagagcaagacactgtcccagaaaaaaaaacaaaaacaaaaggatatcgagatgaggttggggaggttgtctgggtgggcccagagcaatcacagaggtgcttctgagtggaatagggaagctgggggaacagaatcccagaggagataggaggatgggcgcagaggccccagtgatgtgggcccatgagccaagggatgctggcggcctctagaagctggacaaggcaaggaatcgaattctcccctgaagcctttaaaaaaggacacagccctgtgacccattttagacattgcacatcgagaacctaagagagtgtgtctgtgttgcttatggtagccgagctggagattctttgtgacagcagcaacaggaaacgcagacagtgggtgagcaccagatggtagagtcaagtttaatatgctggagcaaggagggtcagctaatcactggcaaaagatcagggcctgggacttttgctaactgtttctatggattcctccttcctcttgcaatgagaagcgacagcctcgtggtgaaatttgttagctgtttattattttcattgatctgattctactagtgtgatttatgctaagcataaatgaccaaagttgactgtggttttttgaagaacattggaaaataaacgtacaaaattatgtttttataataatggttcagtccaaaataaaggaatatattcatagaaattagctaaaattatagagggtaagttacatacatcttcttcttaaagatgctggtaccaacactggaagaagctgtacaagtgggcaggttgttttttgtttttgagactaggtgtcactgtcacctcaacctccccaagctcaggcgatcctcccacctcagcctcctgagtagccgtgactacaggtgtgcacctccacatctggctaatttttgtattttttgtagagatggactttcaccatgttgtccagactggtcttaaattcctgggttcaagtgatccagatgccttggcctcccaaagtgctgggattaggggcatgagctacggtgcccagtctcaatttttaaaaatatattttaccatcactttccaagctttttgtcctatgtgacaacagaaaattgaatttcttaatccacttacattgaatttaaaatccacttaggaaagtgagcttcaggtattagaattattaactccgaataagcagatactctagcatattttatcttccagattgtgttgtgattgtaacaagacacattttatgcattttagttttcatcacaaactggctgaaaatcatgttatgtacaaatatgacttgattcaatacaatttattgtttgggtataatttgaattagaaagccatttgtataccttttgctcacttacattatgctattatgcttttgacatcagaggaaatacacttacttaaaatcctcgcagatcccagagcaaatgaagagtttttgttcttttaaaaattggaagtagtctagttttctggttgtacagtaacaatgtgatatatattgtctttatcatatatacacacatacataaatcatctttccttcaaagatctcagatcacttttttaaaaaacagctttactgagatataatttacataccataaaattcccctattgtaaatgtacaggttcagtgaattttagtaaatttacagagttgtacagacatcgagacagcacaattttagaacattgtcatcactccaggaagcgtccctgtaaccattagcagtcacgtcctccccagcccctggcggccactgatctattttatgtctctggatttgcatattctggacattagatataaatccaatcatataacctgtggtcttttatgtctggcctcgttcatttagttttcaaggttcatccatgtcatagcatggattgatccttcactttttattttattttgtgttttttagaaacagggtcttgctctgttgcccgggctggaatgtagtggtaggatcatagctcggtgcagcctcaaacgtctgggctcaatcagtcctcccacctcagcctcccaaatagctgggactacaggcagacaacaccacgcctggctaatttgtttttagttttgtagagagagtgtcttgttatgttgcctaggctggtcttttgaattcctgggctcaagcgatcctcctgtttcagcctcccaaagccttgggattacaagtttaaaccaccacacctggcctgttttttattgttagataatattccattgttataaatatcccacatttttagattgattcatcagtttatggacatttggttgctcccatgttttttgctgttataaataaagctgctgtgagccctcgtgtacaggtgtttacatgcacatatgcttttattcctctggggtagatttctaggagtggagttgctgagtcatatggcaatgctatgtttaactttttgaggaactgccaagctgctttctatagtggctgcagcatttcacattcccacccaaatgtatgagggttccagtttctctatatcctcgccaacacttgttattctctctcagagaactttctgaatctctcttataatgcctagggggttccttgttgaagatgaaattagggactaccatgaactgctttaggaaacctgggagaaaggagtcaggcccctttttcatatctatgcagtgtaaccggcctctcagaaagattggttggagtggatgggagaataaagaaatgaatgggttgggtgcagtagcttacacttggaatcccagcactttgggaggctgaggtgggaggatcacttgatcccaggagtttgagatcagcctgggcaacatggcaaaacctcatctccacaaaaaaatacaaaaattagctgggcatggtggcacacacctgtggtcccagctacttgggaggctgaggtgggaggattatttgagcccaggagttagaggctgcagtgagctatgattgtgccactgtattccagcctaggtgccagtgagactgtgtctaaacaaaaaaaaaacaaaacaaaacaaaaaaaacagtacaaagtgttcagtgccgtcagatgttctgaatatagtatgatgagaatgcagtggtgggggagaaggtggattagtttctgtggctgctgtaacaaactaccacaaacctagatgcttaaaactacacacatttactatcttaacagttctgggctgggtatggtagctcatgcctgtcatctgaacactttgggaggctgaggtgcaagaattgcttcagctcaggagttcgagaccagcctgggcaacatggcaagaccctgtctctctctaaaaaaaaaaaagccaggcatggtggtccacacctgtagtcccagctacttggaggctgaggtgggaggatcacttgagtccaggaggtcaagactgcagtgagccatgcgagtgctccagcctggatgacagaacaaaatcttgtctctataaaaagaaactggaaaaaaaaaaaagtagttctagaggtcataagttccaaatgggtcttattctgctaaaatcgaggcatctacagggtggtggtatttgctgaaggctcgagggttaagtttctggttttttgttttgttttgtgttttttgtttttgtttttgttttttttttgctttctcagtttctagaggctgcccatattccttagctcatggccccttcctccatctttaaagccagcactgcttgttcgagtctttttcacattgcatttcccctttcacattgaaagcactcttctgatgaaccacttctgttaaaaccactcttatgatccaagataatttacttttttaaaagatgaactgattagcagcctgaattccacctgtagccttcattcctccctgccatgcaacttaagttgttcatggtttctgggaatcaggatgtggacaccttgggtggggatggaccttaactctggctgccaccaatggcgcctggtcaaagtatcctgtaggatttattcttggaaacggcgttaaccccaacgccctactttgctggctgtgtaagaaacacgaggtcagtcaggcagtaagaggagcatggacttgttttctgaaacagcgacacaatccattacatattttcgaatgacgagatgagatcagacttctgctttaggaagagtcacagggttttgtggatttgcaggggaaacaggcggtcagagggagttctgtgtcaccgtccagaggctggggtgccaaggagggcagtggcagtgggcttgaagagatgcaatggggctgctttggggctgaggcgactggactggcgtctgattgatggaataccaggagagggatgggagagggaaagagatgagtccaggatgacagttggaaagtcctggacttcggagtaaagggtagcgattgaggagttaaagggtagaatcaggctggggagagcaaatttacttttgaaatagtgacctttggatgctggacagggagatatgaagcaggcagaggaaatatgggcatgaaatagagcttcagcattttctacaaagaagccaccacattcggtgacatgacaagggagtgatgccagagggaagagaggtacaagggcagaatgctggggaaatgcctgtgtttaatgggcgtggagaacccgcttaataaataatgagaatatattgctggactgaaacaaaagtcctcattagctcattaaatgtttcctggaattcccagtcaaatctgtgaaacaattttaatgctagatgttttgtaagtatttctccggaaatctggaaatttgtccacagacccccagacattgtttataaactgaagtcagttgactcaagtattttgcaaatgtctatggaccctagtgtgattaatagaaacacaaattattttaaaggtgtcactcaatttacagtcattctgtatttttgccatttggtattttttcctgaaacattacataataagaatgcagcatgctttctttatgtaggtgatctgtgaaactttttgacaattaaaaattggtttttggccaggcacagtggctcacacctgtaatcccagcacttcgggaggccgaggagggcagatcacccaaggtcaggagttagagactagcctggccaacatggcgaaaccctgcctctactaaaaatacaaaattagccgggcgtagtggtgcacacctgtaatcccagctacttgggaaggtgaggcaggagaattgcttgaacctgggaggtgcaggctgcagtgagccgagatcttgccgttgcactccagcctgggcaacaagagcgaaactccatctcaaaaaaaaaaggaaggaaaaaaaaatatatatatatatgtatataaaaattggtttttgctgtttgttgcggcatcacttgcagttacaaagaagtgaacatagtggttacagattgggttgtaaggctggacctggccgtatgatgggttactaggcacctgttaaaaatagtactgtggaagtggtatatttattggcatgtccatgtgtttacaatatattacaatggtgttactgtaatccccaggagaccagcagcccagctgggactctgagagctctaagatacgtccttggagtaaaccaagctgcaaggaggtctgttcacttctgtattgtttatccactcataaatttgatttacatagctggactttggtgttgtacagttatctcataatgagggttattttaagaagtgtctcaaggaaatgtgtcgtgtgtttactgaggatagcgttgtatgtagtccacaatttcctctttctgggagaaattttgcacatgtatcagaagtctaggagctgtgtttctgatatttgcatcttctttattgtttagatactgtgaatccagcatctaactatagttccttctttgaggtctaggaaacttggaattggattgacaattcccttccaagtgatttcaggttgtatccgactgcgaactttggataccgccttcctgtctcagcttcgtctcctttgtcctaccatgatcttctcttggccccagtttacccagtgaattactttatttttgctattttgtatgtgtttttggaagccacccccagttttttctcttcttttcctgggtggggagttagaagtgttgcagtggatgatggtgctgtggctttttggaggttggtttgcagtagcttttgagttctggtgtgttagtgtcatcttattctaatctagctgcttcctgttgaagtacatcaagacgaagtatatttctaaatttattacgatgaatactctatcaaaagcagctggtgcttaggccctaggtagagctttaagataaagttctttaatatcaatttagaaaaagaaagattcataatgattaatggagctcctgcatcactgaattttactggaataaaaaaaattagtgggcttaaagttacattgaatgtagtggaaattctttttcttatctccattactgttggggaacaatttcatctaaaccccattgaaaactgggccttatagccttcagtatacttcataacatttgttggaaagcaggaaatgaaaacgaagtatttgaagtaaaagttcttaaatgtgtcccaagaaatgaggattactgcagaaagaatggatcagttatttctcgaattataagaaggaaatatctgcagccttttttgtcatcagtgcagcagccccggtttttctgttaatcatagctggtaataatgccctccggtttatagttttgatgagccgggagctaggctgcgtgttttacatataatatctctgttccatcagctgcataacctagatatccttcaccccatttttatgagactcatgggttcttgtctgggaccatgcacctagtaactgacaagattgcaaactagttatgtcacctgtggagttccacgacaaaggcaattctaggcgatgtttatgtagtgttccttgcatgccagggggattctgtgctctttccatgtgtgaatgatagcatccacctgctaactttgttgggagggttcagttatcctctctgtacaggtgagaacaggaggtactgaggacatctggcccaaggatactaccgctggcacggggtggatggtgattcgccctcagtccctctggcgcagcatctgtgctgtttgctgccaggccagctgcatcccagatagagtgacaggatctgttcgcgtcacatccagaaaaggctctgaggccaagctccctgcgttgcttctcactttcactctggaatcagaggtgcgtgcctggaggacttagctctgcatggacagctggtaaggtgtcacagagggtgaggtgggccattgtagcagagagttgttaagagttggttacgtgggttttctcacagggtacaaggctgaggaatgggaaaccagttaggagaccttgctaatagcgtggaccaaagatggggagtaggtccagacagattccgcagtgttcatgcagtgttcatgaagcaggtgtagacagattgcggggccattcatgaaggtgatttgccggggctttttacggatggaaaaccccttttctgtgttcatcccacctcctgttgtcgacagatgacacctgcacaatcaggtcctcccaactccttccaccacccaaagtgaaatacgcaagtcccagagaactgtgtcattcttaccgaagtggctgatgtaggatgttagaaacatctcccaccccaagttgtgacaacctgaaacatccccagacattgctaactgcctcttggagggggcacagtcacccgctgttgggaacacaggcctaaaagcttggagccagggctgactgtctgtgtaggctagaacagaattcccaatgacccatcaccatgacatctgacactcaaaccgcaccccaccccgaccccccacaaccaccaccttttaaaaatttccatttttggaaaaggctggggcttagaagtcattatgaaggcacccatttccagaagggtaagaatcagaaagttggctaattcgggtctctgctttacaggagttccgcagcgtctttcagtagagtgaagctccagtatttgtatgagtgttggggttgtttggtggtgtggggtaatgcaggaggagagaattggggaactgttaaccaccacccaaacaggctatagagaagaatgccaggggactttactgtgatggagacaggagcgttgaagtctgaagagtgacatctgggttctctgtacgttctgatttcttctgctaggatgagtatagaaacatgttctctggggtgaaagtgaagccttgtgaaattcatacaggtgaagctgctgatagcagctcttcccgatggcatgaatatggaggtggcggttgaagcaagtttggtttgtgaatagaaatatacgtgttcatatgtatgtgtgcacgtatgtgtttgtgcatgtgtatgctttaggacccagttcttggattagctgattatttttttccctctctatagacattggtgacctaggttttcagatacttatgtaagtgaatagttgaatttgtttgagcatatttaattgctttcctgaagggatttgctggctgttttgttaaatgaaattgaagacagtactgttgacctttccaggtgaggagggagtcagaagtgttttgcaaatgatggaaactgaaacgtgagtaccaggaccatatgatgttcagaaacttttatcataactacagtgaataaataaagtgcttgacaattagatttaaaattaagcttcatcctcattgcaaaatgtggagacagtgctttgggacatgaggaagagattaattaggattcttttctacctcaagatgcgctatgtcatctctgaacaaaaaactgattggtattacgtgaggattatcttcataaagttcagagttgtatctacggggacagatttgaattgctgttaattgacaatttgctgaattggaaagatcatattaccttaatactttaatgtatcatctttaaatgtgattctttttctttctctcactaaagattagtttcatgccactaaataaaatttaatcttttgctgtaatttaaataataataagtgcttacaaacatattatgcagctgatagcttgttaaaatttcctgtgggcttgttttttgtttagaagtactgattttgccagttgtacaagcatgaaatattgtttatcaagcctcataagacattaaagaggaaatcaagtttgtgtgactttaatgtctctttttctccttatttcagtggctcatacttttaccctgaacttgtaaaatctacaagcttaataagattccatattttataggaactaatggatattcaatgacttgcctgaagagtagactaagaaaatgtatttctccatgaatctttacatagaaaaatgaaagatttttcctgaatatttatttctcaatatatacagcattaatatgtctgtttttcttcaaagcagaaaaaaaaaaaatcagtgattgcctttgggttttgatcttgctctgtatttgttttaagtacacacctattacatgcccactgtattctaggcactaagctctaatgaaaagtggtttccagtcattcgaatggaacaggaggctcatgtactttgaagtgggtatacagaacttttgcactttggttttattctactttctgtctatgtccttggcactagaatgcttggacgacagtttgctatatctgtggtatttatggaatgagtgaaacatgcaaggagaatgccctggctgccgttctggcttctgccctacccagagcatccagtatacagaagcagcgtttcttaccacagcttgcggaaagacacggggagtagtcggcttgccatataaggaagttgccttcagtggccttgttcattttaggtgttttttaatacttgcttctcttataatacatgttactgttccgtgaggaacctcagcagctcccctaaggggaaaaaaggaggagtacttgaaggagtactgtttatacttcaggggcaataaaatccatgtttatgcacaaagggacctttccacttgtgtgataaccattctacaaggcccttgagttcctgtgaggaaggaaggacgccataaggaatgaaatcacagaaccttattatgaaaatagtaatggtgggatttggaaattatactcaattttttcttctgaaaacaaattgaataccacctgagagttggtgctaaaggccctgattttcgtattttaaaaaatttttggcatagtctttggatttgtgctgtcctaatatggtagccaccagctgtacatgagtatttaagcttaactaagattaagtaaaatgtaaaattcagtttgtctcacactagccacattttgagtgctcagtagccacatgtggccagtggataccttattagacaaggaagatgtagtgcagaaagttttattggacagaagaacaatggttattcagatatttccctattgggaattccagggaagaaagggaaaacttaaatctgaagaagaaaaattttataccaagggactagggggcaatgcagaaaaattaaccacatcaaaacaatttactacatcaaagttcattgtcatgacatattagaacattagcataaaggaagtatctatgcacttcccggatttaaaaaagagtcacacgaaggatcttggaatcagaatgacattgtatttcttaacagcaacacgtgaagttagaaaacagactgaacatagacttctttgaaaataattttccctcagaattttgaaggtgttcctccactaattattaattaaggatagaataaagatgtttgggccgggcgtggtggctcatgcctgtaatcccagcactttgggagtctaaggcaggtggatcacttgaggtcaggagttcaagaccagcctggccaacacggtgaaacctcgtctctactgaaaatactttcacatgtcacttctaggaaacttatggagaatatgtcccaccaaagtgagggagtaaaccaagaaagggggaggtttgggatcttggaaacagaaagaggcagaaggaattctcaaacaaaggtgttttcagggcagtggctcttgtagtacagactagagcaggagacaaattttaggaggaggccaggcgagatggctcactcctgtaatcccagcactttgggggggcccaggtggacagatcacaaggtcaagagattgagaccatcctggccaacatggtgaaacctcgtctctactaaaaatacaaaaattagctgggcgtggtggcgcgtgcctgttgtcccagctacttgggaggctgaggcaggagaatcgcttgaacccaggaggtggagcttgccgtgagccaagatcgcgccactgcactccagcctggtgacagagcaagactctgtctcaaaaaaaaaaaaagaaattttaggagaaagtttggtgttagtgtattggtcgaaggtgggagggatgtgggtgggtgttgcgggaggaagggcatggaactgacaaattatccaagagttttgatcatgtaaaaaatgtaatagattgttggagagtgtgggaaggattatcaaagagtacaaagaaaactgaaatgaaaacagaggcaaataataattctaggagaacacaaaaagtatactaaaaaaaaatcataggctgggtgcggtggctcacgcctgtaatcccagcactttgggaggccgaggcgggcgggtcacgaggtcaggagatcgagaccatcctggctaacacggtgaaaccccgtctctactaaaaatacaaaaaaaattagccgggcgtggtgttgggcacctgtagtcccagctactcgggaggctgaagcaggagaatggcgtgaacccgggaggtggagcttgcagtgagccaagatggcgccactgcactccagcctgggtggcagagcgagactccgtctcaaaaaaaaaaaaaaaaaaaaaatcataatcatactatattgcccactcagcagtgcccattccattgtcaaagtaatatatgtgaaatattgatttagctgaaaaaaaaagttatatgagctatcgaaaacgtggaagggtcagtgtaagattggtggtgggaatgtaaaaaaccaacaatccttacctatgtgtgtgaaaatcagtaagtgatatctaaacttgatgtattgattagagtatcacaaacagactatttagaaacatggaagtctggccaggcatggtggcttatgcctgtaattacaacacttcgggaggccgaagcgggaacgtcactagagccccggtgtttgagaccagcctgggcagcatagcgtgaccctttctctaccaaaaaatttaaagcattagccaggcatggtggtgtgctcctgtggtcccagccactggagaggctgagacaggaggatcacttgagtcctggaggtcaaggctgcagtgagtcgtgatggtgccactgcactccagcctgggtgacagtgagaccctgtcccaaaaacaaaaaacaaaaacaacaacaaaaaaacaaacttggaagtcactatgcagggaacagcaccaataacagaaacagctccaagaaagtggttgctttgggaagtggaattggtgatagatggtgctaaaaggcatgtaattaataaaaggagccttttgcctcacctgcattttaaaaaaaattttgtacatgtattactttgtaaagactaaaagtggtttggaaagtgaaagtataggatatactatctgtataattacagacattttggcatagttaaaagcagggtttcacaaccttggcattgattgacgtttgtgtcaaataattctctttgttaagaggacctgtcctgtgtgttgtgggatgttccgcagcatctctggcctccacccactggatgccagtggcattcctccgccagtcctgacaaataacagtatctctagacattgcccaatgtttcctgggggtcaaaattacctgtaagaaccacttgttttgaaggatttttaaatatgtcattgaataaacctcaatatataaccctgctgtttgatattggtaatacaggaaacaccagcttccttacacagaccttgaaccctggagcaaatgaagcggtttggaatcctctggcactggaacacccgcaatgctcatgctggtgcatgtattagtcagcgtctggctcttggcccggttaattcagagctcactaaaaacagaaaagggatcaggaggaaactgcagcttctctgtcatgcttagtggcttctgaaaacatattttagatttttcatgttgctttcatgatggtacaacttgaatttctctggagttgaaatgttaatcattatggcaaaaatattgcaccctttggatgcattccagtgctcaggtggctgcggacagatcctctctgtctctctgcttccctccacaattcttttgcaagttcttagttaagttattgtcaagtgtttttccctagaattgacacaggaagtcaacaggaaaatggtatctcagattttttgatgtggatgaaacctcataaatagtttaaaaccctcatttcacagctgaggaaactctggtgcagagagggttttttacaattaattgggagcacaatggggcctggaactctgttcttctgttttactctttccttttaaaatacaacatgtgtgcccagtaatgctggaggaggatgatagaacgggctggggaagggctagggcatctggcgggtcatgggagtttgtcaggattttcgcactgttagaagttctcagcatcctctgccaggggcgtgtacccttagtaagcttagagaaaatggcacagagaggcaggaagtgtagtttccatgatctttccaggaggtgctcctgtacctcagttcctgatggcccagaactgggtggagagtgtaggctggtgcattggcgtgtctgacagggaagaccctggcctccttatcttgcagctcttgctaccagggcactcatggagccagcgtgcaccgccactgcagctgttcttgaagaagtggccagaagagtgaaattggcccgttgaggaagggtgtggagctgcttctctgtgggtccctgcatgacttccctgttccttcccctgggatcaaccttcctcaccccacatggttcagcagatgagggttaagtctgccccagcttgggggacgctggtgtcccactcaaaccggttgtccagtattttggtgctgcaccaggagagtgccatctgcagtctgcagggctgtcttgcccaggtggccccttcttccctcggatggatggggcatactgttctgaccaccatgtctccttccaggccacatcctctttcgtgagcactgtgagggcatcaccccacatttttagaaacctcagcgccccatcttgcccccatcccttgcctttggcaccacttaaactacagcctcattctcttcctcctcgcctgagttctccagccaactcaagtgccacctcctccatgaagcccctgtaggtttcctccactgggacaaggacgcgcagagatgaaaggcagagaagtccagccctgggacttccaggccgtcagttcaatcctttgagcctctgtctcctcctctgtgcagtggggcagttcagtgctcccccttagtgctgtggcacgctgcgttgattggcctgggtgctgttgcggatgcccagcgagttctctgtctccctcctggttcttgtcccactccctgctccctgttacagcctggaagtggttggacggtttcccctgggagtcttgagaacccccaaagacgccatgcatcttcttgtcctcttttcgtggcatgttctgtgttgtgtgtgtgtgtctgtgcaacgtgctgtggcattatgtgtgtctgtgtttgtggcgtgttgtgttgcatgtgtctgtctgtactgtgtgtgttgtgtgtgttgtgtgtctctggcgggctgtgtatgttgtgtgtgtctgtgcacgtgctgtgcggcatgctgtgtatgttgtatatgtctctggtgggctgtgtatgttgtgtgtggctgtgtattttgtgtgtctgtgtggctatatgcggcgtgctgtgcatgtcgtgtctatctgcaccgtggtttgtgtgttgtgtctatctgcgtggtgtactgtgtgtgttgtgtctatctgtgcagtgtgtctgtgtggtgtgctctgtgtatgttgtgtctatctgtgcagtgtgctgtgtgtgtgtgtgtgtggtgtgctgtatgtctgtctgtgcaaggtgctatgtgtatgtcgtgtctgtgcagtgtgctgtgtgtgtgtctgatgtgctgtgtgtgttgtgtctatctgcagtgtgctgtgtgtgtgtctgtgttgtgtgctgtttgtgttgtctctatctgtgcagtgtgctgtgtgtatgtctgtctggtgtgctctctgtatgttgtgtctatctgtgcagtgtgctgtgcgtggctgtgtggtgtgctatgtgtgttgtgtccgtctgtgcaccttgctgtgcatgttgtctatctgtgcaccttgctgtttgtgttgtgtctctctgcacggtgcactgtgtgtgttgtgtctatctgtgcagtgtgctctgtgcggtgtgctgtgtgtgtgtctgtgcagtgtgctctttgtgtgtgtgtggtgtgctgtatgtgtgtgtctatctgtgctgtgtgtgtctggtgtgctgtgtgtgtgtctctgcagtgtactgtgtgtgtgtggagtgctgtgtgcgttgtgtctatctgcagtgtgctgtgtgtgtggtatgctatgtgtgttgtgtctatctgtgcagtgtactgtgtgtgtgtgatgtgctgtctttgtggtgtctgcagtgtgctgtgtgtgtgtggtgtgctgtgtgtgtgtctatctgtgcagtatctgtgcaatgtgttgtgtgtgtgtggtgtgctgtgtgtgttgtgtctatctgtgcagtgtgctgtgtgtgtgtgtgtggtgtgctgtgtgtgcacgtgtgtggtgtgctgtgtgtctgtgtggtgtactgtgtgtgtgtctatttgtgtaccgtgctgtgtgtgtgttacatgtcctgagctcacgccttctgttttcacatttgactgtgattactgtcctttttgagatctgagtaacagggacagggctgggcccgatgacttaggcctgtagtcccagcacttgaggatcatttgagcccaggagttggaggctgcagtgagctgtgatcgcgccactgcactccagcctaggtgacagagtgagaccctggctcaagaaacaagaccaaacgaaacaggaatgggtggccagttctgccacttcctttttatttgtgaaatctaagcacatacataatccaggtagttgtcacggaaaggggccataactcaagagaagtggtgccctggagcctaaaggctttcccattaggataaattagaactggaaattgtcataaagacaatgcagggtttgtggatttcagctggatgagtaaagaccagcctgggcgtgaaggattttcatagtcagttgctaaaggtggtgccccaggaaggctatttggcaggcgtggggcgcagtcctggcatggggtgggatggggctggaggtgctgctaatctatcttattaaaacccaggaagtttcacaggcgccttccaaaccacagctcgttgatttaaagatgtgaattccacgtgtgtaagccaacagaacaattgcgttttgtggtctctggctgatgaaaagtccctgatgaagtgctgtttggtaaaacgattcctctccattttcctcccttccaatctgtggttcacatttattcaacgttcttttctttcaaacagcatttgtgtgtagccaacacacatgcatatggagtgctgcgaagtctctgtgcattatctggaaacctgctttctccagaaaagctgactatccacttcccgtgctctcaagcccaagagacaggaatgggacgtggggagcgcgtaccctcttctcaacaagcaggttgaaaatccagtgaatttctttatgatggaatttgaatcacgtggacattcattagaatatttgggcaggattaagcccttaaaactggctctagattatggttataaaatggcctcaaaggaccctgaaactaatgaaagaattcttccatttctgacatgcttcactccctctggctctggctcttatcccaaatcaaagaatgttggtttttttagtgtttcctttataaacaaggatggtttccagattttttttttctttttgtttttttttttttttttgagatggagtcttgctctgtcacccaggctggagtgcagtggcgccatctcggctcactgcaagctctgccttctgggttcacaccattctcctgcctcagcctcccaagtagctgggactacaggcccccgccaccatgcccagctaattttttgtagttttagtagagacggggtttcaccatgtcagccaggatggtctagatctcctgacctcgtgatctgcccgcctcggcctcccaaagtgctcggattacaggcgtgagccaccgcgcccggcccaaagtgactcttatactccattataattatgaatttggaaaacaataaggatattatatgagtctgctcaggctgctgtaaccaaagaccacaggctgtgtggcttaaacaatagaaatttcttttctcacaattctggaggctggaagtccaagatcaaggtgccaggaaactcagtttctggggaggcctctcctcctggcttgcagatggccgccttcttgctgtgtcctcacacggcctttcctcggagcgtctgtgtatgggtggggtggaggggcaagcagagagcttgcacacttcgacaatatgaccatctatcataggcatcaatttagtttaacttcatttcatttacagggtgttaaaaaggaaaatcatctgcataatttgagctttttcatagtgagttctgaatctaatttattttgagttattacagaagtctgcggatatcccaccttaagatagccatatgcacaattagtcatttcttaagggatcccccaatgtgaaaagaattccccgagaaaagacgacctgaaagatcttggcctttacataagtgtacacagaattatttttattgtgataaaatatacataacataaaacttactatcttacacagtttaactgtacagtttagtggcattaagtacactcacgttactgtgcaggcatcatcaccatccttctctaggactttcccagctttccaagctgaaactctgtcctcattaaacatgagctttccattccttctctccccaccaaccacctggcacccactgttctactttctgtctctgtgaacttgatgactctggatacctcccgtaagtggaatcctacaggatttgtcccttttgtaactggcttatttcacttggtagaatgtcctcaagattcatctgtattgtagcatgtgacataatttccttcctttttaaagctgaataatattcccttgtgtgtatagaccacattttgtttatccattcatgcatcgatggacagttgggttgtttacaaggaattattttaaagccgaatccagggtggctggcttgtgactactatttagatgcagacagtgattccaggtggtgcgtggtgaaatcatgtcacacccccgcggaaaactccacagctttcctcatgtgccctttccatcacttctctgctgctttaggaactacttttcttctgaggtgacctctttctgttcctttcagtttttaaaggaaagaatagtagaagtattaaaagcagcagcagaagtccacatgttaaccctgtgccagcccacatccccttgtgatctctggcagtggggtctcttctgctagcttctcccgagcttcctgccaaaaccctgtagccggccttcgccatgtccctgaatttgcttttctttttccaccctctacaaccttcctttcctgcagaagtataaactttcaatccgtgtgtataaactttggggacacttcgcaatcagcatgatgaagttttatttttatgtgaaaactcttgatgattctgaaattgtggtgtctgtaacttaaacatcatctacaaaatcactgctctatctttggatgtgagtttgttctagcatgttatcacagtaccgaattccaaagaaactgctgtttacttaccaagggtaggctttcaactcagatgagtttatgactttatttacatggaatagtcaaaatggacttctgacatttgctgcaaagtaggacaacttaattgatattgatggatctactcatttattcagcagataacaaagcccttccgattgcaggtgttgtggagagagcaggatattcatttgctagggttgccataacaaagtttgatttgatttttggttggggatggaaactgtgtaggaggcaagcgtggagcttgatgtgagctccttgaaataatgaaaaaccagttacaaaatctgtattacctgtagcagtacacattctcccaaagcattctgttggcattttaaagtcctttaaaacacacagctgctttctgttgcttcaaactaaataaggcattatcttcacttttccttttgttaacctaaagaaaaaccttcatttgtaaagcaaatcatcacagcaggaggattttctggtttatgcactagggtgcatttaatctttattttacactgctgattaactttatgattcaaattttaacttatagtttctttttaaattaattacattattgggtgctttcatgtttttgctaaaagccttcctattagaagcactacaattgacagtgatggactgacctttaatatttttttgttatgtgaccagtgtttggtttataaaaatttttctctaaaacaccaacttttggctgcaaataccaccttttcacttgggttcttttcatagtgtttatttacatgggatattgtcactttgcacgctgtagctatttgtctttgtcagcaaatgtaggtaaaatattaatcttgtatgaaattcagataagcagggaacagatggatttatggtgcttgaaacctctgaactctgcagctgtggcaagttgttgaactgtaaataaattctggacggtggctagcaggggctggcgtgacctcatttgccccacaatacctcaccgtgccagggatgcatttcctgccctgtgccacctgtggtttggtcctagtgctttggggccgcagagtggagctgggctccctttgaggaagtcatcagtgctgagagccctcctcacgggtgagagtccagtgggatgtgtctgagcagcctacgctgggcatgggccggggcacgctgtgtcccaagcatgctttaggggtcccagtggcaaaagcacatttgtggttgtttaatctctggaggtggaggatagccccagctcctgggtcagtcagctggcggaacagggtaggccaggggagacagcactccaccctgctgggcatcttattaaatgcagcccagtatattcaatgccggcatcactacttcatgggaaaggatgcagcgcttacagcaggtagtggggtagagtggctgtgtggggattttcaaaatggaggctaaagtgatgcactttggactcgctggaaagtgcctggacctctggtgagttcagcctgggaggtcagagcaccacaaaatttgcttgctgtggctgggtgcagtggctcacatctgtagtcctagcaggagctcagtagtccaagctcaggagtccgagaccagcctgggcaacatcctgtctccaccaaaacaaaaccaaaaacaaaaccaaactggcttggtgtggtagtgtgtgcctgtagtcccagctactcaggaggctgaggcaggaggattgcttgagcctaagagttcgaggctacaagtgagccatgatcataccactgcacttgagcctgggtgacagagtgagaccctgtctcaaatgaaaaaaaaaaaaaaaaaaaaaaaaagtacttgttgcctggccacaggaaggtctgtgtgttggtttgtttaccttcccgaacctttgctggggagactttttatgcccccatatgccccagattcactaacaagaaggaagtgttctgttctgtgtaggatgtgcagaaacagccttgaaaatgttaccaatcaccgaccttctgaaacgagcttctgtggatactgggaaagcactgggacaccattcccctcactcctgcctctgcttccccagggtggaactggcctgtgcttgatggtgccagctgtcataaagaagtcattgagcatccctgcatttgcactgtgtacccagcaccatggagggatagccactttagccaaagcagtttttcagctttactgagatgtaatttacataccttcagactccctccgagggtgtttttttgtgtattcgcagagttgtgcaatcatcactatctgagtttagaacatgttcagtaccccatgcccactgtattagtctgttttcacgctgctataaggaactacctgagactgggtaatttataaagaaaagaggttgaattgactcccagttctgcatggctggggaggcctcaggaaacttgcagtcatggcagaaggcgaagaggaggcaagacacatcttaccacagcaaggcaggagagagagtgagaggggaagcgccatacttctaaaccattagatctcgtgagaactcactcgccatcacaagaacagcatgggggaaacccgcccccatgacccaatcacctccaccaggtccctcccctgacgtgtggggattacagttcgacatgagatttgggtggggattcagagccaaaccatatcacccatcagcagtcacttcccattcttccctccctgtcccaaccggtgcaaccagcaatttactttctgcccctatgcatttccctattctgacatttcaggtaaatactcacaacatagggacttttgtgttctcatttcactgagcattgtgttttcagggttcactcatgttgtcccctgtgtcggtgcttcgttccttttcatagccagattatactatctgttcatcagttggcgggcgtttgggctgcctccactgtttggcgattgtgaatagtgttgttgtgaacatttaagcacacgtttttgtgtggatgtatgcaaagtcattttttttgaaagccacttactacacgattggctaacttccatcagagaaatgttgtttggtggagttaaaaacagattatctgtgtactatattaagttgggtgaggaatgatgaagtgtaaattatacttacataaatattataatgctgtgcagaaactcttaagctatcattcttttagaaaatgaattttatgagcttgggacctttttgttaaccaatctgagaaaagtctgttgtcagtgtggacatattttacctttaaatggaggaggggagagaatctttcaaaaacattaatatcagtgagattaatactaatctgtcaagatgacccagtgaacagttggctatcaaagtattataagaaggtttttaaaaggaaagtgtctattttgtaaagatcttgagtaaattatgcttttaagtatgttttgatattcccccccctcctcccaaagtgtagcatgcctgagcgctgtcatgtttaggaggtgatgggttggggttagagggtgattgactgttagcgaagtgggttgggatgaacaagtgcacttgagtacgcgctgcacagtgtaggcatcaggccacgtcagtgtgtctctgcatttgggcagatgccaggcctattgcaggcagcataacatctaggaacgggtttatggatgaacctgggtaactctgggagcacaaacccagaccacacccatcgggagagattgacctgagtgatgcgctaacgcatatcattgagatggggccagatatcttgcttagatgaataattggagttcatgtcaaccatctgtcctttcccataatttaaagccaacttctatattttccaggttcatactttttttttcattaattgcatgtaaagttgcggtgaacaccttctttcttgacttcctgtttaaaaaaattacagttcttaaaattataagcttattcaggatggagtggtcagtttgtagaaaaactagctctttagatcttttaaaagcactacattaaaaaaaaaaaaaaaaaaaaacatcggacgtggtgggtcacacctgtaatcccagcactttgggagtccaaggtgggaggatcgcttgagcccaggagtttgagaccagcctgggcaacatggtgaggccccatttctacataaaattttaaaaattagccgggagtggtggagtgcacctgtagtcttagctacttgggaggctgaggtgggagggttgcttgagcctgggagttcaaggttgcagtaagccgtaattgcaccattgcactccatcctggatgacagagcgagactctgcctcaaaaaacaaacaaacaaaaacaaacccagagaaactcaaaaaccaaaaaagaggtatccttattttcccaggcctcaatgatgaaatgtgcccagtgttcatttgaatctgcccatcaattagtcttttcctgatgtctcagagaagcatgcatgatgtacggaatgtcttgggtgacctagagcggcatccccaataggactgccctgtgaacatggccccacattcggctcttgggcacttaaaagatgtggccattgtgactgagaaactgaattgtgaatgttatttaattttcacgtgtttaagatgtggccagagcagacagatgaacagtctggcttgatggataactgcagggagtttcacgatgctggtaggaggcacagtgagcttctggaagagccggccccacctaggcctgattttggtggctgctcaaaaccgctggtactgaattcctttagaatagtgcttctcaaagcgggtgactttgtatcctccccaccctccaggggccatctcacaatgtctggagacatttttggtggtgacagtgggtgcttctggcatctggtgagtagaggccagggacactgctcaacatcccacagtgcacaggacggcctcataacaaggaatcatctagccccatatgcgccacgatggaggagccctgctttctattccgaagaccagcagtcctaagatacgatgtggacagcacagacccagttttctaagtgaagagataaggcttgagcaggcagcagcctggtaatgccaaggccaggacagttagccaagtgtctgagtccatggagcttctcgggcagtgttctcttttctcttcagctattccagtttgtattaagtgtaagaatatgaagttgatgtttgtcgtgagtcaagacggtgacacagaagcagtctttcgtgctttggtctaatagctttattgttaaaggagagaaacagaaaactcctctttgcctctgcagttttctctgaaattgaatttagggaaagctgaccctagaccatgcgtgccctttccaccagcatcgctgtgggttccactcgtgggagatcgataaggaagtggggatgaccacgctgcacagaagtgttctcatcacttttgcgcttgcttatttaacccatgattgttagaaagcgtttagaaagttggtctttgcaaaccagccctgttaagtgctgagatgaaattcttaactttttttttccttcttagagataaggcctcactctgtctcccacgctggagtgcagtggcgcaatcaaagctgactgcagcctccacctcctggactcaagcagtccccccacctcagcctcccaaattcttaaaaatgctaacagtaaccctcacacacaaaaagtgctgccgttagagatggcactggtattgagaagcacgtgctgtcagtgttgcaattggtaatgcacaccacacttgggcatagaaattggaaatccaactgcgccaagctggagcctgcagaaaggagcacgaggagacgggacagcaatagagctctgtcgacggcgctaagtagaaccagacgctgcaataagacaagcgtccccctgtgctcagtacaaatgggttgcctgtggcagatgcaggggtggctttggcagagagacggctcctggcatcgtggaattgaattggctgtttcttttaaagatactgcaaattgcggcagcatttatcatcctaaggaagcccgcacagcttgccaaacagataatattgatgatgataacaacaatgataaaaggaaaccatgatgcctctactcaatgaaaatcacttttatcttatttgcaaaagtcagaggtaggacagatgtgtcagcgtcttaataagacagttattcaaggagttaaattgaaattattcacatacccaaaataagctatttggcaaacctggagacccaggggcctttggatctatcttagtgtaaaatttcttgaagcagagacctagtaggtactctgttgcttatggttccaggcaatgtattgttttttcttccccctaaatatctgtgaatgtgtgaagtaccctgtgtgccagagatggaaagtaaaaccacagaagcggggtgcggggagatggcagctaaattccttttcagcagagttgaagcatcttgttgtaagagtctagctccacaacagtgggatgcaggaaactgtaacagctgaaatacccaacagatgtattcaccatcagtgcattgggaaaccctctcaaaagtgtcatcacaaatgatgatcttaacttttgtatgacaggatctttaggtcacccaacagtaggtgcacagtttctatgatttcaatttttaccacttctggagacttgtcttcccatttcttgtatcagtgccttactgatagagttggaaattggaaccaaagtaattagattggctctccagatctcttacatgagccaagaaaggattcaaaagcatgccctgtttccttcttgacaggctgggagaggaagtgaccgggaagtgaattgctaagatgtggtcgtcattttcctttacaccacagagcctctgcgtttgggaactgcaggttcatccgagtcaatgtcagaagtgccttgtgtctactgtagtgaacatcctttgtttccatcgggtcctgtgggaagcagcactgcttattgggtggtttgagggtgaatgctattttacaacttgtgacccccttgacacactaccttttcattttagcatggagcacagagccatttctcccctgtgctggattttgaatgttctttcaaccaccgtgatagaatgtccaagaaaggaacaaaggaagaggcaactaagggaatctttcagtgggttcataagccatgctgctcctggctttgacaggagttaaaatcatgggtatccctaaaccactatcattattggagttgctgttactgtcgacgtaaagagtcaaactctgtaaaatatttgaagagatttattctgagccaactctgagtggccatggcctgtgacacagccctcaggagatcctgagtacatgtgcccaaggtggtgggggcacaacttggttttatacattttagggagaacacagcttggttttatatgtgaacccccaaaatctgagacgggtctcaatcaatttaggaagtttattttgccaaagttaaggatgcgcacccatgacacaacctcaggaggtcctgacgatgtgcccaaggtggtccaagcacagcttggttttatacattttagggagacatgaaacatcaatcagtatatgtaggatgaacattggtttggtctggaaaggcgggacaactcaaagtggggagggggctcccaggtcataggtagacaagggacaaatagttgtattcttacgagtttctgattagcgtctccaaaggaggccatcagatatgcatctatatcagtgagcagaggcctgtcgttgaatagaaggggaggcaggtttgctctgagcagttcccagctggattttccctttaacttagtgatttgggagccccaagatttattttcctttcacatacacatttgagggagacatgaggcattgatcagacacatttaaggtagacattggttcagtccagaaaggtgggacaacttgaagcaagggtgcagggggaagggggggtgctttcaggttataggtagatttaaaatttttttgataggccattggttgaaagagtcattaccaatagaaaggaatgtctgggctaccttaagaggttgtggtgaccagtgttttatcctgcagatgtagcctccaggtagcaggcttcagagggaacagattgtaaatgtttcttatcagacttgaggtctgtgatgatgttcgtgctggaggggcttaatgaggcatgcttgacccccacttcccggcagtcatggcctggtccgtctttcaggataaatttagttggccttggcccagaggaggaagtccattcaggtgcttggggggctttcgaatgttattgttggtttacattatgattgtcattgttattaaaaaactaagggctgtagagaaatggttgcagcatccatcatgtgtccctaggaattgcacatagctaagtgagaacctcacagaaccctttcacgtgcagcccgatgctgtcactgttcataaacaattgtattttgccttcctgaaaggccatctgagttcattaaacttgcatgcttccatatctatacattcttttctcatggcctctttgtggatggtttgttttaccatttgttgtccatcagcttgaatggtagggggaagagttcacaccgtgccccctgtgtagcagaatagcccacagttcaggcatggctctccagcaaggagctttctagggctctgatgctcaccagtggggggattgggcacccctccgcaactgccaggggacattgacaatgtctggagacattttgggttgtctcagtagctgtgtgggggatgctgttggctagtgggtggagccctgggatgctgctaacatcccaccatgcacagtacagccccaacagccaagagtgatggctcacaaatgccaacataagaaacccattctagggtacctttcatttgcttagtgctgcgagaaggtttatctgccaaagatcatcatcttggagagggccaagatcctgtatcctgtactggacagatatgcaggcattcaaattctgaaacgccgttggaaacatgaggctcggatcacagaagcctcctgtacatagagcaaatgagagctggaggcctgctgcccagcccagctgagtcctgtttcttatttcggttttcctttagattccaccgaagtttctctgaagaatgctgactcaggctgccccttttattccatttctttgcagggcagtttaggtgaagctggaacacagtgttccctgaggaagcattaggacaattagaccctgcctttgctaaatgaatgtatcaagaaccttcaacgtctttacaagaagcaggataaccattttgcagagtactgtgcttagtagcagagcatggcttctgttacacagtttcagtattgcaaaggtccccagccagtacagtcccacccttaattactgcttcagagctgcaagttaacgtttaaagtgttttcacagtagcttgaagtgtgatctcccatattacggtcatatccttggacttagcccatgttacataaattagatctttataagcagcacacttctttgcaagcaatttgcttccctttgggaatctgattccatagaaaacagtagtattttaaacatgttgattctagtacttacagttctattcacgtgctcctggtatagtacatctaataagaaagaatcccttatttttacttttatccaaatgcatgtatgttctttcagcatgagatataatttgtctgatcaagtatatagggagatgagattaagaattaagatttgtttcaagatatgagattaagaattaagatttatttcaagaaactcaattgcatggttgctcgcataagccactatgcagtggcagctttaatgaatggggttccaatgttttccttactgttttcaagaaggtagtgaataaaattagatgttaaagcgaattgcattgtgtgaagattgggacagatgccacatatatagttcagatgcttgcctgccagtccctgagatatactcttagcttgttaatatggaaattgtcaaacatattcagaagtatacagaatatcttggtatattcctgtgtattcttcactcatctccagccactgttagcgtgtcacgagcttgtctcatcgtcccctcactgttttctctttagagtaatttaaagcagatctcagacatcatgtgatttttacctataaacatttcaagttgtatccctaatatagaaggatttttttatgatactattattctgtaattgtttcctgtttgccttaacgaaaagaccacagactaggtggcttaaaatagcagagatgtattgtgtcattgttgaggaggtcagcagggtggtcaggcggcagcagggtggcttccttttggaggctccaagggagagccccttctgtgtctgtcctccaggttctggtgcctgcaggtgccccttggcctgtggctgcataacgccaatctctgtctgttaggaggacactgtgtttagagcccatgcaataacccagaatacctcatctcaggattcttaatttaattacatctgcagtgacccttttttcccaaatgaggtcacattcagtcttttactatataaggtcatattcacagagtccagggatcaggttgtgtacttaatcctgtttctttcgtgctcatgggaatgtatgagttaggggaatacagattatctttgtgttgtagggttttcttaagattatgatttattgaaaaagaaggtcaatggcatataaaggaaaatgtcattgataaatataaaaagaaatgcaagttttttaggccaagcagaatgcttataggagccagtgtcttggattaaaattatatgtgaacctcaagtgttatcatctataaagtgaaggtagccgtgaattacctcttagattgttgtgaagataaaaatgaatacagcattaacacagtatataaatgctaagcatttagtaattatagttcgcctctttttttctggaggctcaaagttgattgtaaatgtcaaaccaagaaataatactaggtactagcaacacataatgcaaaggaatgattcctgtgatacatgaagaactcctataaagtactaaggaggatgaccagcagcaggccatgagaaaaatgaaaaaagacatgaacagttttcttaaagggaaataatgaatagctctaaaatgtatggaatgaagctcaatctccctcatgacatggggaatgcagatgaaaagtgtaaggtaccatttcacctttcccattagtagaggtcagaggtgtgactgtgttccgctggcaggagctcaaataaaagcgggtgttgttgctggcaggcattgcaagaggtccagcctctttggggagcagattggcaaaagatatctgacctagaattgtcacttcttgggatttagctcatggacatagtgtaaatatatgcaaagaagtactcacatgatattcaccaaaggcattgtaaaagcagaaggatgaaagcaaccacccacagtgaacgtgttagattataataaaggcatagaatctatcaaacaataggaaaaaaagcataattctgtatatggaatgaactccacatgacgctcttgcatgtaaaaagcaagacagatacctgattgtgagtagagtttaatacaagttctatgtcaaagtgggaggagctatatgggctggtctaggtagaatatttctggaaggaaataccaaaaattggacttccctgttggggagaggtggattttagagatggggtagtagcagcttctcaaaaaccaagagaaagcttcgcatttacaatgggattattggaagcaataggaaacacccatttttgtaaaatctgtgagaatgtgtatacttggtaaaagtatagatattcagccattaaaaggaatgaagtattcatatatgctacattgtgagaattgaggatatgctacattgaaagaaaccagccacaaaagactgtataaggttccatttgtggaaaatactcagaaaaccttgggggaggaggggacaggaagtgtctgtttagtgggtattagatctcctttggaggagaggaaaatgttttggaattagatacagaggtggcggtgattgtataacattgtgaatgcccccaaatgccactaaattgtacacttgaaaatggttaattttatgtcgtgaatgttacttcaatttttaaaaaaatccaactgcaaggagagaagattctctagggaatggcttgtcaaagcatccatgtcaaagggaccatttaaaaatttccagtctgaggtgggtgcctttgtgaaaagcaattaaaatgtataactagaagagcaatcatgtctcagacaccaacgcaagcacaacttgccctaagttttctaagcacttcttacctcattcattcatcaccagagacagacagttcccaggccagaatccgcacctggatgcaacttttaatacatggatctagagttgtgttcttccagctctagaagagctccatgccacccccctcccctcccccccccgccacagcttgtcagaaatgcagatcacaggccgtctctaggtctgctgaatgagaatttgcattttagtaagctgcctaggcagctcagaagcacattaaagtttgagagggtaatttggggacagtaaagtgcagtcggaggaggatggttttgtggccctttggactggtcacttaatgactgtgaccctgggcaagggactgggttcgttccctaggctcctgtaacagagtgccacagactggtggcttaccgtatagaaacaaatgctctgcagctccagaggccacaggtctgaaactgtggtgttgtggggttggcacctgttccaggcctctcttcttggcttgtagaaggctgtcttcatgttcacatgaccttctgcctatgtgcagttctgtatccaaattccccaccttaatgacatcatcttcactaattacatgtacggcgaccttatgtccaagtcaggtcacattctgaggtactgggcgctaggactttaacatgtgaattttaggggaacacagttgaacccgtagcagtacttaacctttctaatcctcaatttcgtcatcttaaaaatgagtaaactacacattaatgtgggtaccatcaaaaaaacaaaaaaaccaacccaaaaaatagtaagtgttggcagggatgtggagaaattggaactcttatgcactattggaaggatcataaacaggtaaacactatagactatagttcagcagtttcttaaaactagaattatcagatgatccagcaaatccacttttgggtatacatccaaaagaattgaaatcagaatctcaaagagacacttacacactcaggtttagagcagcgttatttatattaaccaagaggtggaaacagcccacatgtccctcagcagatgactggataaacaaaatgtggcctgtccacacaatggaatagtattcggccttgaaaaggaaggaaatcctatcacatgccgcaattttgtatgaaacttgtggacattatgttaagtgaaataagccagtcacagaagagaaatactgtataatcccactttcatgaggtatctaaagtacacaaattcgtagagacagaaagtagaatggcagttgccaggggctgggggaggtgaaatggggaattgttgaatgggcatagagttggagttttgcaagataaagagagttctggagattggttgcacagcattgtgaatttaacactgttgaactgtgtacttaaaaatggttaagaggctggatgttttgggtcacacctgtagttccagggctatgggaggctcaggtgggaggatggcttgaggccaggaattcaagaccagcctgggcaacatagtgagaccccatcttttacaaaaaattaaaattagccaggcatggtactgcatgcctttagtcccagctacttgagaggctaaggcaggaggatcgtttgagcccaggaggtcaaggctgcagtgagctatgatcacacagttgcactccagcctgggtgacagagcaagattctatctcaaaaaaataaataaataaaagatggagaggagcgttacttttttgtgtgcaggaacgattgctgactgcagagcctggctggctaaaattagatttgccttgtcagtataataattgtaggtatttttggagggaaggatgcctggagcccggctgggttatttccgcccttggagtgagccagggcagcttagagggctacccgcgtgcagccctggaaggtaccgaaggagccctggaggcaccgagcgctggaggcctcatccctgagcaggttgccctccttctggtcggatggcagggcggaaacccatctgtgtcgggagtgagagctgtctgctgtccgcggcttgcgcttggagcttttcctgcagtccagggagagcagaggaggccagtgacttccatgaaaacacccccagtggtggggagggaggcggcatcccttggaggtagggatggggcccctgctgtgacccattagaggcaaagaagggcttggaagtttcattttgtcttacatgagtgtgtgtgccgagttcacattatttgcacatctgtgtttgtttttatataatgataaggacatcagtttccattgataaactataaggaagatgtgccatgtttaccagggccagagtgaagagactgaggtgcttgctttgggagaaaaatttgagggggtgacaaacaccacagacatcaagataaattatctgtgtgtattttaatagctttattgagatgctgtgcacagccatacaattcacgcatttgcagtgcacagttcagaggtttttactatatccacagaggcgtgcacccgtcaccacagcccagtttagaacattttcatcacctggggaagaaacacccacccagtggcagtcacttcccaccccacccccacccctgccaccgtgcattctgctttctgtagatgaatgcgtttgtctactctaggaacctcatacaagcagagtcatacagtgtctgtccttctgtgtctgacttctttcactctgcgtgtgttcctggttcattcatgtggtagcacgtgccagacattcctttctgttacacagtactgtatgtattatatatgtacacagccggctgttcatatccacgagttctgcttctatgaattcaaccaaccgtggattgaaagtatttgggaaaaataataatgcaacaataaaaaaatacaagtttaaaaacaaatagagcataacagatatttacatgacattgacattgtattgggtatgatacataatccagaggtgatttaaagtgtaagggaggatgagcggttatatgcagatgctactcccttttatctaagggactggaggatactcggattttggtatctgcaggggtcctggacccatcccctgtggatgctcaggggcggctgcaccacatttgatctatgtgttcatctgtcagtagatgtttgggttgtttccattcattttttggctaagtgaataatattttaatgtgatatttaaaaaattaaaatgaatgcaagaaattccatgaggaacaaaatattaattttaagtaaagaccacaggatcagtatttctgaagtttccttttgcctcaggatccagtatggctccatacattactgatcctgtctctctctctaacattttgatattttgtcatgtactttttgcattcattttgattttttttttttctttttgagacagagtctctgttgcccaggctggagtgcagtgatgcgatctcggctcactgcaaccaccgctttccaggttcaagcattctcctgcctcagtctcctgagtagctgggattacaggcacacaccaccacgcccggctaatttttgtatttttagtagagactgggttttaccatgttggccaggctggtcccaaactcctgacttcaggtgatccacctgcctcgacctcccaaagtgctgggattacaggtgtgagccactgcgcccgtcctcattttgatttttaaagataatgtattacactattgtttcttttgatggttgaattttctggcatccccttcaattttgcaccagaggtaagtgatcctaatccctgccctgacattttacactgtgctgtgaataccccagggcatcatgaggaataaaatttgaaagtgtatttcagtgagctaacttggctggacagaatacccatgggttatccttaccagtggtgccatatttatgcctttcagcagtgttgtgattaaactcaggtccagtaaaattatcattatactatattagttttgtagaacttctgtaacaaatttccacaaactgaatggcttggcttaaaacaccagaagtatatcctctcacggttctggagtccagaagtccaaagtcaagatgggggcagggttgtttgcgtctggagcctctacaggaggatccttcctgcctcctccagctcttggtggcgccaggctccagttcccttgtagatgctacaagggaactcttgtttatagtcgggatagaaattacacaaaacccggtcttgattggggataccttttggagtactggcaagttgccgcatggactgagccttccgatcggagtttgctgtcttgctggtgatctgcctggatgccggtgcacacactaatccctgaacacactaagcattgcgcttgctgttgtttaacttttcatccatgattgaattcaggagttctttttttaaaatggccatttttaaagatttctaattgggagtttttcttctgaaaagaatacccgtaaagcaaactatttaaattatacactgagagacgtatgttcattcttgtatccataacagttaagaatcattacctattactagcataggcacaaagcgtctcctctaagacatttgttaattacaaaagggacaaaagtagtgacatgtggggaagaaacccagcagataccacctaggtggtcaaggtcatcatcatcatcacgatgagggcatgttgacaccctgtgataatctgagaaggactcagcatcactcctgtggtgttcctgccaaaaatgcgtaagagtctaatcacgagaaaaattagacaaacccaaactgagaggcattctgcaaaacacctctcctgctcctccaaagcattaagagtgacaagggaagaacggggaaccatcacaggtcaaaggggatgtgctgactataggaatgtgggctcctgggagagagaaagggcggaaggagaaaccggtgaaattgggtaagtctgtagttcacttacttgtgctgtgccgggtcttaactttcttatattttgctaattgctatgtttgtgtaagatgtcaacataagtggaagctgggtggcagttatatgcaactctgtgctatttctgcagcttattgtaagtctaaaaattatttcaagattaaaagtttttttttttaaaaaagtcagatgaaaacacgaataagtaaaaaaaacataaaaagagagaaaaaaggagccatttatatgattaactttttggttggtgtcgccataagttttttcagttcggattcttagtaaaggatgtggatcaaaacaaatcttcatactaaaacatcagcagagaccttatttcatttgaacaaaatatcatgaagtcaggattcgttttgcatttgaatcttgaacatttaagttttttaggaaatttgtggtgctcctgtccttgaaaggaagcccacatatgttcaaaatgcagtatcttttaaatgcatttgaattttttaaagttttggtgtttgttgtttttggttgtttattgctttgatttttcatgagcagtgctgttcaggggtactattattgtcagttttaaatcactgctgcagcatacttcatttgatcttgagacttgccatgagtcttactgtgggggtggggaggatggggaaagaaaccattgagtatgagttggcatgtcccacagaacagcgggcggacacttcagggggctgtgcctttctcagagactcgagggctatgcccaaatcgttatgcagtgtgtatgtgtgggggggatagttggggggacgggtatggggaaaggagtaatctaccagggacgacccaggacagatcccagagccaggaatgagggttggatcttgggcaaggccatctctgccatgactgcttgtgggaactcctgcttactccccgtgaccctgagcaaaacttccaagtttgaagcctcaattttatgctctgtcaaagaaactagtttttcaccctccaccagaggatgaagtatcattctccacgtgaagcactcagcacagtgcctgtcccctctgcagacatgatgccaatctgtgatgatgttctcttctgtcagcattttacaaagcagatgagagcgttcacttgcacagcctcctgttgacctttcttctctcagacgccttgctgtagatcccaatcgactgcttttccttggccagccgattcatgcagtctcttgcttacttaatactgttgatatatttaaattattgtttaataaatacttgttattctggagtatatttgttcatccaaggatggtttactactgcttgctttgtgcaggttataacaggtaagggggtggaggtgtgtgcagagcatcagctggtcatcagccatcttgcgggagtgcccagaggggggaagagcaaagcctaccccttctacggagtgtgagggaggcaggcttgggtggaggcaggactgcaccagccttccagagctcagagaggtgacacctgagccaagtgacacacacatgataaagaggaggtttctggagtccagaggaggaaggcatccttggctaagaggacagcatgaactcatagggtacctccaggaatttttcccctgggcagtaggggcagagaaaggtacccaggggggcaggggataaggactggcatggagcatgggctcgatatcagcctgctgattttaatgaaagccgtttggtcacctgaagaacagctttgattttacttctgtaatctaaactcttttgagttggaatataaaactcagtgttccatgtgacaaaggggtttttaaattggtcattcccttaaacatctttacattttcgtatctgttgatgtcatttttttccccattgctgactcctgttcctgtcttctatttctgctcttgacttaataattcttggcttcttgacgtttatcattgccgactgctctgaatcctcatcttcccttcatttatttccatttgtccgctctgtttactgcctgagatgttgaccttttttccaagcatgcactaagcggcattttaaagaagcagcatcatgtcatagctcctggtagtggggctgggcctattcatcttggggcttctttatctaccttggttgtaggtagttaagaaaatcttaacccttgggtcattatttctatagtgggtcaaagagatgaccacgttactaaaactttcatgtctagttgcatattctgttttttttattgtggtaagatatacattacgtaatacatttgtaagtgtacaattcagtggtatgaaaacattcacaatgttgtgtagccatcaccctcttacacctaaacatttttccattatccttctccaaaactctctgctcattatacaataactggcccttccacactcccctccccacactcagtccctggtgacttctcttttttctctttatttgcctattctaggtaccccatagaagaggaatcatataacatttatccttctgcgtctggcttatttccctaagcataatgttttcaaagtccatccgtgttatagcatatatcaaaatgtcatcgtatttttgtggccgaatactaatccgttgtagggtcactcacacgcacacacgtagagtagctgtgagtacagtgcccagattggtacagaaaggccacagtgcccatgggtctgtccattttacatgctgtaccgtgtgcttcatgggaaatatatttcttctgtgagttttcttgtacattgcttgtttccagacttctaaaggggtggttgtggggatgtggtgctgtgtctcaggtatactctgcttatgaaatagcgggtgtgatggaagggtggagaaagggagttgagtaataatgttcacctggggtcgggcgcggtggctcaggcctgtaatcccagcactttgggaggccgaggcaggcggatcacctgaggtcaggagttcaagaccagcctggccaatgtgttgaaactccgtctctactaaaaatacaaaaattagccaggtgtgacggtgggcgcctataatcccagccactcaggaggctgaggcaggagaatcgcttgaacccgggaggcagaggttgcagtgagctgatatcgcaccactgcactccagcctgtgcaacaagagcgagactccatcttaaaaataataataataataataataaggttcacctgattgaaatagcctctgtattgaagaacaccagcaggtgaagttcgcttagcagatctgagcttcctgttaccctaaacactgccaaccttgacctacctctgaaagccagtgggatgaggtctagggccaggtgggaaccttgggaaaggcatgccctactgtttgaccaaggggatgaggaggctgggtactccagtgatggagaccctttccccaccttttctctcacctctcctccacccagtgccctttcacctttcctttccaaccccacacccatccttccgccccacttccccatttatttctctctgctctttcatttccgtggccagccgcctcccaagccctgccctcaagcttcccctcccttttctttcatgcccatagcctacctggatctcctctccctcgtcgggcccacctccctccacccttgggatcctggtcaccccctccactgcaagggggagaagggctgcactgtgtggagggttctccctaccttggctgtgttctggggatttcccaccagcccttgcgctgcactggtgatgcccgatgtagctgaaactctgccccgctcggggttactggcctgggatcagcataggagatgggtttaaaacaggatgcagggaggctgctggcagacagttatttgaggaaatgcatttcttaggatatagctttcaagaaggtgctgttattgtgcgtcacacatagagtggctgtaatgcgccagggcaaatgaaaattatgtttataaaatagggcaccttgtcaagattaacttgtgtgaaattcccaagaatatacctcaaacagttttttatgtcagtgcatgatattgtagtaactctcccagttctagatatctttattttaaaaggaatgcttgtgtgcagacacatttttaggtggaggttagtatgttttagttctcaggatttctaggagaataaatagccataacttgataggattggtatgaatagtacttggtcttgggaagttttctccatgaaaatgtttcatgttgacgttttgctccctcccgtcttggttttacactcattcttcacagaactgtcatttataggaacttatcccctggccatctctataggtgtctttcttgcccagataaggtgagaatcattttggaaaccaacttcttgagaatccacaagaaatgggttttagccacaagggatcattgcattgcattctataagatgagagcttctacaagaaaaaattctggagccagatattttagggaagacagggggctgataagtgaattgttattttaaatggttttcatttcccctcatcctgatttagaagaggagagaaaactctccttagaatcagtgggtagtcctgacttgaatgggtttattttctttttctctcttgaattgtcggtgtatacccgtgtctttcttggtttatccttcatccccattcctccggatacccctatttgcatttaatctgtttggtcacataacctctcaagtagcgatcttggaggtttcaaaacttaacatttcattttccccgctgggtcaactaccagtctggaagcaccagggtttccaaggttaggttacagtgaaggcacaggggacatcttcctgtctcctctgcagagccagcgccactgtgcagtggggtgtggaccccggctcctccccaggctcccaggcctgcagctggcacaggggtccccagaacctgtgagggggtccttccctctgcctccctgagggacttggtgattcttagccctctctaacagagggagaagacgctgtcaaaaatgtggtttgcccaaacccacatagagctgggaaaggggccagggactcaaatagcagagatttcctggccatccatcagtcaggttacatcagtatactccatgtggattccactgggtgccggcctggtggctgaccctgcctttagagggaactcattattgtgtatttgaagtgtaaatacctcttttcccagatgttaatcttgtttcagatattcgatggagagggttcacataataaataattccctcctgagtcggcttgcgtggctcctgagagcagctggtcagggcccttcttgtcggtgtctcactggcttttagcaaaatggagacgaagatgaaagggaaaccttaactatagcttgaatccttagggtggactaagcactcaaagccttccatgcaaagcagtgtggcttataaattggaggcatttttcttattattaggacaaaccagcacccgaattggtttgtcaccagtaaaagaatttaaaacagtgcccgatttgcacagctgagattttggcaacagtatcttacacatctgaatgggtggagtaagatggagcatcattctgtgatatgtttaaaataatataccatgaaatgatgcagtaagtgttggagatatcttccagaagtcttaggtcatttgttttcatgtttaaattgtttccgcaaaggcattctcttcaacataaggagagctaaaaatcaaatacacagaaattttgtaagtgtgttgtttttttcttttcctgtttagactttataacattacactatttacctgggctaaacaaaataaattattttgtacataaaaccacaaggagatggtttagcctacttatgggaccaaactgttgtattagccagtgtgggagaatattgcagagatgtgtggcttcatcaatgaagattagatgtaaagtctttttaaaatatatgagaatgttgaactaaagatggttcagatgggactttgctcgagttgcttgagtctagaaggcaaaataaatgtttgtaattgttacataggccagccttccaaaatcccagctatccatagaaaacaaggggtcagcaaaattggccatctgcctagactggtaggttgtatgggtctgaactagaggcagtctttccccaggggacatttggcaatatctagagacatttttggtgtcaccttgggggaggggtagtactggcatctggtgggtggagaccagggatgccgctcaacatcctacaatgcagcggtcaccgatagcccaccctgccccaccacagccaagaatgatgcacccagtagaagcaccatccctcttccactggtgacatccgaacatgtctacagacactgcctaatgcctcttggggggcataatcacccctagttgaaaaccactgccctaaactgagactctgaaatcaaccacttaatctcctttcctctgagctcaggggagggacgtgactcctgcgagctgccttggctttttgtaggggcacagatagaagccatcccccaacacggtgccctgggttctgtggtggtctctgagaacccatgaataaggatcccagggaagcctttctaggtcgtgctgctttaatattattctagatgccgatttaaagtcataaaggaagaagagctaggactgtgctggaggaccctaaagcccatggcccatggtttcctataatgctaaccatgcccggagtatctagttataaataattgtgctgaggtcatgaatatttgactttggttctcaaatattcctaagaaaaaagtcatgaaagcccctgatggtaaaaggaggagagctgagacctaagtggataggagactcaggaaaaagcaagttagaaataaagttcaacaaccacaggagaggagaaaatgggtccaaaagacttgggctttaggcacatcttacctaaggacaaaaaagtagagaaaagatcaaatgttgagaaaagattgagccatgcggagaacgggcagggtgttgaagtacctgctgctctccttaaacccagcatgctgttcactgctttattttagagagtgggtgtagtggtctgtttcagaagactcaagtctacactgcctctgccactgaggttccttttgactctgcagaagtctttacctttcatctcctttctgaaatgctgtgagcatttttcctcccagagacattaattgggaacagcagtgaatgcctagttccttgcagtcctttggcccacacgcatttccagctgcccactggccagactggattctaaatgccaaaagctacaggcgctgacagagtgcttttgaaaagaaagaaatgcatgaaatgccccgaatttatgggaaatatttatacccagcagtccttgagccatgcgtgtcctttaggaacggtgctaccagacagccgtcggcatggccttgctcctggtggtgcaggctctgatgttccactgatgtgagcccaagagaggaatgaccagtcagcctgtaaccccagctccagtgttgttaatgagtgtcaccgatcaggtttcagacgttagtcagtgtcccggctccagtgttgttaatgatggccacggattgggcttcatgcgttagtcagtgtctctgttaggagctgaattgtgtccctgcaaaagggatgtatttaagttccaaccccttgcatctcagaatgtgagcttatttggaggtgggatcttaaccgagtgtgactggcttccttagaaaaagaggaaatttggacacactcgtacagggaaaaggccatgtgaacagccacctccaagccaaggagacaggctcagaacagattctccctcacagccctcagaagaaaccaaccctactgacgccttgatgtctctgaattctgcactccagaaccgtgagagagtcagtttctgtgaagccaatcagcttgtggtactttgttatgttgggcctatgaaattcatctactgttactagcctttcccaaatatttcagtccatgaaatgcacccagcatggcaactcttcaacttacagaaatggaaaagagaaagaatactgtgcttcagctagttttctcattacccagaaatgaaaaggcctgacctctgaaaccttgaggaatctctttttaagatgccagagcctgtacttctgcctgatccaagcagagtttgctcgctaccccgggcatcacttctcactgcccaggtggcactggatgatgtccaagactggccagatctggatggattccataaatagctcgtgctgtttctggtcagtgaagaaagaggaaggcaaagccacgtgcataagtttgttgtggatgccataacaaagcgctgctggagtggctaaaacgacagacgtttattgtatcccagttctggaggccagaagtccaaaatcaagatgtcagcagggctcttcctcctgagggcttgaggcaggatctgtcctgtgcccatcttccagcttctggtggctgctggcagtctttggtgtcccttggcttgtagctacatcacccagatctctgccttcatttgcacatggccttttccctgtgtccaaatttccatccccctaccttttttttttgttttgttttgttttgttttgttttgttttttgtttttttttttagacggagtctccctctgtcgcccaggctggagtgcagtggcgcgatcccggctcactgcaacccccgcctcctgggttcaagcgattcttctgcctcagcctcccgagtagctgggattacaagcatgagccgccacacccggctaatttttgtatttttagtagagacggggtttcaccgtgttggccaggctggtctcgaactcctgacctcaggtgatccgcccacctcagactcccaaagtgttaggattacaagcatgagccactgcaactggccaaatttcccctttttataaggactccagtcacattggcttagagctctctcctaatgagtttacatctgcaaagaccctatttcccaataagaagttactcccaggtactaggtgttagggcttcaacatacgccttgggatgggcagtcttgaatccataacaccgtcaattaaaaggttctgctttcattgccgccaggttgggaaaagttgccagggtgggcttggtggaggagggtctctcagcagggcagggtcattgcagggaaaaggagagagaaacagagacacacaaaagcagatagattgccttggcagaggtggccagactagagtctttgagttttgtagagagatcaattgattacttctagaaatgtcctcttcaaagtctctagttttctctcccatttccttatacaaggctctggccatattactacttctggcacagttgattcagtgacttttgcatataggtttccccaaagctaaagctaaaaacgaacaaacaaaaaaagattattcatgaatatgccacaaactttgcccatagataagactttgtgattacaagcaaaatctgattggaaaataaaatacattatatgttagaataccaggaaacttctttttggggagcgtctttatgaaatgaagccatgctaacctccctgggactgctgatcagaatgtgctccaccccaaagcctcggagagggcaggacagccagtgactctctcctgtcagtagacacactaaacctgaatccaggatgggaaatcaatgtttgacacagctgtatctctttcagttggatcagtaacactcgctcactcactaggacttccatttgcttttagctgcctgcaatgaaaacctggcaagacgtcttagtctgatccggctgctgtaacaaaataccgtagactgagtggcttataaaaaatagaaatgtattgctcatagctctggagactgggaagtccaggatcaaggcactggcagttttggtgtctggtgagggctgctttctcacagacagcatctttttgctgtgttctcacatggtggaaggggtgagagcgctctctggggtccctttgataaggcactaatcccattcatgaggccccaccctcatgaccgcattacctcccagaggctttacctcccaacaccatcatattgtaggttaggtttcaacataggaatttggtgggcgggggggggggtacacaaatgtccggaccatagaataggacattacagcttgaaaaagcactagagagaatgacgttgttcctttgtaacacagaaaagcattcacctctcaatttagatgagccattttgaccccagttggttctgaaaatccttgttgacaaacaaaattggagaggaccatagcctgcctgcttttcccgaggcccggggaaagctttttcatatgatgttattataatgttaggtgtaacaataaatgaaagttttgtatggtctgattgggtaggacaggcctgaacacaggcaaacccatctgcacagcatgctcaattcagtcagtgtacaaaccctgtgtcatgggagcagagagaagggtctgcttccattccggaggatgacagaggcttaaggacggtgctggcgtttcagctgagcctttaagaagtggaattttatccagaggtgatcttcttggaatagagagaacaaacaggtcagggcatgcagacttgattacaggtgctctggggaccactggaatttttgttgaacagaggatgatgaaataaatcagtgttctagtgtgttacctttgggcagtggcgagatccgagtctccatagtgaacaaatcagtgcacagaccagggcagaagtgcaggggaacatggaacattcagggcctggagggtggtacccaggccaacactgccccctttttccagctcccatctctgtccacatagttgggccagtgtagacatctgggtcatatagggaggcattccagtggccccatgtggtttccatggagatcttcaggaaggggttttggggtgagagttggtatctcgtggcaaggacacactccctgggctaggtacatatgggtggttttcttgtcctacagattgcaaagatacaggggtagctgttctgctctgggcagcttctgtagagacaggatgtgtatttgcttgcctgctcctggaagccagtcactgaggcagacctctttactcgtccagaagcatgacttggggatgattatagttcaaggacataaggcctagtggtgtctttcatcagcgccccccattttacatttctgggatccccctttctcttttactctgatctggcctcccttcccacccctctggccactcaggtgaggagatgccagatcccaggtgggcaggaaggaatcccactgaatgagatccttggaattgcagcgtagcctggagctgtatgttcattttagatagaaatattgacactattgacactatttggccgggcgcagtggctcacacctgtagtcccagcactttgggaggcaaatcactttgaggccaggagttcaagaccagcctggccaacatggcgaaaccctgtatctactaaaaatacaaaaaaattagctgggcatggtggcacacatctggaatcccagctactcgggaggctgaggcacaagaatcctttgaaaccgggaggcggaggttgcagtgagccgagattgcgccactgcactccagcctgggcaacaggtcgagactgtgtcttgagaaaacaaaaagaaagaaatattgacactatctgtccgcaaaaggtcaaaggcataattacaatatgattttgtttccatttttctttttcttcttatttcatgcaaatgctgtctttttgagagaagtggttataagcacagcgatattctatgctatgtacagctctcatatatagaactctctagaatggctcaagttaccattaagcctcaggtgatatcaaggttataaaatgtaaaatgaatgatcatgatcattaagtagaaatcctggctgtgtcttccaagttctttttctttctttcttcctttttttttttggagataggtactatctgcatttcagcttagcttgccgccagtgttctggtttcttgaccatgctgagtaattttcagccacaccttgtatcccttagaagcccttcttgattctgaggtacggggctcagaaagctttgtcgtgggaggttgtaaattaggaaacatgaaaatcagatcaacaacagtggctggtcctggctgcagggctcatctgcctggagtagcttgaagttgaatgttaatatatacttttaaattgcagttgtttaattaggtaaagtgcacaggtgactttctcacactaaatggatgatgagtattgggaagagttgactaaaatttctctatcttttgcccatatccaactctcattgaattttaactcttatgagatatgtgctatttaataaataatgagtctgagttttctcccttttggaaatgtcaggaaagtctcaatgattttaagtatcttttattttataatagcaatagaatctagaatttctaaaatcaaactgagttcttgattaaatgttgaaatgcttgtcttcatccacctgggagcagtcgttgtgaacgagaagccccagtgcataaatcattgaatgatacattggagaagtctcagagtaaaggaagatttgtttacttttcagacatcctggaaggtgagcatcaaagcaggtgagtggctggctcttggattcaagcttccctgatcctttccagaagtgtatccttctcctttaagagaa[450 bp omitted]cagaggttgacacccaggactagagctcagtagaggggccgtttcctacctgcagttcccttggaagagaaggggtgaagcttaccatgttggtggtggtttgtttcctggggctgctgtagcaacgtgccaccaactggctggcttaaaacatgtatggtctcccagttctggaggccagaagtgcagaatcaaggggtccgcagggcccagctacctctgaggcctccaggggaggatgcttcctgcatccccttgctgcttttggtgttgctggcggtccttggcttgtgggcacagcactttcctctctgcctcggtgactacatggcctccctgggtgtctctgtcttcttgcaaggacaccagtcatgttagattatggctccaccctgctgcgatttgacctcattttactttaactaactatctgcaatgaccctttttccaaatgaggttctgaggtgctgcacgttaggactttagcatgtgatttctgcggactcaggtcaccccataacagtagtcatgccccaccccatcccactccacccttctcccaattcccctggtatactccagggtggctctgtggccacacatgacccaggcccactggccattagacactttggcagggtggccaaagaaattctttgtgctgaataaaattaatgtgtaaatgcggcggtgctccaagggcagtgttgcgtgaaagggcaatagaaccatggctcctgataaacagaagcctgttaagcagcaaggtcaaaagccagatgcagaagtcagaattagccgggtagactttttatttcactttcccccccttttttttttgccagtggactgccaactgttctcttaacagaagggcagtttttgagtaaatgaagcaggacttgatctgggttgtcataaattgtctctccctcaagaggtaacttctcgtgtttgccagttcagaggtgtagggagacatctctgatgtgtagatgtcctagtttggggtgcagggtggctttgggtctgagagcctgctgttggccactgggtgcgcgtgggcttctccacatgacaagacgggaatgctgtgaaggaggccgctgttccgcttgggatgttggccgagcgccgctggcctgtgtccctggaatcctctctgattcaaccattgaacattaactctgtgaggtcacagccaccagcggggcttctgagcccggccctgttctggccatagagggtcaggaggagaagacgtttcacccttggattttctgtgtttggaatccaaggcctttcccgtggagtcttgtgaggttttctcgggaagaaatgatcctctgggagaggcttgggcgcgaactgaaacatctttcaagacactgtggctcttttcagggaaatgctaagccaagcaaacatccactcagaaatgttctgtatttggaagcctcagagtgttaggggaagccttgaccctggaatgtcatctcctggtggtggcggcttcacgtggtaaacaggaggtaacctgggtgtcatgtcacccaggtgacatgacacagggccacacaggatcatcttccagtggcagtggtgaagataggggatatgatttcacatcctcattagagcccacacatgagatccagctttataattggaatcccagataatgagcatgtgaacgtccgtaagttccgcctattctgggtatgatgtcacactcataaacaagctaagcacacaaactggaatttcactttggaggaaaaaaatttcaattctgttacatgagataatacaagtagtttaaagccacagagggtctctttcgatcaggtagatctattcttctgtgctcatgcaatatgatagaagagcttcttgcatctttatgtcaagaatttgctaaaataaatcagacaagtttaggatttacctcatagtaaatcaagaactttaagcaggggcttttcttctaattaaaaatgtcatgtataccacttagacatggaaatgcttaggtaagtggagcaaattattctctggggatttagaaaaaagaaaatcagtctggtttctatggctgcatgaatctggaaggtaaattattaacccagtagactaagattttactaaaaacagactaatttgttgtggcaagacagttccagtctgtgtgctagggcttttgtttgcatgcttgcttgaaggcagacaagtcaaattaaacaataattattggcttggagggggagcagatgtattggattagtttctgtgccacatttctctcatttccaccaatgcactccagtttcagcccttgtatcagttatctgttgattgctgtgtaacaaatgaccccaaaactcagcaggtgaaaactacaaacgttaatgatctcacacaggttctgagtgtcatgaatccaggtgcagcataaccaggtggttctggctcagggtctctcgtgaggttgcagcctgcgctgcagcctttgagacctcgtgtggggctggggggtcagttccaagctcccttagggtgtggctgcagcagaagtgatgcaccatgtgcaacaattctcttggtcctgtggatcaacctggtgaatgtgggacaggccggtactggagtgtgaatgccagggctcacggggaccgaccgtctgagaagctgcctgtcacgtctctctttgtcttttacacccataaatgggcaccttggtcagagaataactccttttgagtccataatcgtctatcagaaaattctgggaaaattacttgttgatttagccacgttcatggcctatctttggagccatcagagcccacaaatggagactgtcaacagcttagcagtcagttcattagaaagtagtgttactgcagcctgggtgacacagtgagactctgtctgtacaaaaacattaaaaaattagccaggtgtggtggcgcatggctgtagttgctggaactcgggaggctgaggtggaggatcacttgagcccaggaggtagaggctgcagtgagccatgatggcatcactgcactccagcctaggtgacagagcaagaccgtgtcccaaaaataaataataaaaaaagaatgaatcacataccaatttttttgctcttaattgcatttttgaacagaaaaacagttttccctgcaatcaaatgcaaacagttcctgagcccctaatggacgagcgtcctcagctcccacctgcactataaatttgcgttaatcttccagttaacttcagaactgctgctgtctctctatgttccttctgcctcaagacatataggaaatgttggcctttccctttcaaaagaacaaaacagttgaataacctactacagtcttctgtgcaaagttagcttcaaaaattatcaagaatgttttctccaaacattcacaaagtttacagagttttcccttttactcaggatttcagcccctttgttgctcttggctctcacagcaccaagatcgtctgtccactcgttcattgggcagatgtttattgaatacctgtgtgtgccaggccctgggccctgaagtcagggccataaacacagagcacagtcctaagggcaaacgattttctcaacagggatttgaggcctgtgaggtttgaacaaatgagcctcgtgagtgccagttctggacactcggcctgacttatcggacatttcgcagattcctaagattttagaattgggagagaatctttgagatttgcttgtagcccttacattttctagacaaggcagaaagaagtccagtgggatgaggcagtgctggtgctggcaccgcctcaccctggcacttgcatcgcctggaaacaaggcagagcccactggggcccccagggtccaaagcctccaggtacgtgtctgagttctagcattggagttgccgctctcacccttgccagttgctttggcatgaagcttgatggtaccagtgtgtttctgtcttcacagcttgtggccctggccctgagacctgaggcttggatggcactcccacttcttgctttaattcttccctggagagttctcaccttccctgctttccaagtccagctgagatgggcaaccaaaatttcccaagggagaaaatagctgaaaatagaagtagaacatgaaagaggatggcttttcttttttctttttttttctttgttccttttatttttttaagttgatttatttatttatttatttgagatgaagtcttcactctgtcacccaggctggagtgcagtggtgtgatcatagctcactacagcctcaacctcctgggcttaagcaatcctcccacctcagcctcccacaggtgcatatcaccatgcctggaattttttttttttttttttccaatttttgtagagacagggtgtcactgtgtttcccaagctgttctcaaactaactgatcctcccgccttgggctcccaaagtgctaggattacaggcatgagccatgtgcctggccgagaatgtttttcaatttgggcttgttcagtggttttcacatgattggactggggtggtaggttttgaggaacgagaccccagaggtgaagcgcccttctcaccacatcatatcaagggtaggtactgtcaacctgactcaccactgttgctgttgaccttgaccactgggtttaggtcatgggtgttgggttgcgattaatgtttttccctttccatgtagtattctttcaaaatccccactcgggtggaggaggggtgttaagcatctcttcctggaggttgtttatttcggttttatgttaaaatatatcagtgcagatccattcacccatctcttgatagaaggagtaggatttttcttgggacagggatcctttattcctagtttggagtcagcttcccccattccggatggtgcagcctctacaatgtttgtctctttgaagcggagtgggaattgaaagagatttatgaaaccatctcggtatagaatctatctaggattttattttcttttcccaaatcccttgaggcaatctgtcttggttaagtctctaaaaaagcagtcaaagtggtttttgtcgaaaaaataatttgggggtactcctagttcaccattttatataatattcaattacttttcgtaaatgcaataacaaggccaactgacataagcgagtttgaagcagtcagcagtttgggtgtttcagacccaggtaggcagctgaggtgggagatcccaggggaagctcagggagcagctgcccgccttggtcagttcagccaggttaagtggaggccttgggaagagagtttctcctcttgagtatttttagaagcagcagatatcagccataaatatttaatgttgtgtttctaaactttagcgtcataaaaatacaaaaaggtgactgggcgggggttggtcagtatatacctaggggagaaaagaacttcctcaacacatcacactgcataaggaaaaccgtcttaaacgttcttagaagaaaagtcagtaggtaaacagctatcgtgtaatctgatgaatacccaccggaggaagtattagtaattattctttgcttgccagggttttcataattcttttccaattataaaaattaatatgctgtaagcagtttttaaaaataaaagtaagcatgaaaagaaaaacatctataaacccacccctagaagttttgccccagcattttggtggtgtgttttcttccaggtgtgtgtgtgtgtgtgtgtgtgtgtgtgtgtgtgtgttgccccagcattttggtgtgttttcttccaggtaggggtgtgtgtgtgtgtgtgtgtgtcctgctgtattctgagctttgtagtatgccccttccacttgaccttctccaggaagcatttgatcatccagcaacatcgattgaaaatgtttgtatgcatctctttcatgaagtacatgttccatcatttatatcacatgtgttgctggagatttcaattgcttccattttcctttaggataaattgctggaaatagaactggagggctcttgagaccgattaccatattgctttcctgagaggctgtgcgggttgcgtggcagtgaggagggacgggggtaagtggaggggctggggcacaggcctctccaacacttcatgtgaacatggtcagctgagccaggaatgcgtgacatctttatttttccccttgcatttctttaattcctaacgaggtggaatatttgatcacatttgtcagctatttgcatttctttttccatgtattagacctaagcctctttgaaaggtgttatctcaggttctttccaatattgcactttctgagtttctcttgaatcccagttattttaaggattgcagtgttggagtttcagctgaaggggccatgtctgatgtttgctggtccattagcctcctggcctgagccaaaccatgcatcttcatgtcagagctgcatatgaaacaagagctaagtccagaaagcaagaagaagctagcagattgattttcctaggtggggcctaccagggcacttctgttgttgactgtaccactctctcctgaagggccctggttgtgtactgcagttgggactgctgacgtgttggggtgttacaagagcatgcggaggctgctcctctcctgtttcctggtgtgctgatcaaaagactttttatagaatgacagttgtaggaaaagcacagattcttatgttagccaataacggattattttttaatgttattataaattggcaagcttactaatttgtttctacttgtcattagccaaagttcagtgtttcccaaggatatatgtgaatgtgtgtctgtgtgtgacatctgttgtatttttcacatgaattaattgagtatctattatgtggcaagctctgtgctgtctttgaagcactgaactgtcttatgatacacacaggatgaggacaggatcattttctatatttctgtgaagtcctttttcaaattcccattcttttgctgcttctgcatctcctttgactgctttagggcatcccaggtagaaagcttacctaatgtcaactccagttctttcttttgtagtcttcattttaagcatgatttctgtttttctttttccctttaaagaaagcttctcaaactttgaaatgaaaacaaatgaaaggagagggaaaagattcagaaattattgatagattgctaaaaacaaatgctatgataattttgggtcggagcatctgtcgttttacagcacaacagatttagcttcttaatgatgtttgtatgtttttcctcaaaagtgtattgactaggtaggagttgagccaagccttgaatgaatcatttcctgccaaattcaatagactgagcaaatcctcggagaaatggccatatttctctaacactgggttcctttcagggctcaagattccattttctctcaatactttgctcctacagactaggagtcctcttcatgctacagtatgcagtgtgtatggaaactgtgaatggagaagcagccgttcatgctgccaagtttctttcagaaggtggctccaggtggatgactttcagtctgaactcagtgtcaccaggcatgtgtgtgcccacacactgccactttaagctgtggacaaacagaacggatattctcccaccaaaataaacatacaagcaaaacactctgtcttcattcagcatcatttgcatcctataaaataatggtttctccttgatgcccacctttcttatgggtggttcttaattagttccaaacagaacttaacgtggccatgatattccacttgctaaaacaagggcagtcgagtgttcgatttgccatcattgattagacgcatgcagtcacccagtgctgtttgcccaagcatctgtaggcggggattccccagtgctgattccccaatgcttgtaaggggcaggacttaattaaatcttaaagtgacagctgaaaatgtaagggtcaggaagtcatgtctaaaaggggatttagtataacaataataacagcagtgactaagactaatcctggctcaggcattttgtttggggtcacctggtcttaattagcagcactctgggatttgagtggcgctgtgctgttgcccacaaagcccatcagtggcaccattgcctgtgtctttcggggcagtctgttagggagggggtggcacaggtgttggcacggccatccccattttatatgtgagggaacctcagccaggcaggatccttgcctggatgctctgtggggagccctgtgagtttgtaaccctccgtgcagcctgccaggtcagcggccccaaaatggagagatacagagggcaccaaattgtaaggcagagcgttggctagtgacacaagctgcctttcgatcgcctgggcgttctgaagcccgcaaacattcgcctggaccttggtcaggtgtctcacagaacctacagtaattcactgttaagaataacttcaaacacagaaaatcgctttttgtttcctagagaaggctagtcttcagcgagaacaacttgtgatttttaatctgtttcacactggtcggggaggggggaagaaaagatgttatgggcatataattaaaaatttgtcggcagatacaattacaggaagaatcatgtggcctaaaaaactgaaagcctccatatgcctcttcatcttgccagctacagtccacaaattgtagagcctgcgggcactgtggaagccagctagatttgctctatccagtagcagcagattgagagccatacatggaatttatacttttctagcagccacaggaaaagagtacaaagaagcaggtaaaatttatattacaacatcttttttactgtgtattaaattattattgtaatacctattttaatatataataatgccataatatattttatttaacccaacgtatccaaaatggcatcatttctacaagcgattcctattttaaaaattatccgcaagatattttatgttctttcttttttgtacaaagtctgcaaaatccagtgtgttctttggtcagtgatgtctgagatcccaagttccaatgtctgtctgaaattatgaaaatcaagtcatgggagatggataccctattccctacgatccacttatttcacattgcatgcctgtatcaaaacatctcatgtactccataaatatatacacttactatgtaaccgcaaaaattttaagaatatacaaaaaattttaaaaactgaattaaagagcattgtagataattgtatttttcaaaaaataagtaaaatatctggtatataacagttaaaaaaaaaactgtattatcaactctgtgaccttagaactacctttttacattttcaaagattaactctccttaaaaaaataaatgtacaaattattaccaaaaaaaaaaaagaaaatcaagtcataatgtgaaaaataatttttaagctgaaagttacactgtttctaggagttttaaactaggatagtttgtggttattaatctgtttggaagtagtccagaaaaaaatgctatgggtcaataacttgaaaatgtgcatgtggactacttaaagaggaatcgtgtggcctaaaaagtccctgttatccctccaccctgcagactccaataggagaatttccgctgctgcagactctccttggtggccaagctgcccagcactctcccgtcccaccaatggtgtgactcctatcactgagaaacagaccccttaccatttcatttccttttaattaatttaaatttaaaaatcaacacttccttggttactggaatgttgggaaccatgtgggtgtgtgcatctatattttccagggtctattttgttacctataataccagtcatgtatttccaatgaaaatttaacttgtgaattgagatatagtacaaatgtaaaatacatacactgtgatgatttaggaaatttagtaggaaaaaggaacgtaaaagatctcagtaattttttaaatagaatacaagttgaaatgatactattttggatacactgagtaaatcaaaatctatcatgaaaattaatttaaggctgggcgcggtggctcacacctgtaatcccagcactttggcaggccttggcgggcggatcacctgaggtcagcagttcaagaccagcctggccaacgtggtgaaaccctgtctctactaaaaatacaaaaattagccgggcatggtggggcatgcttgtagtcccagctacttgggaggctgaggcaggagaatagcttgaaaccgggaggcggaggttgcagtgagctgagattgcgccactgcactccagcctgggcgacagagtgagactccatctcaaaaaaaaaaaaaaaaaagaaaagaaaaagaaaactaatttaaaattatacataaggcttgccttagatttctgttgggttgtgcagatctagaccacagttgtcatgtaacaaaggaaggagagtttgaaattacaggctcacagttaatgataaaattccaacctaaacccaagaccagacattccaaacactcaagtgagtcaatctgatgatttgtaaggcttaatgttgaaccgtcttcaaatgtgatgacctcatcctaactctttccaagctcccactttgggtatatcaagaggctgaatgtggtggctcacatctgtaatctcagcactttgggaggctgagtcaggaggattgcttgaggccaggcatttgagaccagcctgggcaacacagcaagaccccatctctacaaaaaaaattagccggatgtgttgatgcacacctgtagtcctggctactcatgatgcttgggttggaggatcattgagtccaggaatttgaggctgcagcgagccaggatcatgccactgcactctagcctgggagacagagcaagaccttgtctcaagaaaacaaaacaaaaaatgaattggccaagagaagtcaaggctcatctgacttggaagggagccaggttctcagtctatactgcttttctcatcctggcagcatccccatgagataaaaatgattattcccattgtacacttaaggtaaaaggtctcaaacagatgaaataattgcaccatgactatagaaactagtaagagtcagcgcctgaaattaagcccagggctgtctcctttgacactggccaaaaagcagtaacctcttttgatgaaggggcttacttcaagctttgtttatgtgatgaaaacaccccagggctccagaaacttaacatttggttccacatccagaaaagtaaatttacaaaatggtactgcaagtgataattctcgttgacctgggattgctagggtataagcattctgggaatacctgggtttctgatcaggaagtcattcgcagctataatggtgatcctcagtcaccgggactctgggattgctagggtacaagcactctggggttacctgggttcctgaccaggacatcactcgcagctatagatggaatgctttaccccttttctcctgtgttatatgacatcggttagcaccttttaacctttttagaagataggttggaagttgagttagataaatcaacaggtagctgatggcctagaatataactttctgtagctttcaaagtgaggatgaggggcatcttgttccctaaactgcttcctcatgatggggaacctcagcattgtcttgccttgtgtctgagtacccatgtaaaattcagtatttcattcttaaaagataaaggggaagaaggaataacaatagacaaagagattccaccctagtccccatcctcattctggtgaaaagttgtcattactaagacaatcacacactcgatggagaattgtaggctgtggacaacagagccatagatggtgtactaatagctgctacaaaggacgcctctgtcctacctttcatgcccagctttgagtatatcctgtctcttgctcattaccgatgctgagttttagccctgtaaccagagtcctctttctttttccacagatgggactatgaactgtgttttaatgattagagggagtagtgaagattttcactgtgaacattttcaccccctttcccatccttggccagagatgatctcacatggtcttggcaggtatctttttacaggagtgcatgttgtttatcttgggagctttttgcacagggaaggcctttgtcttccagctctgtgaatccttcttcactgcgtagcaccttgcagaacatttgcacatattaggctcttggtgaacacttagaatcctcagtcatttgcattcacgtcatgtttccataacacattgaatgaaccagcaagtatttattgaacatttactatgtgaaacacagggaagacagccatgaacagaccagacacaaatcttacgtgctactggataaaaatgtaccccacggatgacactttgggtattatgatgccaacaatgagaacatattaaatcactttggtatttgcattagattgtgtcctgtaagtttcagattggtgtatttgccaaagaacaattgtgtgtaccccccacccaccagaaaagaatacagtaaaagtgctaaactattgaatatttttaaatggtattatatttgaaacgtgtgtttgtaattttgagccatgtaattagaaatctagggtttatttaaattcttgtttgttttagagaaatatgtaaagccacatttccctttatataaagtacttggttgaaaaaacaatttttttctaaagaaaaaaaacactctttagtgtacttttgccaattaaaagacagtacagagaaattgattcctcctggagtttgtgtagaaattagaaaacataatgcttttccctaggcatgaactcgcttaaaactactgagaagcttatactcacgcaggttgaatggagtgaatagtggtttagagaattgagctgattaataagaagtccctgattttcttttaataacacgttctgacccaataaggaaaatttgcactatgttttcctacagcgatggtgctgttaaaacttatgcaaatgggacaactttattattactaagccttttacagtatgttgctttccagggagctttgtaaatcattataattgtgtttcctcagtgtatgggttctgaatgctcctgttgtcctgtgaggtgaatttccatttggtgaagatgatactgttaaatggaggtttctaccccatagaaattaagaagagataaatgcagacagacccagcccttggaaattctgctttgtgatgaattatttccttatacttatggtgaacttttttacccgtgatgtgcacaggggcccagaatcatatatgacaagtccttccatgtggactacatccatatgacaccatgttcactagttggagccttggaaatccagtgggaatggtgagatagtgtgaacagctccaaggcaccgtgtttttaatgtaacccattcgtttctggctgaataggctagttgttgatgtggtgggcattatgagatagtgttaatggttgggccacggcatttcaaagagatgccttataagtcctgagcccattgtgcgtctctgatcattttggtcttcatttgctccccttgcccaccgtccttccacagagcattctctggaagcgctcagggagcagaacagggcaggcccacgtagaaaatggtctcttgagagtagaaggtcaggttcgctgagatctctgactcagaccacccgtacccatgctttttgttgtgatggagaaggtgctctcatatatacacatttgtgtagtaattactgcatattgatagcaatgttactgcacctgttaattaatataaccaaatggcatagctacagtgttttattctagttcaatttaggagagtatatttgttctcaatgggaattgatctggggagacccagagagtggggacatgagggttatttgtggaggggatgacacagcagcttcagaaaacagaaacattaatgcattagactgctgacctgtggggtcacacttccttcagtgatgcccataagagtcttggagtgccggaaagtataagcaacgctgagttcctgccagtatcacaaaggtgtgttttggataagagaggagccagaaagattacacttgtgtagaaagtgaaaactgagtttgagggaacagtcacattctcatggcaataaggtgggtagaatgggccgctcagcctctgcactgtggtcagctggagctggaagatggttgtggtggggctgccgtgtgcacggtgggaggtttagcagcatcccaggacccaggagataccagtagcaccgcctcccccagttgtggcaactgaaaatgtctccagatattgccagatgtcccaggatgccatagggggagcatgcagtatcattgcctgttgagaacctctggaataaataggtaaatgcatacaaatataaggatcttagtcttgcattgggaggcggcgtctgacatgtaaagacaccactagagcacactgaagtaggttctttcagagcattgcatgcatgataccctggagcccaaggagaaaatgatcaggccatgcctcctggaatcaagaaggcttgacttcacggcctggaggagataagttttaaactgatccttgaaggtagaggtaggtgaggaactagatgaaaggatcagtattaggtgggcttttaaaatattttctggccgggcgcggtggctcacgcctgtaatcccagcactttgggaggccgagacgggtggatcacatgaggtcaggagttcaagaccagcctggccaacatggcaaaaccccgtctctactaaaaatgcaaaaaaaattagccgggcatggtggcgcgcccctgtaatcccagctacttgggaggctgaggcagaagaatcgcttgaacctgggaggcggaggttgcagtgagccaagatcgtgccactgcactccagcccggacgacagagtgagactgtctcaaaaaataataataaataaataaaatagaatttttctgagtattttgtatgctgttgaaaaatttatcacttcgtagatgtatctcactttgtctatatctaagaaaaaaactatgtgcataaatgaatttttattagctagttaatctagtcagtggaatggagtattatttccagagttccacttcatattccttggtaatattgagacgctggttgtagtgaaaatactcttaattaaggcatgttgtaggttcagagtttagatggctgaatttcatgaagggtcttcaaagcattgggggtgtttggtgtacggtagtgattttcttgtgttcatttgacattttaaagtgatagacgtttaaccttgggctttctcaggactctagaatatgaatgatcactgttaactgtttagaaactcatgatgtaagcccatatgacttatggatttatgcacattctaaacagataagcatcatacaaatataacttgagttttctatgaaaggacagtgagacaccaccccccgcaagtctggcctgaacattggtggactgggaatcataaaaactgatacatacatgtcttactttgtgtttgtttgttctaagcgaaagcatgtgaatatgcagtcatctgccaatactttgtgggccagcccaggcctctgctctgaggatggcccacagcctggagtgccccagtgatcccagcactgtccacacccgcggtgcatccctcctggcttctagtttccagttaacttaagcaaagctgcacagacatctcactgtacatctctctagatttatacctcccctctctaccttcccggtcttgctgcccacacctgtcctcaagtaaaaactgattcacacttaccctgtctctcaaacattcaatgttattttcattttgaaaaaaggctgtgaccctgtgtgtactcgtacttcatccgtctgtgtaatatttaaagtttgtagttaaaatagtgaggacactgagtgaaatggggctgggagcagacttggatcggctttgggagatggtgtaggcagcgatggggacaggtggaggtgcggaccggagtgccgccctctagctgcgagcttacatcctcatgcttgggtgtctgtccttcagtttcttctccagtgccacgtcacctacctgagctgcctcaggtttgctccctgctgctgtgcacacgtaaatcagtgtctggcgggaaacaggcagacgcctttacaagaactagttgccatttatctttttattgttagacctcccagtaatgtgtgaagtctagtaattgcctgtgtgtcagactaactcagttgtaagctctacattatggtgctattaatctcttcaatgtaggcaaaatggggacagtggctcccacagcaagcccatctgctctacccatgtaagttgggagggatgtggtaccgtgtggcttctacttctccatccactttacggttgatgttcatgcttattgtaaaagccctgcaagacctagagatgctgtgagtcctcacgaaggaaaatgcagtgttccgtggggttgtgctgtccactacaggctcttgacttctgaactttctgaagtttgtatatttatccgggaactcatacttaccaagctgtattttaagtttctttcctgagtcaggcaccctccaagctaagtgctgtggctgcagaggcccctgccctgatggagcttgcctgttacttgggagacttgtagcaaacagaggaacaaagaaacaaaataatctgatgacagtaacacatcctgtgacagagacgaacaaggtgacatgggttggaggggtttgcacattagaggtaagaagactcctgtgaggaagagatggatgaaccgaagtgtgtaagatgcagccggaagagccaggagaagagagtttcaggtggagaggccagcacatgcgaaggccaggcacccaggaaactgagggaaaacacaggccaggccagcatggtggagcgagtgaccaacagagcagaggtgtgcacggtgaacaaagcctacagtgctttgccggccataatactaagaggatgagtgtggacctgaaaccccccagcagcttcctaccacactaaccagtggctggctgctggctgagggacggactgtgatgactcccactgggtcccaggcagggagataacctcaccttccactagcatagctcagcggagccaagaaggggagaggacagattcaggacactccagtgcagaatgtcagcggacgtgcatgtgtcctgccaggggagtgaaggtgtggcatgtgagcacggagtgggagggaggtgtgacttatggagactacaggctagaagagagacgagatgccatggttgggtgggtggaggtctctgctgtgggcgtgttgcgtttgagatgctgcttggaccttcaagtggccaagtcatgcagtccctgcagggataggtgaggagctatggaggttgggggctggagacatctgggatgtagacctggagactagattcgttcactggagagacccatggcggtgtagtcagcgaggggcactcaaaggtcgggaagatgcctttcagaaactcagggtgcccaaagcatttccaaaatcatttaacacctccttgcattttcacagggacttggaacctcttaggagataagaatatagggaaccagccatctggagacttctgcagagaatatacattaatatcactgtcttattctcactgactccccacctttttaaaataagggagatggcctagactaggaattttgcttaacttctatcctcctgtcctttttttctgactctgcagttttcatctgaggtagagagaaatgatgcactctgctaaattagacctgaatatctgttgtttttcttagacttgtgaagtttttactaacaaccacaagcacagtcctgaacatcgtataacagcatcatttgttaattttttgaatgaattttgtgattaaccttgatttaacaagaacacccagcccatttcccaacgacacaaattaatacaaatttaatgaaccgaagtgtgcccttctgctgccacgtagctcagttctccagggatggaagctggcctgagaatttctaagtttgacgaacattcagatgttccagaaactatcaagattctgagactgtttctaggaaaggccacaactctactggaaagtatatcagaatgacatttttgaatctgaaaagaaaaaagtcctgtacatttttaattttagttaagagtttgaatctggcttaatatattcttaacttgctagtttgaaaacaaactggtcgatgctcattttcactctcataactgtttcgatatttctgattttttttttttctttaaccaacagaggggtctttggaagacatatgtgcttttaagtttcaattttcattgcaattttgtttgtggtaaaatgcacataacattacatttaccattgtaagcatacagttcagtggcattaagtacagtcaccatctacctccagaactttttcatcttcctgcactgattctccatcccccatctccacacccccggaaaaccaccatcccactttctagctcttgttttgactactctggtgacttcatatagtggaatcatacattaattgtcctttcatatcgggcatatttcacttagtgtagcgtcttcaaggttcacacacctgtgtcagaatttcattctttttttttgtttttgaaactaagtctcactctatcacccaggctggagtgcagtggtacaatttcagctcagtgcaacctccgcctctcaggttcaagcaattctcctgcctcagcctcctgagtagctaggattacaggtgcgcgccaccacaccctgctaatttttttgtgttttttgtttgcttgtttgtttgtttctttgtttgttttttgtatttttagtagagatggggttttgccatgttggccaggctggtctcgaactcctggtctcaagtgatctgctcaccttggcctcccaaagtgctgggattacaggcgtgtgccactgtgcctgaacagaatttcattccatttaaaggccaaatatgtcattgttcgtataaacagcatgttgtttatccactcatccgttcatagacatttgggttgctattccaaaatagcttttggctattgtgaatgatgctgctgtgaacattgaggaacaagtgtctgtttgagtctctgcttccagttcctttgcatatacctagaagtggacttgctggatcacatggtaattctgtttactcttttgagggcctgccatactgtttttctgaaggtttaagtttttgtgagatgtgataaaggtagggtccaaccgtgactcctatgatttgatgcaaaggttaacccactgtatcctgcaagccaaatttagcccttgctaattttgtacaggcaacatgctaaggatatttttaatattttcagatggctaaaaaaattgaaggataatatgtcattatccatggaaattcaatgaaattcagatttcactttacatagttgaagtttcattggaacacggttatacccattgtctgttgtctatggagcagactttgtatggcccatggagtgggatttgctatggcccttcgagaacaaatttgcaggcctggcatggtggctcatgcctgtaatcccagcactttgggagggtgaagtgggaggatcatttgagcccaggagttcgagaccggcctaggcatcatggagaaaccctgtctctacaaaaagtacaaaaattagcggggcatagtggtgcatgcttgtagtcccagctacttgggaggttgaggtggcaggatcacttgagcttgggagatggaggctgcagtgagccgtgattgcaccactgcactccagcctaggcaacagagtgagaccctgtctcaaacaaacaaacaaacaaaacacatttgcaaacctggttaaaatgataaggagttcgacaaagcttacttacgtctgttgactgctctgcccaactccgtgggcttttccaagggtctgagtaggtgcatcaagctgtccacctaattactcacaccatcctacacattatttgtcacttttttgcatgtaagcaccaatcccagttgcttaagcctgcagggggcatttccttcagtaggagatgcagagtgtaaaaactccaacccatttgcatcttgcttatttcaggtacatttcctttcctgtttataattccaaagtgtggcttcctatcatgccttttaaggaactatctattcccattgactaggagataaatctctgtatagtggaggaaccaaactgaggaagacttctcaaaattgttctttttatcatacacttttttggaacgaagtttatagccaactaagaggcagtcttctatttttaatctgtgatatttctgtaaagtcatgtaaatgtcataactgcagtgttttcaagttgttgttgtttttgcaaagagctgttctctgcagtgagggctgagtgtgacttgttaaaaatgaaattcacatagcatccgtttcctccgttagcttctttcacttaaaggacatcttcaacatatcatttaagggcaacacttggttcatagtgtttaatttgttgtcaggaatgtcagcctcagaacttcttaatatacacacccaactctactgtaggtgcctatataatttacatttaacctattattttattttattttattcatgagggtgatcttaggacctgagataaatttgaacaggatcaatacaaatcaggctatgtttaaaccaggaagcagaattaaattctatttttcttgtatttgggttttgcaggaaatggggcatcgtgttttctcttttgaaattgtgtttgaagtgatatttgcatgaagaagcagcctgttttctattagactggtaaagtgggaatagtagaaaagagaaaggcgggatttgggaaatgtgacatgaagacgttgttaaataaggtatgcgtataactaaatgtggcaagaacaatgctacttagatacggaagctgctaaagtattttaatgttctctttacaaaaaaaaatttaagaattttaacatctgctagagctcaatctagtctgaattttttttctcatctgacctttttcatttttcctttctcaaacacacttgctcatttaaaaaattcagttggagaaccaagtaatatgtttccatttaagaaagccacagataaatattgttccatttgaaactacagcttcactcacttgatacttgtatgactattttaagttccttttaaaaaaatggctcaaatttatccttttgggagggactggtgaaaacgtctgcaggttcatcttggtttttaaatttttatgtgtttaattgtggtaaaaacacataaaagtttcatcttgctttcatgtttgcttttaaggtctgagaatattaatagaacaaaaggaacacaacagcattccaatgaccagtgagtgtagctgttcccactgtgtggttatattgtttttttacaagcctacatatgtggctttacctatattttaatatgtgaattcatacagtgtaactataaagcattgtgctcacttagtggcacagagaggttaagttactgactgggggacatgcagccctcagcacgaaattctgggatttagccgagaacagcctcactccaggatcatgctgcttctcagagtttgctagcttgcattgttagagtgtaatttctggaaaacaaggccatactggaatccggaggagagaaagatggcttacactgggtatgagtacagtgtagttgagatgtgcaaacaagatgtaggtaagataaaagaaaatgcaaactaggccgagtgcggtggctcacgcctgtaatcccagcactttgggagactgaggcaggtggatcacgaggtcaggagttcaagaccagcctggccaaggtggtgaaacccccgtctctactaaaaatacaaaaaattagctgggcacggtggcaggcgcctgtaatcccagctactcgggaggccgaggcaggagaatcgcttgaacccggcgggggggcggaggttacagtgagccgagatcatgccactgcactccagcctgggcggttacccttttttggttgtttttattttttattttaagataggtcatgtggtgtaacgggaagctgatgggacttagggtcagacgacctgggatcattcctggattccaatctccctggcaatgtagtaaaaggtctccttgtctttgagatgtcgggacggtgatgcagtgaggggcagggtgttagggaagactaaactcatgtaacacgaagcatgacacgtgtcgcgtgtgtctctttgtaccacaatatccttggacatacatattcctgacctggtaagatgagattctgtatgttttttgagacctcagcatcccatgcccagacactaaagtcacaggggaccatcagagtcccctagtagtttggaaattctgatcaccagtcagcaaagatatttgactgttggaaattttttaaatggtgagctctctttttctgtttcaagattcggtcatcctttctaatagtagacacggaagtctttttgacaaaggtaatgctaggccctgcactggctgacactccatgcagtgtactgtccttccatagcctgtgccgttagtttacagaggtcagtagtacctgcccgccccacagggtttgtgtccaagtgcttcatcgtggtagaagtggtttttaatgaaacaatagatttcttggtcttgcttcaagtgaaatccctgaagtgtttgctttcccgatgatttcatgctgtaaactgcctatttgtggccatggcccatgagcataaagcagcatcattgctattcaggcacataaaagccagatagaagaaaacctcactatttagccatcgtgtcagagagagccaaactacatgtctttctgggccctggtttttaggggattgaatgtcacccagaccttgagtcttagttatcagtgtcgcatatcaagaaaggacactgaggaatcagaattcttacaagggtggcaacttttattttatgaattgaaaaatattcctattcagcggctgtagtcacacaaaactaggcctgatgtaaggttccacacttttaaaaagcattgtatatatttaactaggattctgtagtcatttatattaggaatattgttgctagttgttttgcaagtttccagtagctgtaatgcaactagggaagcatttacatattgaaggcaggagccaccaataatgtacggattttaacagtaattagggtatctgggaattgcacaggtttcattctcgaaaagttaactgaattgcacagatcaaaagtgaaattgattcactcatctaaacatgcactctgttgctttcttggtgagaggaatgacccacctacttggtcttcatggagctcggtctcctcatctataaataatatattaagtgttgatctaagaatctatgaatctgaattttacataatgagagagatgtacatgtgagtgaaaagcaaaaccctgtgataactcatttttgttccagctacaatattgtggactctgtggactaactatagccaagacttatctgagtcaggaaaaaagtatcatagaaaatccaaaaattaattgaaggcagttgtttgtaggtacagcccaagtgactgcataaatttcacaccaactaaaagtgttaaagagtaacaagatgaaggggttagaatgatttgtgatggatacattgtgcattggaaattgtttgtaagacttccccaataattgtgtttcagttgcccaattcctgtttattctcattgtgcagaagtaagttactactcccttcaatataaattagtgtaaattgtgaattgctttcgtctaaaacaatgagagcacccaacatgaagccaggacttggggttcaaatcctactacttgttacctgtgaagccagcctagattgttcacttacactcttcagaaagcagcctctttatctacaaaatgagaataaacagggctgatgtgatggttcagttatataatggacataatattaaatagactctttctttctgaatgggaaagtgaggagttactgtatttagaagatgcataaccagccttgctgttcaagaatgttaggaatgaaaacagttgatatgtggttctcatgactcaattaaaagatgctatgtttgtgtaaaaattaagaatacatttctgctgaacttgtggaagaagcttagagcagaggctgcctgtgcattaagactgagaggacttggaaagagaagatttttaatgttttccttttacattagggtttcctaactgtggcactgttgacatgtagggctggagaactatctgtgggaggtccttcctgtgcactgtaggaggttcagcagcatccctgggcgtcccccactggatgccagcagcaccctctccgtatggtgaccaccataagtgtctccagacattgtccaatgtcccctggggggcaaaatcacgcctgcttgagaaccactgaaaatttccccaatataaacatgcattacttctgtaattttaatagcaacttaaaaaaaaagatgtcatttccaaactgacaaggctagtctgtacagcttcacatattgaagactcagaagagttggactttttttttctttttcttttcttttttttttgagacggagtcttgctctgttgcccaggctggagtgcaatggcgtgatctcagctcactggcaacctctgcctcctggattcaaataattatcctgcctcagcctcccaagtagctgggattacaggtgtgtgccaccatgcccagctaatttttgtatttttagtagagacagggtttctccgtgttggccaggctggtctcaaactcctgacctcaggtgatcctcccaccttggcctcccaaagtgctgggattacaggcatgaggcactgcgcctggcagacttggatgtttttacgaggcgttttgggcttgtgttctgtaagcatcagcttaacagaaagtgatgttgcatgactgccccaaagactcctggtggcagctgtgaaagcatccagggaccaaaacctgtgctgaggttgccctcaggcacctgtgggcctgtcagtggggccattctaagtaaccaagacaaacctgctctacttgtggaatacggatcttcttcttctgcatgttagttgtctagggtcaccttgatgatattagtaggttatctgttctactttagtaatgtgttaggagtgcacagcttaatcaatctaatatgatactgctctaaggtagggctcagcaaactactgcacacaggccaactggcttgcagcctgcttttgtaggtagttttattggaacacatacacatctgtttgcataaacacacccatttgtttacagattgccagtggcttccaggtacacgtgactacgatggctgcaaagtccaagatccttgctatttggccctttagagaaaatgtgtacctaccactgctccatggttctggaactttctccccttctgttgccatatctaggtatatctcccatctgttaatctcagtttcagaaagggggaggatagtaaacagcatagccaaacaagacaaattatgatagagagcactgtgaatatttcaactttattcagtgcttttagtgagtatgcgtgtgtttctctgcatatcagatgcatgtaacgtgtaccagagtgtatttattaaaatgcctggctcatgtacttgttcatgaaagaagcaaaacaccatcgttttccttgatttaaaaaaacggtagcagcatttgtgctggagaactttgatagaacatggcagttgcgtgtaggatattggaccagacaggctgttggggccagagttttaagagggtttctctagaaacagaccgtactaggattacatgggaagtgagtgtggaatacttcgggatcgctgatcgccggttgtatgggagtgaggagcaggacggggctcagtggggagctttctggaatgccagtcccgctctttcctgcatgtctactacccccgtccaagcacttccttggctctagtatgtcctcatgagcagggcccatgacttcccggtgttatcttctggataatttaatacagggttcaggatatttgttaagtcccataaaggtgttttaagtgaacagctgaatggcaacctcagtttgatgatgctctgtctcctggaggggcctaatgtctggctgtctccagtctccttctaacagaccggcatcatcgtgtcgtgttaagttcgcttattaattctctaccaaaggcatctgcatttagtgtccaggaatcactcgatgtttcgtttctttttatgttttctttgcctccgaaatatcttccacagattccctaaggacgtgaggaatggaggaagttgtgaaggaggagaactgtaagctgaatagaatacagtcatccctcggtatctgtggggtattggttccaggacccctgtatataccaaaatccagggaggcgcaagtctctgatataaaatagtgtcctatttgcatataaactatgcacatcttcctgtaaactttaaatcgtagattacttggaatacctaatacattgtaaatactatgtaaataattgttatattgtttttaaaattgtttttattgtattgtttttattttttaaaaatattttttttctttctttttttgacacagggtcttgctaagctcactgcagccccttcctcccgggctcaggtgatcctcccacctcagcctcccaagtagctgggactacaggcgtgagctaccacgcccagctaatttttgtattttttgtagagactgggtttcacaatgttgtccagactggtctcgaactcctggcctcaatcagtcctctcgccttggcctcccaaagtgccgggattagaggcgtgagccaccacacctggccttaaaaatattttcaatccgtagatgcagaacttgtggatacagagggctggctgttcatattttcaaagactatatatcaacaacatataatcaatatataacatatatgagatatatggataatatatatatatatattcagtaacgatatacatgtattcaaagtagtaggtttgttatagacagcatagagaagactctggctttttaaatccagtttcacaatctcggcctcttatttattttgctttgatttttattttatttttgaactttttaggttcaggggtacatgtgcaggtttgttacacaggtaaactcgtgtcatggggggtttgttgtacagattattttgtcacccccagtattcagcctggtacccaatagttatcgtctctgttcctctccttcctcgcactcttcacccggcagtagcccacagtgtctgctgttcgtgtctcagccttttcgctggagtggttataccatttaccacttgctctttgttttctctttgtaccacttactctgtgtttcctttttcctcggttcctgtgtgcttttgcataaattgcggcttttttgtgactatacttcacagtaagcttattagcaataactcattgctttattttttagggtgttgctctagtgttgacaattttcatgtttaaccttatcacaatctatgtttgaaagatattttacttcacatataagagccttacaacaacaatgtgctttcattctccttccattcttagtgctttgtgctacatttgccgtatgttttacttttatacatgttacaaacaccataatacgttgttattaattttgtactaagaagtcaattatatggaaaaggattcttttaaagagaagaaaatatttttatgtttatatttactatttctgccacttatcatttctttgtgggaatccacattttccatccgaagtttttcttccccttcatggactcccttcagtctgtcttgtaatgcaggtctacaagaagtgaattctctctgcttttgtttctttggtaaagtctttattttgccatcattctttgaaagatatttcatctgagtgtagagttttgcattgatacatcctctcagttctttaaagatttcattgtcttctgccttgcatagcttttgacaagaaatttgcagtttttactatcatttttcccctggatataacttttgggttgttttctggctgcttttaagagtttgtcactgattttcaagaaattgattgtgtcttgttggggttttctatgctgtttatcctgcttggagtttgtttagggttttgaatctgttttactttccttaactgagagttttacaacttgatttgatcttggaatccttaaaatgcgtttttggtttttgtggtttttttgagacagtctggctctgtcacccaggctggagtgcagtggccgcgatcttagcttaccgcaacctccgcctcccgagttcaagcgattctcgtgcctcagcctcctgagtagctgggactgcgggcgcatgccacaacacccagctaacttttttgtatttttagtagagatgggatttcgctatgttcgccaggctggtctcggactcctggcctcaagtaatctctccacctcggcctcccaaagtgctgggattacaggtgtgagccactgcgcccagccaaaatgtgttttaagtaacatattttatcatctcagtactagtgttttattaatgaacactaaaaccagttagagaaacactgatgaaaaccagtgtttattatttttacatatttttataactccatattggctccttggaccttttagagttgggttacgagaaagcaattgggcatttgcctggtattatgtagagggtatgcaaacacggttagcttgtggaaaagatatcagtaacaattgcctgtgtaaccgccagctttatgggagtgctccagtagtaacatttttgcttgtttcagctataaaagctattaccacaatctgtctctctcattttgtacagtaatgatccatgaacatactaaagggaaattgatggcatacccagggttaccatttacagatggcagtactgaaatgttaatttcaaaaacattcaaactgtagttttcttctgtagacatgggacaagcaatttttatcatttaatcatgcagacttggttttaaaagaaaactcttttaagatgttctttgcttttaatttatagccttctagtttgcttataacatatatgcttatttttaaagaacattaaaggttaggcctaaggaatttgtgtgcaaaattggtcattgattattaagaaaataatatagaacctttttttatgtcataaatacaactttaaaaggaaggggactcttcagagttgcctctgaggagcacatatgaaaaagaagggcagaggtttactgcagtggtaaaaaataatccacctagatcaagactattccaaaagtgaatttaaaaagaaaaaaagatgagatggtaagatatgaggaaataatgaatgcattgtgactttccacctccccatacccattttcatagtttggtgagtagaaagagaaatgaggatgctggcccaattttgattcccagtggatgaggctcacacagaactgccctgcttcttgacactattatgatattaaaagtaacttgtatttttataagttattaccatcttggcacacttgcattcattttagtcaagtactgtcacctttagatttcaagcttgcagagtcttaaaaaaatacacattggagaacacatagtcttttaacagtaaaatctcagcttattagaatgtttagtgactgaggtattcagagtcagtcagaaaagtatctttaggatttcagcatgtggagatgtctttcatagagaaaccggggagagtcaggcaaaccctagcacgttgagcatggcgtatcctcatctgcacgggcacttagacacctggacaagtccattagcagtaaggcaggatagaggggttcacaggatacgtgctgcccaggatacgtacgtgcagcccagagctgggaggaaatcatgaggaccgactagacatttattgtacagatgcatgactggctggtatggcctgggatatgtcagtgaagatacaccgtgaggttgtgggaggtaggattcacagtaaatcctaaattcttcatctttgcactcacgacgcacaatagctgatcaaagcttttagcaaactgcagcaaatgaaaaggcggcagaacctcatggtgacaaatgcaaaccctggagtcggactgcaagcattcacaccccagctccaccagtccccagccctaggacctagacatggagctgcatgtcagtgtgtccgttccctctgtgtgagaacgggatagtaacagcgctccctcacacgctcctgtacacatggaaaccaccactgccgtcggacacagtgtatgctgtagaagcacttatggtactaagcacattaaatatttaaaattattaattagattatttaatccaagctcaaagctctcagaacagagccaggcatgtaacaggtacaatatacatgttagctattattattattatttaatagagatggggtcttgctatgttgcccagactggtcctgaactcctggcctcaagtgatcttcccacctcggcctcccaaagtgctgcaattacaggcatgagccactgcgcccagcctattattttttaataactttatgtaacccggtgttgccaattgttttgaagtgtggagccgtttttcagatgacacatactaaacatctactaaacagcctgagaaacggcactctgaagagcatgccttggcaaacactcccctacttactctaaaactccagtcgattggcttccaagttcacttggttctcatttttcctggcaacaactctgcaaattattacccccatttgatgaggtgctggctgagaaggccccttgcccaggtatgtttccgacctgcctgtgacaaagtgttagattctgaaagccgggagtgctggcctcggttagctgagtgataccagcgtggggtctttcgaggctgcaggcaagatgtccgcccacctaaaggcaggatgggggctggaggggccgtgtcccggcgcctccttcctgtggctgctgagttggtatggctgtaggcagggggcctcagtcagtgttgtaccgtgctggcctcgccacgagcacccgaaggaattttatcatacaaatttgattctgttttatcaagagatgccagtagcacctccacttccagttgggacaccccaaaatatctccagacattgcctaatatcccctgggagatggcggggggtgtggggagggggcggcagcgggcactgtctcccctgctccagaacactgtattgaaatacagaaacgtgatgccaatcccatgcttttatttgggattaaatgtgtaatccatatgcttctgagtgggaaaaaaaaaaacttggctccaagcagaaaatggtgcatcctttgttgtcattgggcaaatgcttggtagggatttgatctgtgtagaggaatgctcagtctgcagtggcagccaggtagtgagcatgtgcggccctgcacacagcatgagcttgtcagacagacagtgcttgccaagcagggctctggcatgcgcttgttgttggctatggctcttccatgggcaggctcccggctcctccttgtgcatccatcccctttgttggccaccctgcctgctggccttaggccttctgctcctttccccaggtcctggctctctccagcttggcctccctccgcccatcctgtgcacctttcattcctgggtaggaggagactcaggtaaagaaggataaaggcagaacgatgccaggcaattccactgctagccattgccccaaggacatgaatgttcatagcagcatggttgacccaagccaggttcctgtcagctgctgcctggaaaaacacaacgtggttcagccacgcagtagcatagtattcagccataaaaggagtgaagccctggaacgtgctacaacatggatgctctgggaaaacatgctcagtgaaagaagccagatgcaagaggtcacatattgtatgatctcatttagtgccccaaatagggaaattcatagagccagaaagcattctgtggtcaccaggcctgggggaggagggaatgggagtgactgcttagtgggcaccagaactcctttccaagtgattgaaaatggtttggaacttgacataggtggtggttgcataacatctgaacgtaccactaaattgtacactttaatttggccaggctcagtggctcacacctgtaatcccagcactttggaaggctgaggcaggagcatcacttgaagccaggagttcaagaccagcctgggcaacatatcaagacctccatctctatatttaaaaaaaataagaatttttttaaaagaaaaataataaaatggttaattttatgttgttacttttattccaactgaaaacaaagcaaaacaacaacaacaacaacaacaacaacaacaacaacaacaaccatgtatggtccaggggaatgtctatgttgggcctgaggtgtgctgttctggtttttcttaggtgaatgggttctgaaggctgcatcaaaagaggagtctttaaagttgctaattctttcctgataggaaaagaatataatttctcaaaatgactgctttcgaggaatgcccctttctgaatttgaaaacatagtattaaaaagaagagtctctcagtgctttagattattatttcttgtattcgatgtaaaaatcccttacagtggttttacaagtctgcagaggaattcacaaagcacgattgaaaagtgatgtacaggatttatagttgaatgggaacaaaccagctgatctgcatataggatgaaatttagctgagggtgctattgagtttggacaacatttggctggacctttgtaactcttcagctctatgaaacaatagttgtgtgaagaattaaaaggtggaaaatgaactgtaggtggctggctcacatatgcctaggtctatttccagacacagcgaacagtgaaatgacagtgtcggtgaggcaccagttcaaggaaatacacaaagactgcctactcataaatacagacacaatggggtgataactggtgcttgcacttggagatctagaattctaaaacatcggaaaacaatagcagaccattctgtgtccttttctttaaaactatctcttgaaattttcgtgcttcccccaagaacatcctcaaagatgccagtaaaaataactccacaggaatctttctgaattccaatatccatgtgaaaaggctgcattttattctgatttttcacaatagaattaaggcagacatgatgaagaaatgaatgtgtagaggacttccgaaatctgtattaacgtgtgtgatcagcaactgtaatgttttgattgattatatatggtacatctttcattcattaagctaactttaatcaagtatgtgttatgtgtcaagcctggactgtagaaatgaacttgaagaagaaaggactcttcctcctgttcgggtagaaaaggtataatgcgtgttatggatggtgtgaccgaaggaaacaccggataccatgaggaaaattgagatcatcacccagggattctgtattctacttagggaataggctaaacatcaaaatacagcaatttgagacaaaggcaggcggtagtcccagaagggtaggtgtcaaatccccaagagcatcggcggatccaggttcctgttgtgttactatcctgccttcctaagggtcagacaggctctcaagcaacccccatgaccacaagttgtgcacatcctttcccagctcctctcacctaccattggcaagaactcagtagtggaacacctggggtctcttaatgaggtgtgcttgtgtgactaaaagaaaaagaaattttgggggaggagcaggctggtggatgtgcagtttctaaattatcttgtattttatttgattacagtgtttgaattcagtgttttgaagagatgtatgtagcactgcaagctctattctaacctactttctttggagaagcaggtacatgctgtgttgtgtcagcttagagagccccttcaaaacctctccatgttcaatgtggagggactgtcactatacatgcatggcacaccacaccaagaacagagggctaccagaaaattagaatcccttttatatttgtcacatatcagcatttatttagctgtaaaaataaacagcatatggcatttgttaaaatcgtttgtatttcacacaaatatttggcaatatgtaaactttcttgccagggctgtttattgtggttctatttgcatactaataatggggaaatcagtaatgaccaggtgttggaaggtctgatttctcatttaaatgtattgtttctagcaataaactaattatttttgacatgtttcataaccagaagaatgttattaaccaaagtcataattcctatttttgtgttgatcacacacagatgataagttaattatacttattgaatttaacaacatatataagagataatctcaaatttcaagactctcatttgtgggttaccatctgttttggaccaaagaataggaatttgattgcaagctttcttctgaacagcttgtaataagagctgtttgtatattaattacttattgaattattgtggattttaatgttttaatttacaagcaatttggaacttattgtggtgacagctgctcatattttgatactttatggtatttagcaatttcatcataaggctattttttcccctggtaatttataacccaatcctgaaaacagtaatttggtctctccagctcactataaggagtattgtcctgtttcatccccactgcagatttttttcatagttaaaagtatattttataagcaaaatcaagattcctttgtgcctgcttccctggtgccctttcatttctattcagagttacagatgaatttagtttcactctcattattttacttcagtggtagattttttacaaattgccctggttattactttcatcttgaatatccttatggtttttgttttcaatgtactgtaatgcactttaggggcctgtgaacctgcttgtaggtttttttttaatctccttcctttaaacaacataactataaacatgactcagtgggaataatttgcttgaatttccttaaaacacttgagtttctatataaactccctaataagaaacaccttcactcatagcttcacttgtggacttcaattatattaaacctggtacctttttattatcactgaagactattaaataagaatttagagaaaatggtggacatttaatttccttagttcttgaattcgtagatgatagaggataattgatactctctaggaggcaggaatcattcacaaccaaagaaattttataaggtaaatatcattaggtaaatggtttactgattagtgtttatagtgactgagaaataaaaacaatttttgatataaaggattatcattttatgagccataaacctggcttcctcataaatcagtgcaaatggaacacttgtgaaacagaaatgtctgaagagtaaatgaaaagttgagacgttagtgggtgcctttggttttcttgattttagaggagccggaggagaaaggattctgacccgtttgtgtgtttttatgagcacagtacatgaggatgcatatatgcacacaaatgtgcctggtagagttattggaaagctagcccaagcgatggggaatgtttagctaaagcgtgttgtcttctcccgagggtgtgcacaggttcatgtatcagctgaataaggccctgttccaaaaactgatatttcaagggaaccttaatttatctttaaatttaatgtaatttaaaattaatttaaatctttaaattatctttaaataatagcagtagcaatagctgagctaacattaattttatctattttgagactcttttatttcagaacttctacatgcataatgcctgaccggccacttttaatttctcctttctttcactttgcaaacaaaaccttacaatctgtgctatggactaagacagaaattaagaaccaataaaatgtgttaagttttaattaggaagaagaaaaaacctaaaggaacgggatggttgagaggtaaacacaccccaatgatttttaagtcttttgtttcaaacctttccctttctccctaggctggtccctgcagacggcttcccatttttatgaccggatgctgggaagcctgctggtccacaggtccatacatgaagtcaccataaggtaagcagcccagcatgccattggatccttgcccttgtacctgaaatccgtttgaggagcagaactgcattttcccaaaatggaaccccttctgttttaaatgatgttgtcaggggaagtgcccggtctttctccttactgaaggttgaaggtagtagacagacaatcattaaatcattgcgagctgcatagtcaattccaaatgagaaatttgcctttttactgacttctgagaattttgggttgtgtttttgttttgttttgttttgtttttgtttgtttgttttgagacagagtctttgctctgtcacccaggctggagtgcagtggtgcaatctcggctcactgcaacccccgcctcccaggttcaagcgattctcctgcctcagcctctcaagtagctgggattacaggcacctgccaccacacctggctaatttttaaaatagtttcagtagagacagggtttcaccatgttgtccaggctggtctcgaactgagctcaagtgatccgcccaccttggcttcccaaagtgctgggattacaagtgtgagccattgcatctggcctgccttctgagaattttggatcctgaaggagctataacaaatttttctgggtcttaccaggcgaggatgacaccttctaaaatcaacctctcttgtcaacattatcaattacaattatgcagacaagttaattataattgggtgcatgagtatagattttatttggctcctatatcttaattctatgctttatcagtttcttaatatgatttgtgtctgtctccaaattgatttgctagttaactttgaaacttattagaaaatcatggagattactatgtgtaaatctggtgagatgctaaggtttcctgactagcacaccaaacaattgtatgtgcacaggtgtcaagagttgagaagcccgtagcccaaactaaaactgagacccatgccccaaaagttctgtaaaagttatcttactacctttcggtacgtgtgattttaatttcactttacttaattgttatttaattttctgtttctttctctaatgcctttttagttaaaaaaacaaacaaacaaacctgtagaacttgggcagttttaaagtgtaaagatagaattttgaggaagctttttgatttactattttaagagaaccaactagaactaaaatgatagacttaaatttaattaaaataagcagcttactgtttgaggtacttttgtttaaagccagacatatgcatatgtaggttgttttaacaagttaaatatgtataagtattttaatgaaaggtgtagtctgtttataaaaacaaaatttgtaatgtattagtgaatttgaattttctgactggctttttcactcagtataatgttttcaaggttcgtgtgcattgtggcatgtgtcatttctttttatgtcagaatattccattgtgtggctagaccatggatagaacatatttgattcatgcatcagttgatggaaattggagttgtatttcccttttggttattattaaaaatgatgtcatgaacacacatatacaagtttttttgtgtggacatatgtttcatttctctgtggcatttacttaggagtgggtcatatggtacctctgttgaacattttgaggaactgaatttttccaaagtggctgttacaccagtcaatatttttcgaaatgccattgaaccatattttaaatgtcagagggaagcagggaggggatctttctcttatcaatgttttgagtgggtattagttcagtactttgggaacataagcttcaatttcattgaatccagcacacattggatttctcctctgcgtgaggtatctgtgtttggctttatacctcagtcatttatacatgactgagtgtttttgtagcctttgataacttgtatggtttatacatgcagatagtcatttggcattatcctcaaaaatggtactctattgctgtagttcattagtaaggttgggaataacctacataacatactctttctgcctatgctgcgtgctgcgtctcagaaagtgagggcttctaacggtttccttgaggtgtgtgtggtttcaacacatgtcctcctttcaaaggcatccatcgcagaccctggtgatagtgttttttgtatctcagtcttaaaggggttggtatggttatgaggaatgttcacattcaggggcgttcactgttgaagttctcaggcaggaagattccaagccgagaagggactaggcagtccgttctcggatgtagaggtgggaaaatctgtggtagagcaggaaggactgagagcaggctcagcaagcatgttctgtgatgggcccgatagttaggggcttaggcttcgcgggccaggcggtctgtgcggcagctgctgtactctgccattgcagtgtgaaagcagtgtaggccctacagaaatgtatgaacatggctgagtgccaagaaaaccctatttatagacactgatactgggttgcagtttgctgaccctaacctagaggaacacaactgttttctttccaccttttctaattgtggccttttgagttggaggccacctggaggtgaggctccgagaggcccacccaagggccatgatgtgatgaagacagactctaaattgtgattacgtagcgaaggcactgcagatatttgggggtcaggacttttacgtaaggaatttgagggcctttctgccacataagagggagtggctctgggcctgtgtaactgccctaacttgggttctcaccctgggggagtctccacccccaagataacctgggaatgtgtggagacatgtctggttgtcaccactgggggagtgggtgctactggcatctagtgggtagaggcccgggatgctgtcaaatgtcccgcagttcacaggacatcctccccaacccctaaatgtcaaacgtgaggagattgaggagtcctgctcaccgctgcttctgtcagccctttattttgtacttgttgtcagtcatatggctgtggaattataggctatggggcattaaattacaaaatttagtacctgtgtttgctgacataagtgtaaggatggttggactctgatctaatatttgggttcatgatgcttttagttttttccttttttaaaaacgtctttgtcattcatttaaatataagcctccaaaattgatataggccaggcacggtggctcacactttgtactccctgcactttagaaggccaaagcaggaggatcacttgaggccggaagtttgagaccatcctgggcaacatagtgacacccccatctttacaaaaaaagtaaaaacataataattagccagaggtggtaacacatacctgtagtcccaactgctcaagaggttgaggcaggagaatcacttgggcctgggaggttgagccttcagcaggctatgattgcaccactgcactccagcctgggcaacacagtgagaccctgtcactaaaacaaaacaaaatgctgatataacactaagatttatatgagatccaggccacattgggggatggggcaccgcctgcctttcgaactgtagggtacgcttcagagtttatttttcacaacttcacaggccacatcatatgtgtaggtgaacccactgctgactccatctactgccagaaagagactcatcatggtcaaattaaattcttcatatgtcagtgaaaaatcagtgtcttagagatatcatgaccagagtgcatgtattcctgaaatttgtttgaaggcccggtgcacattgtgtagaaactgtgttcagtctatctaaaagataattaaaatccataaattaatttctggctggaaaataggtcataatggatctggatatcagaagtgctaggttaaagaccacggtcatcaggaaaataggatgagctcctgctccgtggaagcagtagcatcagtgccttccaaggcagtctgctctgaaatcttgggcacgtgcatctgtgttgaactgtggccagaggaggagaggatgaaagggaggcagtgctctttttcttacatgcattgtccggctcatgtgatgtgggtttccctggtagtggcttgctcttgctaggtggagcattttcaagagggcttccttcctgtcaccatagcatctgccgttgacgtgcatgtgggctttggatgaaagccccagccagccactaattaacccagaagggtggcagggcacagaaaggaccttttctgaatgcctcatcatggggattttttcttttcttttctttttttttttttttagatggaggctcgctctgtcatcctggctgcagtgcagtggcacaatcttgggtcgctgcaacctccatttcccaggttcaagtgattctcctgcttcagcctcctgagtagctgggattacaggcgtgcgccacaacgcccagttaatttttttgtatttttagtagacatggggttttgctatgttggccagtctggtctcaaactcctggcctcaagtaatcagcccgcctcagcctcccaaagtgctgggattaacaggcgtgagccaccatgtcccgtcagggatgattttattctgtgaaaagcggcattccttttctaacacaaaacctctcctctgctctgccctcccaaccctgtagcctcatttcctatatagttgttttcatactgattatctctgaagacattgccaggtcgtttttgtttgttttgagacaaggtcttgctctgttacccaggctggagtacagtggcacgatgtcggctcactgcagcctccacctcccagggtcaagcgattgtcgtgcctcagactcccaaatagctgggaatacaggggcatgcctccacacctagctaatttttgtattttttgtagagatgggtttcactgtgttgcccaggctggtctcaaactcctggactcaagtgagcgaccacgcccagccgacattcccaggttttctttacgttttaataaatatgagtagtccatgttcagagtagaaactatacaacgtgtagaaagatacacatgcaattgggagccgtgcttttcccacacagtcccctgtcatggacattgcccctgcctgaaatgctgttttcctggccgcatcttatgccactagtttattccatatttaaatggaggcgtcactgctcggcattggaactctagtaacgaagaaataattctttgattatatttaccatttcagaccattgactccaagtaaataaatataaccgtaaaactaatgggaaattttttactttgcggggaatattttcgtactgaaagtattgtatatctgattgtgggtaaatggagagaagtgtatgaaagaaagcaagcaacataaaatatttttatgcatttctccccaaacttttcctctgtatgtgttttcctacaggtttgggtcaaactgtaaccttgttggccctcttttctgttttgttgtcgccccctgccacccaatttgggacatatcataaatatctttccattaacctagctttgaaatttttaacttgcactggaagaccacagcgtttaatgtcaaacaacgtaactttaaatcctagcttcgctgggatttaagttggttatcttccctaagcctttatttgttaaacctataaaatggtaataagagtaatggtcatatttatctcttggagttatgactggtgagatcgatcgtatcgtgcacatagcactcacacctgatagctagcatacaatccatgccgtgtattggtttctaaaatcatcttcatggcggcctgatagttcccatatgtgttcactgcaatttatttcatcgtgctgtcactggacaatgagattgtttcgagaaccacacattgtcttctttacaattacataggatgaaaagatgtgcaaagtggtaaaacaagcctgtgtcagcccccaaataagctgctccccaggcagatgttagaaaaggtgtattgggatttatatgtaaactttatacatacatttaaaattctgtcttaagctggttactgattgtgaaatgaaaataaactcagtttacatctgagcagagaaaagagccgctgcctccaaatgggcagagtttgctcgtttccatgaagcaacttggagaaagaggtgccctttagaggctgaggtcagttcaagcagatcttccagtgaccctggctcggtccagtctgcatggagacaagccccaaagacctgagccttgtccaggccatccctccaagcaatggattcttccagcacagacgccaacagcctgactaatagcagcctaactaatgacactcactttctcaggtgccttcagaaaccaagggctgctttagaagatctttaagatgtttacataacagggcaaatggctgaaagataaagcttcccctccagtgatgtcagaggagctctgtgcgctgcccttcctacaatacacgcccccttcatcagctcgtgcttccttcgctgtttcagaacacggctggcctcttggcaagaaacgaacttgccctttctgtccttaactaccagcaccagctctccagcaggccccatgtgattctactttttaagataattaaaacagcaattaagattttgtttggggccagtgttctcccacagaatgatggcatattgagtgctctaactacatactcaatgaaatgaaactcttaaacagccatttctcctgggaccgaatgctgaactgttttgtgaagggaactgcgaattaataggacttttggccaccttgaaaccaaggcttaaaaaaaaatactataaataatctccccttcagcttcttgacggctctaaaccccaaattatcacttatattgaattacttatctttagcagagaaacttcaaaaatgccatcagcccatgctcgtttgttcttctttgccttctttaagcagcacagtgagagaatgttgtggctttaacccaaagtggaaggtggttatttcgtttttgcgcaatcacaactccaaacacctcaaatcaacctaattgaaggtgtctttaatcaaagctgggtcaggcaagaaaataaacacagttgctctaattaagactcccctctcatccccctcctgtttggggccaaggaggagctgtgagtgctgccaaaactctcctttattttagaactggagaaattggaaaacatccacaggagttctcagaactcgaaggctggaagcggatgctgttcgggaaaccggttaggtgttagaatgcggcttgtgtctccagctgtacatactagaaaagaatgcccaaacacaggcctctggtggtagttctttttggttgggctttatgtgtgccaccttgcctgcttgacattgctgatgagccaggacgaggagtcgagccctgagtggtcatgggcgaggcaggtgtgtgtttccctgatcctctcctactgacctttcaggtctctcttggggaattgctggaggagctaaaataccagctcccacatactggatattttctgtgcatcgggctctgcataaaagcattgactcctcacactctcccctttacataggggctatttgatactcagtttagagataaggaaacagccatataactgaccctccaatcccagggctagatagtggtgcagctgcccctagaagtcagggtctctggcgcttggccaaaggctccctgaatcccacatctttacctgttctctgtggctctcaggacgtgagctaccttatctctagccaataagcctatacggatggggactctcaccctgatttaccctaactttattgtaataaagtcataactgtcataagaagtaatagttgcaataaaaagtagtaattgtaataaagcatgaacattccaaactccatgttatttgtccacaaaaatagttcttggcacagaagacaaaggcggactttttcccacagaatacatagctgtcgatggcactttgctttgaaccttggtgtagagggcagtcctcatgccctgggctgaggggtgcatgtgacacatcattaaaagtcaaaaatcattttcatagagcaggtcctccccacatgtacacccagagctcctgtgcttctctcctctttctctgacttcttccaaaatcgtgggtcttgtctccatcagtcaagaatttaacttttcttccaaaacatccccctcctcttctgtgaaggaaggtgcttgtggactggccttaggaaatgtcgcccagacaggaacggcacaccagtgtgccatcactcaagccagaaatgaggtttgcagtgaccttctctgtgcttgagagttctgctacactacgaataccactataataacagcacatttatttgtgggaaattaaacagcaaagccctgggtgggagatccataatttaccatcttcctgtgaaatttagttctggtcttagaaaaaagaggaggaggaggaatttttattcccagccttgtgtgtggtgaggtttgtctggaacagtggttcttgcagaggaatactggccaggagactcacttgagtcaaaaaactgaagaagatccatgaaaacaaccaccaccttcaagtgagccacttagagataagcgcagctaaacgccgggacacccagctgatggatggtttctcttgattttggtgtgatgaagcccacagagctgaagggcattaaatacagctgttagggttaggagtccattcagagaatattctcatgcttgtatctaataatctaagaatatatatgtagattctacaatttttggaattaggttttaaaagaaaaataatcatttaaaagctagcaaagtaagtgtttgttgggggagaaaagtttgatccaaatattaaatcagtcttaaaaaattaaaatatgtacttgagatggagcagtcagtcttaccaaacattacatcctggctcgattgcaggccatggatagtttttgttttgttttctcttctgcttagaaatcaaaaccctttagaaagttaacaatgtattggggaaagcattccaatccttggaccctaacttatacatttaaaaacaatgaatctgtgatcagaaagcagaaagccagagctgaagcagaagtttttctagttggaagaaagaaagatgtataatgcaaattagaggaacagataattaaaaatggcccgtaatccccatctcctcaggatcttatattctcattctccatagttctatataaacacatgcagagacacctgtatttatcacagatgctcctggggtggggaatattaaccaggctgtgtatacaggtgtttcatctccacgaatcagagtatctgctcttattttgaggcaagatctcactctgtcacccaagatctcactccactcactggagtgcagtggcataatcatggctcactgcagcctcagcctcctgggctcaagcaaacctcttgccttagcctcctgagtagctaagaccacaggcatgtgctaccatactttgctaatttttaaaatttttttgtagagagggcatctccctatgttgccaaggctggcctctaactcctaagctgaagcaatcctcccatctcagcctcttagagtgctgggattacaggcatgagccattgcgcccagctggtaccttttcagtggtcaggtcaccaagcagcgtctgagcctgcaccagttgccttactttataaatggagttcatttcaaacacaaaatgcttattttccctctaaagagcaatggttctcggccagctgcagttttgcaatgtgggacatttggcaatgtgtgcaggcatttttggttgtcaccactgcaaggaggttgggggagtccaaggatgctgcagaacatcgtgctgtgcctggaacaggcttgcttttttttttcccccagagtaaaagaggaaaggagctaggcatggcaaacaagaagggcagctgggaagctggggtgtttgccaggtcctgccagacatagtttcctctctgtgcctcagtttcctcatctgtaacatgcagagatgagatgccctccaagattggtcctttccagctgccctcactgggagggggcaccgtgccctgcctcccaggctgactcgtcctttgtaattctcttcctttccacgggactccagattcatgccggtcccactagccctgttgccctgttcctaagcctgtccagaaatccttgggactaagtgaggctgaagctatagcgctctgctcttcctacctttttaagaggtcttacattgtaaaacttcaatttttcaaacactcactggctcacagaagaaaataaaataaaaagctgcaattgtgaaaatgtaattgctcaactttagctcatgctccagatcagtgattttctcttttagccaaacttctttataattatttcctttatttttataatagattcttcaaaattaatttcaaaattccttatctaccgtctttcacaaatgtatgtatagcctagagaattttggtaataattttgtgatacatttatattgggatttgtagctgccagcctttttttttttttttttttttttttttttttttttgagaaagggtctcacttccgttgcccaggctggagtgcagtggtgatcgcggctcactgcagcctcgacttcccaggctcagatgattctcccacctcagtctcctgagtagctgggactacaggcgtgcaccaccacactcagctagttttttcgtttgtttgttttgttttgtttttgtagagacagagttttgctgtgttgcccaggcaggtctcaaactcctgggctcaagcgatccgcctgcctcggcctcccaaattgctgggatgataggtgtgtgccactgtgcccggcccaagccattttttcagtccattctttttgctcctcctagtaacccttcgtagcaaccagccttccattgttcagtcaccagaagttaatgatagaaaaccagagatttctagctgtgcaagatgtagagagaaacctaaactctatacatttgctattggcactgtgttgccatagtcactgcagcactcagcatcaccaaaagcctgcccagtgctgcaacattctttagatagatttttgttgttttattttgtctccttaaataatatttaatttttcattaggtcatgctatgatttcatagcttattttgtctctaatattttcttctgcatgctgtcttttgagagacctctccagagttcaagcacaaatcctaggacagacttgtattttgactgtcaaattttcattgcagtatgtgcaaaagtacagaaatgtcatcaaattaagcaaagaagataagaatttttgaatggcagtgttctggcaactataaaataaagtctattaagagtgcaaagtgagaggtggaatgtcgccagggcagctgcattcattatctcttgctggataacagacgaccacacgtttagcagcttgaaacaacacacattcattctctcaccgtggctgcgggtcacgggtccaggcacagcacagctggggccagtgctcagcgtcccacaaggcttggtccgggtgtcagccaggctgcgctctcctttaagctcaggggttttcttccaagcacaggttgttggtagaattcagttcctgtggctgcaggactgagaccctcagctccctgcaggctgcctgccattgcctggacagatcatgcaatgtggtgttaataatcacaggagagaaatgtggtcaaccttgccatgtaatgtaacctaacctagggagtggtgccccatctccttgacgcattctggaagcaagtgacagatcttgcccatactcaagggtcgggagtataccagggcaggactttgtgggggtaaggtatgtccctggcagtaaccattactttgaatcctcccattaaatgtaaaatatcttccaacttgaacatatactttgtacttttctccccctaaacaaacaaaaactcaatcctcattcaacaatgaaagttttgctgcctgtaaagatacttgcaaatgtgtgatatagacaccaaagacagttcccaaacagcctaaagatgtttagtgctggccgggcgtggcggctcacgcctgaaatcccaccactttggaagtctgaggcaggtggatcgcttgagttcagaagctgaacaccagcctgggtaaaaccttgtctctacaaaaagaaccaaaaaattagctgggcgtgctgatgcccacctttggtcacagctacccgggaggctgaggtgagaggattgcttgagcccgggaggtggaggttgcagtaagcccagatcatgccactgctctccagcctgggcaacactgcaagactctgtctcaaaaaaaaaaaaaaaagaaagaaagaaaaaaagaggccaggtgtggtggctcacgcccgtaatcccagcactttgggaggctgaggcgggtgggtcacgaggtcaggagatcgagaccatcctggccaacatggtgaaaccccgtctctacaaaaaatacaaaaattagccgggcgtattggcgggcgcctgtagtcccagctactcgggaggctgaggcaggagaatcccttgaacccaggaggcggaggatgcagtgagctgagatcgcaccactgcactccggcctggcaacagagcgagactccgtctcaaaagaaaaaagatgtttagtgttggtgacatcattgacgttagttgcagcctttctggggctgcccagctgtttggagtgagcagctcttactgatgtatgaattctggtttgttcatggacaacagagttctttccttgcttgttccctttgggctggtttgctcttgtgtctaaccgggtggtgtctaagaaaaccagactctgtcttggctgtctcacacagaagcccctgaacgttttcctgcccatcctccctccccagatttctgcctgccttctgggcaccagaagtcttagccagacggatgcagcggattctgtggtgaaacacaaatgacagaggtgctccctgccttctgtgttctggttttccaccaggagccctggcctccttgcagaaacatcgaggtgacatgtagcatgaccgagctcgctggcgcctcttcatcgtgctgccaccgccctgcaggaagaggggccatgcagtcagtcttgcaccactttcaacgtttgcgagggagaggtactgcggttcctcatgtggccaggaccgtgtggtcactctttgggggtgttgacatggccgcgggtgtactcggtcacctctccatgtgtccagaaaagtgctcagtgttgaatccctccacgtctgcctgagtgcactttgggattccattcctgccgcttatggggcgcgctgcggatccctgcatgcacagagctttattgaacgcaaagtcagttgtttgttgtcgtgctctgttgcccctgcttctggcttcattcatgtggtttttgctcaattcttccccggccttaggaaataggccaactcttgtttttttggaaaacatttcacctgggcatatttttctatctataattacggaatttttatgtaatcacataattataaaatataacacaatcagatattaattaccttcatgtgtataatagcatggatattattttctttagtcatctcaaaaaaaaaaaagagaaaaatacaagcagtgtttcaaaactctcttctctttttgaacagagggtggttcccacttcatcaacacctcatcgccgcgaggtgaggctaagatgagcataaccagtgacgaggtgaactttctggtgtatcggtatctccaggagtcaggtaagaggcttggttttctgtcggtaggaaattcatctacagcatcttacaagcagaaggatcaacgcttaattcaaaaccaggctgtagaagaagaagaagaagagctaagaaggttcttagtgctgatggggagaagagaaggttctggagctgtgccatccccgggtggaaagagggaatgtgttctttcttcccttgacacttctgtgcagatgaatcaggcaggaatcaagagcggttgtggtgaatgtggaaaggacggaagcagtgcggggctcttggcctccacctcggcgagggcatgcatgagctggtgtgtgtgtttgaacctcttcgattttgctccagagatttattcagctccccagcctcccctactccccgccccctaaatgggctgctaggcaattttctaaaacttaggaatcgtcgtagcatcttccaacatttttgattaccactgagacattactttatggttagtaagtaaacagccaatcacatgtgttcgttgttgacaagacagactttgagctgagcagctgccctcctccgccagcagggaagtagtgggaagaagccacggagcccagggcttgggttctaacttagaagatatgtaatttaagacctacaaaatgatattggtgaaaaacgtcctgatacccacctacctgttcaacttaaacaaacctctcaggtgcattggaaaccccgcccatgtttgcctccccgccttcctcgatgatgatgaccctggtggacttgctgtttgttatctccacgtgtttattacacacagccgttttcctaagcgacatacggtgcaggtggattcgtttcctagggctgctataatgacgtaccgcaaactggggtggcttaaaaagaaatatgttgtctcctagttcctgaggacagaagtccaagatgaaggtgtaggcgggtcggttccttctgaggggaagtctctcctgtgcccctgcctggctcctggggccttgctgcagtctttgaactccttggctcgtaggcacatcaccctcatctctgtgttcagatttgtccacatttccccacggtaaagacagattggattcggaatttaccctcctccaagacaatctcattttaactattgtttttgaatacagcaataattacatctgcagtgaccctgtttctaaatagtgtcacattctgaggtgcgctgttggtgaacactgcaacctgtgaatttgtggaggagggggcacacttcaactcataacagtcggtttgggattttaagttgggttttaagcttcgtgcccttgatatcagattgtatatattctggaacttgattatttgaaaaggaaaccccagttcctaggccccgtcctcccagagatgcatgtattcgattggagggaaaaccagtctacgatcctctaggcttgagttctctcacagctggcctggtagggtagactgtacgcattggagccacacagaatggctcgagctctgatcctcgaacaagtctgagtgaggcctgttcatttgagcctgggtttccttgcccaggcaaatgtgctcaaatacgtcaggcacgtagcacattgtaagtgcgtgccttccccatccaagcctgggtctctgtcccttgcgctcccagctagtgttattcatggaaagtacacattcttttctgcatatatattagatgcctgtgattggctgttgccagaacatagtataggaagttggtatacaaaacaaaatatgtactgcctcactctggaaatcagggaaatgataaccgctctgctaatacctcaacctcggctcttagaggagcacaggtgatctcctgcctcagagcccatagctttccagaggtgcctgcaaatggaaatccatgtaccaaaccctgcttccctgtcgacttgtggcatggaatttgagattctttccatttagcaacacctctgcacaaggacacgatgaaggccaaagagactcacagctcttgtgtaaacaagtcccaggctggaactgtccggtgtgaaggaccacgtgctccggtaacctggagacagagccatgctgctggctggtccccagggggccacggagcatgagctttgctggcttcttgaaataaacacagaaacccccatccctccccagaaaggtcggcttccttattcagtgtttgtttatgaagcttctgtaaccaggcagctgagagggagagttggagcacaacaatgcatagaccttggcaaatgtcaactttgtgtaacatctgtgagctccattcctgattcatcagtgtcactgaagtataataacacttcttaggcagagttgatattgaagagagagactattacaccttcttcagctcactgtgtgtattgtggaactttttagagcaccctacaaggttgtattcaaaggaagaagggagcaaagaaatacttaatgttgaaatgttcattctggggttattttctatgttcgtctcaagtcctaaagttttggttaggtcaatagtcattgagcccccatcaagaaagcacaccttctcagcctatcgctgtctcccttctaccttaaataaaaaggaaaacatttccctgatcatgcttcctcctcaagcacctgtactcttactcctgcaccccaccaaactcattaaaaacaggttctgcatctcagaagatgattcattcctcagctccctccactctggctttctccactagaagttgtcagtaaattctgggttcccagatccactgatcttactgcaactggcattcctccttccctggtcatccctccttacctgtgtgtggcaggaagcgggtgggggtgggcagtgaggcagggagtaggtgtttccctgcagtgcggcaggacagctgcttccctggaaggtctgctggaacactcaaccccaccttccaggtacagtgacggacaagttttccagagtcaccaagcatgtggcctgagccctgcttctctgccctggacccagcagaccaggttgccgctcctgtccatccattcatctccttcaccagtgcctctcttcctcccctctgccagtatccatggtgtcagttaggatgtattaggctgcaaggaggaatcttcagtggagcactgatggcctcagacagccgggaagcagggtgttgaagaaggatccaagacacatctcttcaaactcggaaaagaacctcaaaaacagatgtgttttgttctctgcccacaacaggcagaagtcaggtcatctggcttttagcaaaccacatatatttccctacctgtgtggattagtggattttcattgttgcccttgttacttgtccaaagcaagggctttgcccatcagaagcactcaatagctgttacccacaggcgacatctcatagcagcagactcatggcagtctgaaagaggaaactggttaaagcaagaatgttaagtagtagggaacttttgcattaccaagctctagtgccaaaatggatttgttggtttttgcatgagttcagcagtctggctttgacgagtgatatggtttggccatatctcatcttgaattgtagctcccgtaattcccacatgtcatggggagggacccagtgggaagtaaatgaatcatgggagcaggttttcccgtgctgttctcgtgaaaagtgaataggtctcacgagacctgatggttgtataaaggggagttcccttgcacaccttctctttcctgcagccatgtaagatgtgactttgttcctcattcaccttctgccatgattgtgaggcctccccagccatgtggaactgtgagtccattaaacctctttcctttgtaaattacccagtctcaggtatgtctgtattagcagcatgataatggactaatacagtgtgtgagtccattggcctctgtcttacgggatccattgcctggtcacttgtgctatctgggcagtttttaagaatcacatggtggccatgtgcctttcccgtgagctcgtgttaccatcccaggaggagagaagcaagggagcgagcccctagaaatgtgcacagcctgcacctgctgtagtgagcagctcccccaaatgctgggggagtcgtgagttgtgtgcccccgcatatttctgaatacagccagggaagtggaagtccattttccacttagtatggaaagagagaaaatttggcaagtgagtccctgtaaacatattatttcctctgggacttcatcccaaaatccaaactataaagaaaacatgttctcccagacccacatttttggcataaattaaataattcacaggaacttgcaaaacggtatgaggaatacagggggacagaaccacagattcaaactgaatttaactgagaaagagctgcctgcaagataatcgggtgatacattcaggggaaagggaggtactatgaaaaattttgttttttgagactcactcatgctgagggtctcactctgttgcccaggctggagtgcagtggcacgatcacggctcactgcagcctctacctcccaagctcaattgatcgtcccacctcagtcgcccaagcagctgggactataggcttgtgccacaagaaattatgcccagctaatttcttattttctgttttattttatttgtagagacagggtctcactgtgttgcccaatctggtctcaaactcctgggttcaagagatcctcccccccggcctcataaagtgctggcattacaggcatgagccactgcgttacctggccaaaaatattttttaaagaagtagaagatactgtctgaagaggaaagaaggaaggaatgcgcggagctggcttgagcatagtcaacacacaggacagttctgtcaccctcaaaattgccttgtatccctttgtactcagctcctcttccacccccaccctgccccggcaaccaccactgctctgtccctagagttttgcccttgcaagaatggcatagagatggcatcacatattgtgtggtcctgagagtgtgacgtctttcactcaaccttatgcatttgagattcatgcatgctgttgtgtgcaccagccattcattcttgaatagctaagtggtgttccattttgaatgctgtttctgcgatttgtttatgcatcctcttgtggagggacatttgcgttctttccaggttttggtgattccaacataaagctacaaaaaagattttcatacaggtcatttgtatgaacgcaggttttcatttctcttgggtaaatatcttggagtggggttgctgggtcgtgtgacaagtgtaggtttcactttaccagaaaccagtgcattcttttccatctaaggcagaggcaggacacgtcgtaaacatgactggttttatagacgtgagttgagtcacagaactcctctgcctgtcgcacaaggcatactggaaagtatgtaaagggacgttagctctggcgtatatatctgcaggacgctcatgaagtgtgattcttcctttgaggatttgcagctagccttctggactaatttcatgaacctgtcagggtcacagtttccatgggccgacatgaatgtagcccaggtcggctgaatgacagagcgtccttgtttgcataccttcccctccttaagcagtgccgttggtctaaccttctgcttaaaaatagaaaactctatacagcctcatcagccctccggtggataagcccaggcatctgggcaaggcaaaggccaggcttccagatagcaggattccgcaggctgggccctgtggcggccacgaaagctctctgtgcatttgcccacatacccatggtatcaaagtcatcgaaaacccagcgaagtatttccctacctggagctttgtgactgacgtccacacaccaccaggaacaggcagacaagttaataaaaaccatgtgatgatggtggtggcgacagtactgaagaaaaagaaacacaagtagaaatggaatttcactaacgttgtgtccggcacagggatgttaccaagttccgtgtccatgacggcagtaattttaaacactgtagctactaaaaggagcttgtcaccataataaatggtaaaaatccacttctcacacacgctgaattcccagagtgaggaacttctggcttagctctaaagatttaaagaccctagaggatggttgaaatctccttattcagtggaacttatgttctgatttgccctgattcgtagctgagaggccaatttattatacatttttcttgcctccattaacgtcaccaaacatgggttattcagagtgagagtatcactagttatcaaaagtgagcatctacactctgggcactcttgttttcctaaagagcccatttctgcacacctgactagctgggtagaagtaggcatgcttcttttatttacataacgtatatatggctctgtgttatatgtcatccttgctcataaggaggatagttgctatggtcccaatgtttctgttcccccgaattcctatgttgaaatcctaacccccaaggggatggtatttgggggtggggcctttaggaggtgatgaagtcatgaggagagctcctttgccccttctaccatgtgggaacacggtgagaaggcaccatctatgaatcgggaagcgggttctcaccagacacccaatctgccacatgttgatcgtggactcccagcctccagaactgtgaaacacacatgttgtttataagccacctactctatgtattttggtagagcagcccgaacagagtaagataatagtgaagtagtacatccacatgcccagactttcagggttgtgaatataacttagtgacatttgtcattcatttcgtgaagcttccatgccaagaaaatcattaataagaaagatttctacccagtgtggaggcccacgcctataatcccagcactttgggaggttgaggtgggtggattgctttgagcccaggagttcaagaccaacctgggcaataaatacaaaaattagccgggtgtggtggttcatgcctgtagtcccaactactcaggaggctgaggcgggaggactgcctgagcctgggaggtcaaggctgcagtgagccataattgtgctattgcactccagagtgggtgacagagtgagaccctgtctgaaaaaaaaagaaagagtcttgctgggtgacacacttcacctgcagtgcttctctctggtggcgatgccattcaggtgagttagcctcagaggagtgcatggaagagtgagtgagacctcagcggcctcctctttccacaacaaacccaagcacagagataaaaggctgtgctgagcgcccaccaacacgcagcgaggttatactgtccaaaaagagtacctggcagatgacccagcaagttcacagcgggtaagctggcgtgggtctcggttagagtgaggtggagcggaggggaaggttccctgttcttcaacactttctacagaaacataagactgagggtgaagtgagatcccctctgaaaaagcaccaggtgtcttgtgggggcctgatgctgagggatgggttgtagctcatgccctgtagaagagaacactgttcaaagccaaccagtctggattcaagaggggtcctgggagcttcagtctgtccgtgaaagaagcacttccctgaggcttccctgtgttccaatgcccttcatatcctaggcctctgaacagggtgctgtcagtcgagtgggattcatcatcctcaagtttttgccggagtggaggccaggctgtgtgctgggctgatctcctcctgttgcatctgtgagctgctgttgtgaggacagtggcttgagagagctgaacagaaagacatgccccctccttccaagactgacctcacactttaggggagcagtacagtgtcctttagaacacctcagcggaagcaacccagatgtccattgacagaggaaattccatcaacagaacgtgtccatccatacagtggaatatcatgactcagctttgaaaaggaaggaaattctgacacaggctccagcacggatgacacttgaagacactatgccaagtgaaattagccagccacaaaaggcaaatactgtaggattccacttagaagggatacctcgaggagtctaatccaaaaagacaggcagtggaagggtggttgctgggggatggggagaagcaggggacgtggagttgctatttaatgggtacagtttccattttgcaaaatgaataacgttctggggatggttgatggtgatggttgcacagtagtgtgaatgcacctaatgccactgaactgtgcacttaaaaatggttaagatggaggccaaggtgggaggatcactggaggccaggagtttaagacaagcttggacaacgtagcaagaccctgtctcaataacaaaaaaaattttcaaaaattagccaggcatgggctcacacctgcagtcccagctattcagaaggctgaggtggggggatcacttgaggctgggaggtgaaggctgcagtgagttatgatcacaccattgcattccagcctggacaaaagagtgagaccctgtctcttaaaaattttttttaaaaatggttagcatgatatattttatgttatatatattttaccacgattttagggggaggtcatggtattataggtgagaagttccatgtgtagattgtttttcagagtttagaaaattagtctcaaagggaagagagaaccacctgtattcacagtaatattaatattactaatattacatgataagggctttttcatagtcccatataagtgtttggggcaaatccctggcacagctagtatcatttgtaagctacattggtgtctgacaaaatccagttatttaaaaaacagaaaacagtggcttatttataatagcaatattctggacatatggccagtgtccatcagtgggcgtagttgaagcaagctgtggcatgcctgtgccgtggagcaccactcagctgtgaaaaggaaggagttgtgggtaggcacagcaagctggaggaacccccagagaaatgtgccgagtagaacaggccacgtcagaagattgcagactgggccaggtgcggtggctcatgcctgtaatcccggcactttaggaagcctaggtgggcagatcacttgagatcaggagtttgagaccagcctggccaatatggtgaaaccccatctctactaaaaatacaaaaaaattagccaggcgtggtggcacatgccagtagtcccagctactctggaggctgaggcaggagaaacgctggaacccaggaggtggaggttgctgtgagccgaaattgcacagctgcactccagcctgggcgacagagcgagattctgtctcaaaaaaaaaaaaaaaaaaaaggaagaagattgcagactatatgattccatttataggacctgcttaaagtgctgaaaatatacaggtggacaccagatcagtggctgctacagatctggagtagggatgggagcacgtgcgtacaaaggaaggttataggagagttcttttgtgttgaatgaagagtttggtaccttgaccagagacacagttccacagatctacacgtaggatcaaactgcatagattatacgtacacaaccagtgaatgcagtgcagaaaggatgacgatagtttgtgttccagtgagcatttccgtcctgcctcctacttagtggtgttgatcctctttgacagtagtgtaagatgcctagatgggaggagacaggatgaaaggtgcacagcacttcactagttttgcagtttcccctgagtccatagtaattgcagaattatttaattgtaaaaaagactataccaaaaatgtaattcaatgtttctattgtctgcaaagctttgtgtgtgtgatagatggtggtccataatgcaaaggcagccaagacatttttattatatttcgcaggtcattagccatattgcaggcctagggctgggtgggggtactctcttgtgtaatggattcgagtggcagccctattaactgagaaatggatggccacacagacactgtggggccgttggaaacagaagaatcagctggaagcaaacagcatttgtcatacggacattgcttgaatgtttgcagactggggactgtcgtttctgggtgggctgcatttttactgggggaaaaagtcggtgcatggcttcttccctgctcatttaccagtgagtcttagaatgcttttacaatatccacttagaaccttcagtgtggaggattctgttagatttatgtgttcagcctgagagaagtgggcagatttgagggtcttaacttctgaagatgttgtgaatggccacaacatataatgcattaactcaacattttcagcccattcattgagatcagggtttcttggccttggcactattgacaatggcggctggattgttcttcatcttggggggactgtcctgaatactataggatgttcagcagcatccctaacatttgcccactctctattacaatggagagagagtgggaagacatttgtcaaatgtcccctggtgggtaaaatcaatgtcagttaagaagcactgattcatatcctttagttgtaggatttttttttccttccaactggtttttcttgggaaatggagttttaatggcattctgatttctttgcccttcatcttgtgttctccttgggcttcattttgattcccttacctgcagaactcaaatagacgttcacggcaagcaaaatgcagtccttgttattattaaaattttgcaggtattttttcccttgaggaaggagaaagtctgccaaaagcattctctggcagataataaaataattgagagtagcagactttccatttgatttttcttttttggcttggctcctggtgagtaagttagttaacccggaaaagggtgttactgaaactgcctttgcaaatattgtaacggaagaaattatgacagtgagagaaatctgacatggctgactccatcttgtctctagcttcacaggctggctgtctttgctcattcctggttaaaatcaacttaattaaaaactgatattcaagctatatatatatatatatatatatatatatatatatatatatatatatataaaaggccttggtgctttttcgcttcttggatcttgtttaagaaaaatttttctttgtttttcttcttagtcagctgaattatttccccagtctgttttcttgccactcttgatgcccacatgagaggacctaaagtaatttctgacagcccgggactccttgggaaaaacacaggaggtgccacataccctgttttgagaaaaacctacgttttcctcatggaaccccaggaattgaaggaggctagatccctctcaaaatctaaggctctgttccgtgttacctgatgtattttgactttgggaggtatcagaaattactttgcaggaagaagagcttttagcctgtgtgtgtaataactaggtaggaaatatactttaagggatggctaatggagttatggaaggatactcagctctttgcacttttggattagagaagcatgctgtcagccacctagaaggtatggaaatatttctaccccacactgagagatgagactcccttgggggatgggctgattggctttggattgccttgcagtggaatgcagggtaaaagcattgcactctcttctcccattgcattcccctctttttggggatccaagatgtcatataaaaatgggacccttaatttgggggatctgtttttgccttccagctatgcctgcttattaggccctagaaactacatgctctcctggctctgtttctataagggctccaccctgaagccagtaatccaatgaagaaacttaaaaattgaaagataaaaaaatcatataactaccggatccccttctgtctgtgtatttatatgtgttgtgtgtgtgatgtttatataaaacatgttaatgttcctattagttgacttttaaagaaaaaaagtgctaaaaaaaaattgtcagaaaaatagaaacattaatgcatttaggtcacgtgactctaatctttgaaaaataaaggcaatttaaaatattattggtaaagtaaaatgtcttcaacatttatacatttggtctaaattaggcaggtcagatactgtttgctagatgctttaagcccataaactgcttctgtgatttttaataattgtttgacttgtctgttttacagccattggattctagataaggcctggggacacgtggaattagccaggtgccctagctaggctgggaagagtcagacattgtctgcagctctgtctttgtcctgggctctataatctaatacatggttaaaattgcttacctatcagatattacaccacaaattaaagctactgagaattaacattgtaatatactggagaaacaattttacttataaggtatacaaggaaaatagaatgtatttttggtaaaatgttataagaaggtatggaaatacggtttttgttaaagggaaggtaatgttgtctagttcaggggattttaaggatcgtcttaacctaaaagagcgataagacaaaactgcaagtttaaacaagcgggaggatcacaaggtcaggagatggagaccatcctggctaacatggtgaaacctcgcctctactaaaaatacaaaaattagctgggcgtggtggcgggcgcctgtagttccagctacttgggaggctgaggcaggagaatggtgtgaacccgggaggaggagcttgcagtgagctgagatcggccactgcactccagcctgggtgacagagcgagactccgttcccccctacccccaaaaagaacaagctataaagggtttgtgaaggattgatcttgtaaaggaagttctgtgtgtatgaggaagttggctaagatttgaaggagattatttcagtttttggtaaattaaacattaaaataaaagcacactgatacagggctcaaatctgggcccatgtgtctgaataatggttttcttaggaaattaatcagctgtttaacagaaaattataaagggttttaaaaggtttttgaaaattttacctgatggtcaaacgaattaagattatatagatttgtttataaggttttattaagaattgggtttaacattaatagtacacaaatgcaaaggtgaaattttgctttttcttttaaacaagattttcgtgtaatattaagggatacaaaaggtttttgtttgcccctttgagtaaatggcagggaaaaggaagaggggaaaggaaagagattcagttggcttcatgctgtcttcattgggtcctgttgtttggaaagctgaggctcctatcaaagtaaagattttttccttcgtaaaatttttgagttatcattttggctaaatgaatgacttaggtatggtgacctgggattctattttgtaatatctaatgttttaaacctttgatatttgacaaacttgccaagatcaaattctaggttatgttttaaaaaaaaattaggacacctaaagtccaaaagagatatatttggcttattcaatatattaaaaccatgcaggaagcattgtcaaatataaaatggtgtttaactttctttgggttatattcatataaatatgttattagtatgtgttacaaacttgtgtaagattcctataattctgatgtttcagtgtatgttatcattaataattataattgttatgttaaattgttgtgtgtcacagagacgaccagaattccttgttgattgcatctttatggctgtcctgagacttgtgtcatccatagacaattattgtcttgtgttgctccttttcagaaggcagttgttatattcagctataggactctgacaggtactcttgaatgcgggtctctgataagtttagaaattgtgccattggaataggaaaaaaaaaaaaaaacttttgggactctcgtggagagctgatgtgttaaacattgctaatccctttgttattcagaatcaagaaaatgttttctttttagctgtttaccacttttagcaattgaataagataaacttgtgcaaaatttactgtgagcaaaatttggagcatgttactttttctctacctgatttctgcagaatttatagaaactatttgagtattctcaacttatggcagtatagttatttgcataagtgcagtaagaatctgttctcttttgtaacagaacagaattagaaacactggttattttaccaaggctttgactggaatggcatgcattcaaatataaacagactgctttaaggaatcaaagttgacttacagagccaacaaaagcccctcaggaaaacgcctcataccttgtgcggtttctgtacagggttcctgacttgtggtaagtaaagaatgtcattttctggcgggcctagggagccccaagttatcttgagaccttgggtggaggaaagagcctattatggcaaataattcttcttgctgcactttatacaaataatcagtccaagcataataagactaagacttattttgcaagtaaatttgtcttactatgatttgtctttaataaaaatggggactagagagagaaaaattatgtttcaaaaaactataaacttcttgagttttcattatcttctgttaacactgaattctttgtgggctacaagtccccaaactaatgctttcaaatttttcttccacttttctaacttggactcagtaaaatgctactaccttgttcctgaggccctgcaagctgaagcttattcctcgtaatataggcgacaaaaacgtttcagattttcactgcctgcctcatctataacgaaagaggcctaacccacctgcattgccacctcctgatatgggaaacagctgtttaattaaacatctagtctcaggactaggaaactgacctaaaaagaatatgggatgatatatgtaaaatgtgttctttcctgtccatcccaatctgtctgtctaacaaccactggcccaaatctctctgctagccgccccatgtctgattggttctcagagatgttcacctgggtccctcagagcttaaggtccagtctacaaaggcttcggaagctaggacttccactctttatcctaggaccttatagctcactgttcacttcaatgctgtgccaaaactacagatgaccatcctaatgcctttgtcatgcaagccctgaaaccccaaccaggcacatgtgagtacatgcagacagctgcaaaggggttccactccttttaccttggggtctgcagctacacccactatgcccactgtcagcaggaagaagttagggcagtcgtctcttctttttccatcttcatagcccacaccttaagaataaggtgttataaaacccaaagggagggattgaaaccacctttgcaaaaattataactgagaacatgttgacagtgagagaaaactgacctggctgactgtcttgcttctagctcacaggttgactgtctttgctcattcctggccaagctaacctgggggaaaaatttagtttatagtttcaatgataatagtccttcccccaaactaaatgttgttgtaaaactaatgaaaggctaccaaattaggatgagaggggcttgaattctaaataatttaccattatgccattatgccataataatttgccattatgccggcagtcaagatttgcatcttccccttgaagatagcatcactgttgtagaacctaagattggcctttgagatgtcttttcaggtgttcgcatttctgacaaccagattgccccacttggacctgcgaacaaccggtcctgtggccccccctactgaggaatgactcagcataagaggacagctacaattccctatgatttcatctccaacccaaccagtcaggatgctccctaccccaccccactgctcaccaaactatctttaaaaaccctaatctctaagccttcggagagacttgatttgagtactaataaaactccagtctcccgtacagccggctctgcatgaattaaactctttattacaattcccctgtcttgataaatcagctctgtctaggcagcaggcaaggggaatccattgggtggttacattactcttaatatttgtgaataattgcatctacaaaaatgattaagtggctttgcccactgtaatcctagcagctgacaaattactctgtagactccactgtgtttcctagggccatggaatgccttcttatgcaagacacgtttccatggattcaggaaatcattttaatggttcagctatcttaatttaaacaaaagttcagggcttattgttcagctgagtctctaaaaatattttttgactgcagcggctcttttacattgctaatgtgtatccatgtttaaaaaaagaatctttatgaaacagtgaaggccagcatttctttgaggtgttggcagtctttgctttaggaataataaaggaaaacattagtttcatcaaataataaaataaggaagacctgaataaaatgtccacattagtagaggatgaaagtaccctgaaactctgcaaaacagtaatgtctcatgctttgatgtgatctcattaagtgagagcagcacattttgctggtatgttgggaccccccaagaccaccctcaggcccagtggtttgctggaagggctcacaggactcagtacctgccacacttacggtttattacagtgaaataatacagatgaaaatcagcaaggggaaaaggcataaggcacgaagtccaggtgaaactaggcacaaccttgcaggtggccacccccagtggagttacagagaagctgttaattctcccagaagaatatatgattggccatgtgcgggagagtggccagccagggaagctcacctgaaccttggcgctcagggtttttatttgggggccattcctgtgggcatgcggcccatgccgaggggttcagaaggaaaataggagaatacaaggctatccacaccacttcaggcccaggccacatggaaatctgggtgaggttctgtatctgtcgttggtgcatttatgcatttgttagatgtcaatgataaaaactaatttctaagaatgtgtaggagtgggtaagtagctggagaacgtgatacccaggcctttcatatagaaaagaatagcacatcaccctggccagctgtgtggcatgaacaattgatcctcctccaccaagtatgtccattctccctttgctaaatacagtggtgtaggtttgcagagcctctgctcacatgggaggttatgaaggggctaattgttcaattaccaaccctctcataactgtgctagttgcaaacaaactgtttgaaaagactgttttgctaaactgttctcttggtgtgattataaccatttacagtagcaaaatgcaggaatccagaagttcttacattccagatgttcataaccattccactctcctggttccagtgcagtttcagttgtacgatcttttctaagtttattgttctaaattaagacttgccattcttatgctcattaatttgttacagggagaaaaagcaattagaatgaaaatcagttgagtatttataaattacagttgtttaagtatacatcttgttcagtgtagtcaaaaattctccattggtattgacacccacaaaaatggtcagattctgttgaagatgcacataagccttaaatttcacttcctactttaaaaattggtgacgatgtgaaaatgtctaagagagtccacatttcctgttttagataagatgaaatagccactcaccaaggtgcctgtcttccgagtttattcaccgttacattcaagacttgcctgctctgaaattctactgtgaccttaaaagtgcccagcattgatatgttttatgccaaattctattccctttcttgctttccagaccgaacagcaagcgagttgtctggactgtcagacacaacactgtccctcttccccgaagtctctgtacatccctttgctggtgcctccttctccgttcacttctcaactactactgtcctcaagatgatgttctttttaccctcccacatctgtgcctgtagtaatatgtcactctcttcctcctgaagtctgagtcccatccccagtctctctgctgatcccccaagtctgagtgtccactcccaatctctccagtgactcctcccctccaagtcacggtgtgtatccccaacttctccattgccatccatactgatattttgaatgacacttcacgagcactctttaatgtaaacccacacttggtaccatcaccatttccctaccacagtctgtccacttcaaagacaagcttcctctatcctgtgattatgtcactctttgccttagtccattcgagctgctatgacaaaataccataaacaacagagatttttttctcacatttctgcaggctgggagtccaacatcaaggtgtgggagattcagtgtctggtggggacccgcttcctggttcatagatggcgccttctccctgtgtcctcacgtggtggaagaggcaagggagctctctggggtctcttgtataaggacactcatcccattcatgagggctccaccctcatcacctcccaaaggccccacctcctaatgccatccccttgggggttagatttcaatatatgaatttagaagggcggagagaagcattcagaattagcactgtttagtagaaaaacatcaggattgtgttcaaacatttttttccatgttatctttcctactgcctccttgtcttcagttccctccccaccacctggcacccagatatcctacccttgtcagtgttacctctatccccccatcactgttttgttgtagtaacaatatctcacatttgtcaagcacttgctgtgtgccaggcatgattctaaatattgacagatgaaactgtttattcctaccaatccctaggaagtagaaacagctccatcctcatttacagatgagaaacccaaggtactgagaaggtcctggcctacccaagtcacttcaaggaggtcatacagctgggattcagaacaccatccatctggctttggaatctttctcattttttcatttattcaacattcattgaaaataatgtaataaaaattatatatgtgtatctatatctacctatagatgcatatgtatatatgtatatatagctatcatgtgctacgtgatgctttcaaatacagttggccctccatatcctcaggttccccatccacaaattcaaccaactgtgactcaaaaataaattgggggctaggtgcggtggctcacgcctgtagtaatcccagcactttgggaggccgaggtgggtggatcacctgaggtcaggagtttgagaccagcctgtccaacatagtgaaaccccatctctactaaaactacaaaattagctgggcatagtggtgcatgcctgtaatcccagttacttgggaggctgaggcaggagaatcacttgaacccgggaggcagaggttgcagtgagctgagatcgtgcacttgcactccagcctgggcaatgagcgaaattctttctcagaaataataataataataaattggaaaaataatacattggaaaaaacaaaaataacaatacaacaattaagataatacatatatttttaatttttaaaagtggcagttttattagagcaagtatgaaaatatgaattaaggttgcaatgagcagcgcagcagagaaggggctgcctgccctcctccccccgcccgatatatatttcatgtgtgggacagggtctcactgcattgcccaggctggaatgcagtggcatgatcttgcctcactgcagcctcagcctcctgggctcaagcagtcctcccacctcagtctccccaagtagctgggaccacaggaatgtgctaccacacccagctaatttttcgtagtttttatagtggcagtgtttcaccatgttgcccagactagtctcgaactcctgggctcaagcgattcacccaccttcgcctccaaaaaagtgctgggattacaagtgtgagtcactgcgcctgacctatttattgttttttaaagacagagtctctctctgttggccaggctggagtgcagtggcacaatcatggctcaccgtagcctcagcctcctgggcacaaatgatcctcccgcctcagccccccccccccccccccccccccagtagctgtgagtgcaggcacgggccaccacactcaactaattatttttattttttgtaaagatggggtctcattttgttgcccagtctggtgttgaacccctggcttcaaatgatccttccacctcgaccttgcaaagtgctgggattacaggcataagccaccacacccagtgccaatcttagttctttgctcgttatctgaattttcaccatatttgcatacacctggagtattttcttaaattgaaacagttgctttttattagatataccaatacctgttagtttacgagtttcatttagttctattgttcgcataacatacatttaaatagctattaaatttcaaacatttgccctcacgctacttaaaattattttgagtaccgtcagaaatgtggaggccacaagagagtacttgaatgcagcagttgtcaccttttctccagcagcttgagaaagggcatagagtgctatctgagctggatttgaaccagaagtttttaggcaaagtaagaagagcacttcaagaaaaataaagagcaaaccccagcatttttgaggagaatgcgccatcttggtgatgcggacctaggacacatgatggcaggaaggaggaaaagatgctggcaagtagggttagtggcacattaacaccagctgagacacgggaacctgtccagttagaagccgttgattcattgttgaaagataaaactggatgtagtgtgagtaaaggatgacctgcctgcttggtgaaaaattagtaaccacagaggtggctgtcaaaaccaaccagcaaccagggaaaatgcttatagtgtgctaggtaaaagagaacagggatacaatattctgtgaccatgatgattatacatagaaattaagacgcacaggccaggcgcggtagctcacgcccagcaagtaatcccagcactttgggaggccgaggcaggtggatcacctgaggtcaggagttcgagaccagcctggctaacatgaaatgaaaccccatttctactaaaaatacaaaaattacctgggcgtggtggcatgcgcctgtaatcccagctattcgagaggctgaggcaggagaatcgcttgaacctgcgaggcggaggttgcagtgagccgagatcatgccattgcactccagcctgggtgacaagaatgcaactctgtctcaaaaaaaaaaaaaaaaagaagaaagtaattaagatacatagagaaaagggactggaagaaatcccccaatgtgagaacaggagttgtgttgattgtttaacaatgtgagttaatttctccatcttccaaattgctttctcttatattcccaaagtcatatcttgacttttgtttgagtgtgatttgcaatggtgctatccgtcgtaaatctctggtttagcattcatgctgtcttccaatttccaaatattgaatccagaattcatgagtgttccaaggtgctggagaccacactgtagggctggaggacatgagcgtctctgcacctagctcttcctagtagctgacttgcagcaggagctgaggcttctcctggcatcacctccactacaattctctgtgagcatttccaggaagcagcaccccctaccctagccgaggcccgtccaaggttgtctcgttgtcctagcccgccattgccctgggaggaagtagccacatgagtttatggcctgagtaatgcttttccctcctggatgctccccacatctagaggatatgaaaatagtcttggcaagggtgcctggtctgcgcttgtcagcggcctgagctgtattcagccaccacccttggggtccaggccagatgttatggcaaaaccgtattttaacgagatccttctggtatttcttttggacgccgtccgaggcagcttcattttacgctaaattccatgttatggtgggtcatctcaaacaggtctgcagcgcataaaaatgttctcactgcactctgttttctgtagcaaaatgttgttggaggttaggatgggagttgaggactgggccttgagggtttttttcatataaacacattaaaatggaaagctgatatgaacacgttcagtgatatagactgcaaaggcaaaaagaattctccccagcatatttttttttctttttaccatggatgtaattggagtttacatatgataagaactgcttcttgggcagaaaatgtaatcctctggtgagactaatccatcattgttgaagtgaagggaactggtagtgaattcgccccacagatgaagataggatttctaattccctcgccttttctgtttactgttcctaactccgtgagagtgtgcgtgtgtgtctgtgttttcttcaccatttgatttttcatcccggctcccacttcctcatccttggcctctctcgcatctttatttttatcacaccctccccacctccaccaccttgtcccagcactgagaggaaagtgggcagctttccaggcagctgcagtcctgctggagaaacctttatgatccaggaaatattgactgaggagaagctgtgctgactccgctatgaataaggaggttggaaaactgtcagcatttgcagaaacaaaaggaagtgctacatatacgttttggtttcataatgactgtattgtaaaaccccttctctttagcctactagattggacaagtgtgttaaccagtggctgtttggtatccattgatcatagagctagaccaacaaccaaagttgtttacctctcataaggtggcttttgcaggcgtgccaaaatcatattatgaaactcccagccacaaattctgacatgtattttcacttcctatccaataagggatatccccacccctttactccccgactactgtagtcataaaggtacactcctagttcctccctctctctttctcagcttctcggtccctgtgtgtgataaggtttcttgttgccctgtgtggcatggtgtggcacgccccagcatactcccttccttgggaactgagtaataaattctttcaatggcattagcctctttgtgttgtcactcagtcacctccataaattaaaacccttcaggttttgttggcactgtaaggtaatttattttctctacataggattttagaattgaaagggaccttgtagatcattgaattccacctgtccatgggtcagaaaagggagctggggaaactgttagggggcagatccaggccttggagcacctggttaaatgtgttctccccataagcctaagaaatggtaccaaattcttatgtcattgcatccaatatggtccttccttctttcttctcttctgtttctttcctttgctctcaagactggtgtatcactttgtctcccaggctgaagtaaagtgtgtttgttatattgcagtggttttttattcgtattattatcatcatattgttttttgttgtttttttctggatatttttgatctgtggttggttgatttggtggacgcagaactatcggatatggagagtcaactgtatataaaatcaggtcagcacacttttcctgtagaggagcagatagtaaatatcctcagctttatgagccatgtggtctctgttgcacctactcaactctcccattgtagtgtgaaaatagccatagacaacacatcaactcatgggtgtggttgtatctcaataaaactttatttacacacactggcagtgagccagacttggtctgtgggcctcagtttgcaagcccatgatctaggcaatgcacagatagcagatggtgtccctcagctttggatagctgtaagtattacaagtatgtgagtctgttaaatacttaataaaaattccagttttaatgttacaaattgatacccttggtatttgttttagctgaagatgcaaaaccaactccacagctgcctgagtattaaattctacttttctctgccaaataagcagtatttctaaaggccagtgattgataacttagcagattttgctgatgaatcaggccaacattagctgagcatagtagtacactgtataactcaaatggtttgtgaagtcatttgtgaggggtgtggtttagcagtgtcataattgcaagaaacgcaatacatgtacttggtttgttttaaatgtttatgttgcctagttagatgagacaaattcttatacagactgtttcctctcttgtgagactattacacgttttattccaaatggacaggactttacatggaagatcctaccatcctttataaaatgtcatcctttgtgtaagcctttcagtttatcatgattatactcttttttttctccctgggaataattttacctcatctggttatgctctgttactgtgtgttatgttatctaaggtctatgaccaattgcatgcagagggtggcttgcttttcaatagcaacaaccaagaaccaagcagaaatgtaaggagagtagagctgggggtagtggcctttcagggtgtcaattccccaaccatggtggggttgatgggacaatattggaaacatttttggttgttacaatgggagtgtgctactggcatctagtgggtagaggccgggggtgctgctcaacatcgtacaatgcatgggactgtgtcccccacagcaaggaatgagccagcctaaaagtcagccatgctgtgcttgagaagccctgctgtcaagagattcatcaggaatacgcctcctaagtaggtggcaagcctagcgtcttcaggaatgtctctaggctagcctactggtgacaccaaggacactaacccatcaccctcacacgatctttcatcgaggtaccaccaagctctttgttctcctgccctttaactacttctgcacctgccgcaggggcagtccttggtgcttcgtttatcattgacattctggtctttgttcctacggatgtcttgttgggcagaagagatgtgttcagagatgcgggaaagctgaggaggcacaaggcaccgaagtctcaccactctggcagactgcatatgaatgtgcccattagccctggagtccaagtgggaggggtgagatgctggcaggtgtggaggcaggcattaccttccgcagcaccctggcacctggttctggcaactgtggcctaagaggaagtggtcaagcagcctctagtacatagtccttgggcattgtcttagttagtatgggctataaccaacaccttagactgggtaatttatatacaaccaaagtgtattgctcacagtcctggaggctgggaagtccaagatcaagacgccagcagatttggtgtctggtgaggtcctgtttcacatggatggctccttctgtgtcttcacatggtggaaggtgcaggggagcttgcttgagcctcttttatagggacactgatcccattcacgagagtggatccctcatgatttaattgcttcctgaaggccccaccccttaataccgtcactttggggatttgtctcccacatacaaatctgggggggacacaaacattcagaacgtagcaggcatcttcctgtcccagaatgaatatcagaactagcaaatatcctagcagccatttcatctgacatccttattgttccaacaaggaaagctgggacagcaacctttccactcactgtggtctcctctccatcaaatgtgttgggggtctggctgctgtcccatctatgtgtctcatcagcacctcaaggtactttttatccctatatcacagaggaggaaatgcaggcccagccaaatgaagcgacatgggccaggcaccagtggcagaacgaggacagaacccagccatcctgcctgctgctgacattttctccatccagccctcctgcttgccttcatgagaccacatggccagaaatcagtaagaaaatcttgcaagcaaatggactgaaaaaccattgctctagaggccatgtagagatccattcagagaaatgcagctagtgaaaatttcagcaaataggaggacttctgttaaccatggcatggaatgcacatctcccaggtctttatgaaggtgcctaatttccagtcatgacctaccctctccaaaagaggacccaagctgatgaaagaccttcgaggtacccctgtagaactttatcctgcacatttgtcattgtgcatctgcacaggatattcctttcggcagacgactttcagctctttgcagaagtctcagacgccacatccttagtccatctttactggttcatctctttgttccaagaagacttaattgaatgtggatactgttgtccacacgatctagaaatgaaatctgtgttggagagcataatcatgtagagagataaagttatacagccaaaacatgtactcaacattaaaaacccagatgagagagaaatcaagggcacactccctccgtgggttagactgagctttgcacaccgttctttgtgagttgcctgagctgcacccacgctggctgctgtccagagctgccagtggtctagctgagcagccaggtggaaatggagtctgtgtccatgcagggaattcaagaattttggttcctgtgcttgtgggtgggtcttggagtgtaaagtaaaaagcggaatctcggagtcacatagtctacggttcacagtttagttcagcgtcatatcacatgatccttgggcgggttacctgatgtctccaatgtttgtccttatgtgtgaaacaaaaacagtaccaactccaaacagctgctacaaagactgaggtagtggacagagtgcccaggtttggttgaagatggtaatgtggtcagaatcggctctgtttcacagagcatgtgactgcaagtaccagttctgtggcccagtgctgcttgcgggaatgaatgagtcagagtggatgaatgaaatgtcccaggagcacgagactttccttccacaattgctccatcagccatgaggtttgcttgtcaggtgccgtcatcagcacataatgctgcattctggtgcattcagtagatgtttctagatactgtttcatggtggctaagagtggtttctggcacccaggcttagatctcagccccacccctacaaactgagcaacaggaggctgtcagttaccctcaaaagatctcagagactgattgatcaaggggaaagcggcagtgacagaatgatgctgagaagcttgaagccatttagtaggagccacgtgagtggcccccatcagccgtgagagtcatgatgtctatgagagaggaatcactgtggcccagagtagataaggaagattccatgtagtggatcgtcaagccaagaatgcagtgaggtcccgctttatccattgactggggtttttctcttccacactttgccaaagacctcaatgataaaagcttgcaggtaaaactctgtatagcattggcagagaatagagtcgttggtgaacccaagggtgggttgcttcattttggtaggagtgggtaggagaaaaggaaggtggatagagagaaagcaagttagaaggaaaaggtaaggttgttgtaaacagccttggcttatatcctccaaaaacacaggggcggaggaacccttggggataggggaacctggaagggcgtcctttggaacctaatgtaggcagttatagttctgtaaagaaatatgcaaggctctgtgcaattgattgtaaaattaatagcagctaccctattactctgttagataaatctcaactacacatttgatatgttctttacaacctggcggtggggacagaacagagggtggattgaggaggagggagagtagacagagaaaagtgaagtgtaagaaagcagcaaggagagcacagcgcagagctcgtctcctggaggaacattcccatctggtgagcgttttgtttattgcaaggtcagtttgcatttggataaggcgaggcagaagggcactgatacggaagcagagggaagccggctgccactgcccctcattggctgaatgaaaggcggcggaagaggagcacctgtccagcaaggctgacagtcctgcctcctgggataagcagattctcagcctgcagagtggtctaaccagggaggtagagtggctgctttccgaactccctgcttcctgctcatttgcctcatgcatggaagttgtaaacagtgtgagagttgaaagccacaccatgggaatgccttggtgtccaccccacctgttgccaggaaccgagcactgggggtccatgttcctcacacgagatccccccatgatgtccacctcccaaggatttcaagctcctgtgcaccctcaggccgcctctgcaccaagcaaagtgacccagccctgccaggcggggttgcctgttttaggaaactccctgcagcagcctaggcttgctggcagtgggatgccacctccctctctctccttgatgaagggctgtcgcagcttcctcatcacccccagacctccacatagatgccctgcatcattgccttctttccttgaagcaggcgccatccacaagagcaaggcatggctttctgtgtattcggtcctgacccccttcccaacagcttcattcaagagccttcatccaaagctgatctgaaaacacctttaaattgccaagcatcattgatagcagcttcctagagcggcagtgaaagagatgcactgggggaggagaggaaaagagccagcatcaattagcaaagagaaaattcccagtgttttgagaaaatgactcagtgccacaccagtcagtccaggacggcctcttctccgtcttcagttgttgagttgtgatacacttgccccgcgtgccaggaggactcagggtcagcgtttgctgttccctcatcttgggctgaagaaaggtgccctgtgtgctttcagggggtgacacagagaggcttcagcatgagcttctgcacagtcttacgaaccacggagttttggtggggagcctggagccaaatttgagtaacagaaatgtccaaccggggcatgcagggcaaactattgtctgttctgctttgttcttaataacactgaaacggttctaccatttaagtcccttgtttcatcacataccaatcctggtcttcctgggtctgaagtccctccctctctccctgccctttcccaccttactgaacccaaatcagaagcatccctgggcattctgcagccgtgtctgtccctgcaaattaagtgtgtttgaagtctgcgggccaccttcagatctcaatggctgcacctccctccttcaattcgggtctcactcaacctcagctttcccctcttgccacaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggtacgtagctgctgggcccggcccccaaacagcagagccctgggaagctgcaggagcttggaacacattggaagctaacatgcatttccctcaggcatttgggattaattccgcggcagggtgcagtggctcatgcctgtaatcccaggactttgggaggccgaggcaggaagtctacttgaccccaggagtttgagaccagcctggacaacatggtgtaacagcatttctacaaaaaacaattttttaattagcccagtgtggtggtacgcacctgtagccccagctctcgggaggctgaggtgagaggatcagatcacttaagcctgagaggttgaggctgcagtaagctataattgcaccagtacactccagcctgggcaatgcagtgagactccatctctaaaattaaaaaaaaaaaaaaaaaaggaagaagaagaaagtaagttgggttcttttccactttgtgttaataccggttgtgtggacacacagcagcaagcttccagtgcccctcccacatggctctgtgtttttgacttaaatgtagaatcactggctgttagttgatgtaaacacttacaccgccacatctgaaaaagatacggcagatcttcagctgctctgggcttcggagtggacgtttgccttgcacttaatgcagacttgctgtctcttcttgatttctggagcaggttggttagagaggggccccacacatggtcaggtggaatctgtatttcagcagaacccggcagagggcatcaccagaggctgcgtcagggcagagaggtgatggctctggtgttaatgaggatctcaagggatgccttcattaccgggctcgttgtagagcagatggggtaggaggatggaaaaataaatgcacattaaaactgtgcacttggcttggaacccctcccactttttacattggtccacagtgaggagttgtgccaattttataccaattttggttttaaaccacacacctcaccctctcttgtcccctcctattctggtctcatgattctgcagtgaagatccccttgacttctggggaataatgggatccacaacctttcttgccgccttcacctgagtccctattttatttttagagactgagtctcacactgttgcccaggctagggtgcagtggcacagtcatggcttactgcagcctcgacctcctgggctcaagtgatcctcctgtctcagcctcccaaagcactgggaccacagacagtccctgttactgatttctcagtcccctgcagcttcctccctctgcttctctttctcctactctgacccaggcgcgtgattctactgaacttttccatactgtaccgtcatccatcccacctggcagtcacattcttccaggattccctctgtcccgtctttctgggaactggtcttgcccttacaaacctttctccttcacagcatgttacactgctttaaaaaactcttttagaaaatcacaaagtaataatatcctgttctctttttcttttcttttctttttttttttttttttttttttaagacagggtctctctctgtcacccaggtgggagtacagtggtacaatcatagctcactacagcctcaacctcctggctcaaaagatcctcctgcctcagcctcctgagcagctggaacttataggtacacaccaccacgtccagataatttttttattttttgtagagatgaggtctcgctggtcttgaactcctgggctcaagcgatcctcccgcgatcctcccgccttggcctcccaaagtgctgggagtacaggcgtgagccactgtacccagtccctgttttctttcttgcacttctgcctgccatttttcgcaaagctgtggctttcgaaactccggtgttttttcctctcttgtgctcctttttccctggcaaaccccttcacactgtgtgcccgggatcttccactgactccttctggccctgtctagtttcctcactgcaaaacacacacgtgtgtatctaagaggacatgtctccaaggtccagccagccatcagatctcaaggcgcctgtgactctgtttttctctgctcattgccttctacctctcatctgttgagaagccttcatagttgccttccctcggcactccagattccagcactctaggggctaatgaaagactgtcccatttgtcacaatggtttctaatcattaaaaagtgagacgccaggggcggtagcacacatctgtaatcgcagcactttgggaagccaaggcaggagggttgcctgaggccagaagttctagaccagcctggccaatataatgagaccctatctctacataaaataaaaaaaattagccaggtgcagtggcacatgctcgtaaccccagctactcggaggctaaggcaggaagatcagtttggtccaggagtttgaggctgcagtgagccatgactgtgcccctgcactccagcctggatgacagagcgagaccccgtctctaaggaaaaaagagagacagtgtgcccgcggagtttaaatgaggacatgttgttactactttggacagttaccgcgttttgtcatgggcttgttcatttgggtgtgaacatatgaaggaggaagggggtgtgggagcgtcttgacccatcggtcaccattgtccactccatggccagaatcaagggccaagagtgcctgaggaggtgatgcagctagttctttacataggttgtattgttttctttattttgaatattgtcttgtaatcagaaatcatctggagtgatgtttcatttagttattcttcagctgaaacctgagcctttcagttcttcctcacttctgaagtaattcaggttcagagcatataaacatgtgtttgcacatccagatacaaccccaaggcttactgaggttcacctgattcgaatatctggcgtgtttcacaaggaaagaacctcctgctgtatttttaaacgtgtgtggaaagttttccatggtaaacggaaatcagagaatcaaagaatggtcaaaaaaacatgaatcaaaacaaaatgatgtcaattgtgtcatggctatggttagtctaaccctgaacccaaggagtcatttcaagtagcagcaagtgcctattttattaaatcccctggacagatggacttggaatccaggcctaaatgctgtgtgcatctcatttgggctctgcttctgaagcgttaccctcccatataatggatggtcatttgcagagattttgcacagtcgcgatagcacgtgggcaggtcttctccaccgcagcactcagtatttggggctgcgtgtttctctgtggtggggccatcctgggcactgttggatgttgagcagcgtccctgggctccacccaccagatgccaggagcacctctcctcccttagttgtaacagccaaaaaagtctccagacgttgcctaatgccccccaaggagtcacagtcaccccccgcccccgccacgttgagaattgtgccatcagggatagcactttctgtcaagaataaatggcctttttgtcctcaatgccccaattgggtttgacactcagaacaaccatcacacttagttcttaccaacagtttgtcgtgtccccttccctgcccaccgtgggatcccttcaccccaggctccaggtccatgccgcttcccccgtggccccctggttgctgggagccagctgtttacgccccacttccctgcgcttctcctgcccagagagcagaggccattcccagagccctcacccccgtgagctgacagctgtaccttggcttgcttccccaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcagtgagtgcaggggctctgggagttcggtgggcctctctgggttcattgttttcttcttgggcaaatccgaatgccttcttaaaaacctgcctgctataaatgtcttagaagctgctctctagtgtttgcttacgatctggccggaagaacttcccgttccattttttccatcacaacccttggacctgagcttcttcaccctcatcttcaactttaggaaatcgtgctgcgcctgctaatctgagaactctcatgtaacacatgattattgcccgtgataaacaaaagtgtttcattcatggacacctttagtctcagcctccagccttccatgttgagggtttttggccaaattatggtataattattgagcttgcagttcctgccaagggcactgggccccagagactgggcataggcttatttggtctttgcaaaaccccaggacatcagtccctgttaggtgattgcctgtgagtatgtggccagtcagagagcccaaaattctacccagagaacctgctccacttagacatactgctctatacacccgtagggacgccacttcagggtgcaagttcagagcgagcatatgtgccgtgcatggcgcaccgtgtgcgcgcatgcacttgcatgcacaggtatgcatgggtgcatatgtatgttgtacatgtgtatatctgcatgtgtatgtgcctgtgtctgtgtgcaagtgtgtatgcatgcgtgtgcgtgtatgtgtgcgtgtgtgcgtgtgtgcgtgcacgcgtatatgcgtgtgcgcacctgtgttcctgtgcgtgtgtgtgcacaagtttgtgtgcgtgtgtgtgcgcacgcacgcacacctgtgcatggtgtagtgtatgtgtgtgtgttcttccttatttgaaagttgttgccctcggagcagccatgcagcccagcagtccttgaagatcgagctgactatgacgttgctgtcttacctggtacgtcttggctccacaacttcctggtgtgtagagagccagccggctgcctctgatgaggctgcagcccgagccaagccctgtgacaagttaccatccacaggcaccagctaaaaaattcttggagaagcagatccagcatttaatggaaggttcacagattgttaataacgtttctattgcaatagggtgacagaaaggccacctgcctcaggtaaaaggaaaagacctcttaccagccttctattgataaggtccacaattgtggggcaggaaaagaagagtctggccctcctcctctgtgcatgtggccagagttcaccctggttgaacttctggaacagccaccccaacccccttctcaaaccctgcatcttgtgcctgacccacagcccagtctatggagacaggagcattggaaggccgcattttgataagaatgaaaatactggctgtcactcctgcctggagttaccaggccccctgccactgcgtggctggctaagatgccagtttccctcttgccatcaccagggacagtgggtctgccacatgcagaaagatgtttttcctctcttccagccagatgacactttcagagcatggaagaaacaccaacattgaagagtcccattgttgtttgaatcttttgtatcaggcttctcgagctaagcaggaccaccaggcgttttcttattttttacataaacagcactcctactcagtgacacgtaacctaagatcacattgcttctgtttcctgggttttccaccagagcacctttacgaaagacatatgacaaagcatgctcaattcctcaccgtattgtgaaactgttaaccatggctaattgtttgatgatcaggctatattgctcctttctcaggagcataaaccagggtctagcaaactttctttacagggacagacagtaaatgtcccaggctttgagggtcatgcagtctctgtcacagctgctgaagtctgtcagagtgcaaaaacagctgtgagagtcagctcaggctgccgtaacaaaaggccacacaccaggctgtttaagaatttgctctcacagttctggaggctggaggaccaagatcaaggtgtgggcagggctggttcctttgcgaggcctctctccttggcttgtagagactgtcttctctccatgtcttcacgtgctcgttcctctggttgtgtctgtgtcctgatctcctcttctcataaggacaccagtcccactgggttagggcccacccttgtgacctccttttaccctgctcaccttttcaaaagccctatctccaaatacagccacattctgaggcccctggaaattggggcttcaagatatgaattttagggggacatagtttagcccataacagtagccatagacaatttgaaaacatgggcagtggctgtgtgccagtcacactttatttatgcagaagcagccagggactaggtttggatcatgggctgtagttagctggccccagttacaaaaaataactgtcacccaggctggggtacagtggcacaatcatagctcactacagcctcaatctcttgggctcaagtgatcctcccaccgcagcctcctgagtagctgggactacaggtgtgcaccaccagggctggctaacttcttgttgttgttgttgttgttgtttttatagagatggggtcttgctatgttgcccaggctgctgttgaactcctggtctcaagcagtcctccctcctcagcctcctgaggcactgggattttaggtgtgagccactgcacttagcaaactgtttttattcctcaatgaaatttagagactgtcaaaatgtaaagaaacctaaaatatttactaaattgcactaaagccacgatttcgttagaatcatcagaggtaggccgggcgtggtggctcacgcctgtaattccagcattttgggaggctggggcaggtggatcacttgaggccaggagtttgagaccgaccctggcaacatggtgaaaccccgcctctactaaaaatacaaaaattagcctggtgtggtggcacatgcctgtaatcccagctgcttgagaggctgaggcatgagaattgcttgaacctgggagacggaggttgcagtgagccgaggtcgtgccactgcactccagcctgggcgacagagcaagattccgtctcaaaaaaaaaaaaaaaaaaagaaaaggaatcatcagaggtagtatttagtacataaaaaaaatgtttctggaaacaaaagagccctttaagtgtgtttctcttgtattggtaagccacttgtctctttgtgtttgctgtgacagataatcacgcgaagccaatggaaatagatggagaggttgagattccatccagcaaagccacagtccttcggggccatgagtctgaggtgttcatttgtgcctggaatcctgtcagtgatttgctagcctccgggtaaggatgtcagggtggggggcgctccagagttggggagatgggagatgcaagctgctcgcccttctctggagttctgcctaaaggaacacacactccccttcttaccccggtgtgtgggcagaccaaggaatgggtggctctatgagccacttctctacatgtctcatattgtggagaagccatagttccaagtcgttttctccatgtggtggtgaggaacacagcagcacttaaattaccaaatgcaaagatggcaaagagggaaacagggatccagagggatgaaaaagacagaagagcatgtgctgaagatgccctctggccagagagcaagctgtggagagcttcttatcccatttgaaccaaacaccagaggctcctgtgtttttattctgtagatctggagactcaactgcaaggatatggaacctgaatgagaatagcaacgggggctccacccagctcgtgttgaggcactgtatacgagaggggggccatgacgtcccgagtaacaaagacgtcacctcactggactggaatgtaagcatcttccaccccctgggcactttgaaattggtaaaatcggccagccaccaggcaggggctgcagcaatggagcccatgcagacataggaggcaggtggtcctgtgtgctcagcccccactctgatgggctgccagagaggtgttcttggcttctttttttattttgagacggagtcttgctctgttgcccaggctggaatgcagtggtgtgatctcagctcactgcaacttctgcctcctgggttcaagcgattctctttcctcagcttcccgaatagctgggattacaggctcatgccaccacacctggctaatttttgtatttttagtagagatggggtttcaccatgtcggccaggctgctctcgcactcctgacccaatgtgatccgcctgcctcagcctcccaaagtgctgggattataggcgtgagccactgcccccggccagtcttggcttctaagagctattaacaaggctgcatttggcaggcagtgagctgtgtattcagtagccgtatctttgcacgtgagcatgccttagcaaaatgagcctgtggcctcatggtgggaaggtaggctgggagccccaaggtagttcttctggagagatacgtcgtgcagcccaggaaaggtgattctccaccttgggatttcagcaccaggtgttctgtgcattgacacatgggatgcacacagtttgactgctttttattttctgcaaggtcttacgatagctttcagcatggtattttcaattctgtcattaaagaacacgcagtggcaaatggttccagtgtacctggatcctcggagaggctctccgagctgcttcggtgctgccgctcctaagttgtttttgtggggttttgtctctttctggccctcagaccaatggaacactcttggctacgggttcatatgacggttttgcaagaatatggacggaagatggtgagttctgtgtccctcgtgctggggtcgggtaagaggagctgccgaacttaacccttgagtgaacagaccatgacattgaggtcaacatgtttgtttttactaacaggtaacctggccagcaccttaggccaacataaaggccccatctttgccttgaaatggaaccgaaaggggaattacattttgagtgctggtgtagacaaagtgagtattagctgaaaatacatccctttgatctataggtggttatatatttttaatctcaaaataacatcgtggtttcttggaactcgtaggctttgtgcttccccttaagaaatgaaaatgatttgtttaggctttgtttttgtggttttgatctttctgttcatttgtgacacatcatctcttaatatattctgctgttctgcagaccctcgtgcaaagcttccctttatttgaggtacatggttcagtggtagagagaggacaatctccacattgcatttgtcagttgctggaaggagccacgtggtatggggcgtgccctgcctgaacttgcacccactgaggggtgagtggcacaggctgtgtgtgttcttcaggcttcggctttcctcatttgataaactgctgcttcccaccgtagaccgcagatttctctgagtaggagtcaagcaacctggctacaagggcacgctcttccgatggcccacagagccaggttagaattgacttgctctgcacctgggcagggctgcagggagacacggtagtgttaactccaggtgcatgtaaaagccatcaatggggtgggaacccaagggcaaagagtaaggggacgcagactccatcctgggcccgagtctgatccagccagcaacctcggcctctgtgcatttcactttcctcacttgtccagcgacaaggctggctggagtcatgagcggagacagccttcatggaacagttgtgcgttcccgagactcagcaggaattctaagtcatggctttggaaaagaagcattatctagaattgagaaaaaaaaaaaaaaaaagacgtgttttcacatgaatttgtgtttctacaacaactggaaaccatgcctgaatactggaggatgctcgggcctccacaaagctttgcattttgtggtgatttcaggataacttgaaaacttactaggtcttgaagttcgagaccagcctcgccaacacagtgaaacccagtctctactaaaaatgcaaaacttagctgggcatggtgtcgggtgcctgtaatcccagctacttagagactgaggcgcgagaatctcttgaaccagcgaggcagaggaggttgcagtgagccgagattgcgcctctgcactccagcctggatctggaagaagagtgagactctgtctcaaaacaaaacaagacaaaacaatacaaaacaaaacctgagtcagagctctctgttctttctagttctgaaagttataaaatgatagagttggccggtcgtggtggctcacgcctgtaatcccagcactttgggaggccacggcaggcagatcacctgaggtcgggagttcgagaccagcctgaccaacatggagaaaccctgtctctactaaaaatacaaaattagctgggcgtggtgggggatgcctgtaatcccagctactcaggaggctgaggcaggggaatcatttgaacctggggtgagcccagatcgcgccactgcactccagcctgggcaacaagagcaaaacttcatctcaaataaataaataaataaataaataaataaataaataaaatgatagacttgacctctgaacatcatcccactttgggagaaattgctaaatgaaataattgaatttggcaaactgtggcccacataggccaagtctggctcctcacctgtttcttaaatttaaataaagttgtattgggacacagccacacccctttgttgagacttctccatggttgctttcatgctacaatggcagagatgagcagttgcaagagagaccagatggccctcaaagcctaaaattctactacctggcccttcacagaaaaagtttgcggactcttgcactagggtataactaggtcaacaaatcattcattcataattgctctccctctcttttaagccaagaaacctttcagacttagtagcctggtttatgatattttaaaagctgagttgctgtggttgacacataaacgttctcatgtagctactatcagatctttgccaagatgttctaattcaagtaacatgcatacgcagcactttgctgtgcattcagtaggctctcagtaattgctgcttgagttattaaaatcactcatgaaaatgacagcacttttctttatcaagcagttcactactgcatgtgttaatccatccggtactgccaagataggaggcaggcacaagtatgatcactcccattctatagaggacgaactggaggcctggagagggttattaatttgcctagggacacacagctggtgcagagtacagagggatgggaactcagaccctggtcaccagtaactactgccctttaacttccgtagaattctaaatagctgtttgtttcctggcctccttcctacctggagactgttaacatttgtgattgtttttctcactgattatcagtcttaactccaccaggtgatggactatgtgatcagtgaaaatgcatatgtggaattatgttagtctcttgggctgggtacgatccaccatcattacttagtcaaccacagcaggagtgaaaataacatccttgtacataacactcagggagaaaatgtaacttaggggatgctggtgttgaccaacacagagtgactaaaatatatgtcacattcttcaaatgtttgcataactgttttcttttgtccaatgtacatttaacataaacatcaactaagagaccagtcgctgatgtaatatgtgaaatggtatcagaactgtgaaagagtttatatattctctgcagtgttagatttgtttttgcatggctaaattaagaagagttataccccaacaaagaaatgttaattggtctagaactgacccaaaacccaggagtaccaagtttcaaagacactcactgcttgctttcctctgaaaatgtctacagtcaacacaaaatagaactctttcttcttaaagcaaaatcttgactgagcgtcagtaacagagaggtgtaaagtttccaattaagttgaaaattccagttgatgaagacgtaactccaatgctattcattgagctggttctctatcttcctagcgtcagtaaattcataaaaattcgtgatttcctttgctttccaagggagaactcaacctttctacttactgttagaccagtacattggtgcctggccccagtgcaagccaatggctctgccatgtctagtgcccccatttcatggagggatgggcagaggcattttcagaaatgctcgtctctgcagcccttcacttggaacaaatgccacaaagatctctggagatgctttgttccaggtttttcaacagtttctgcatttggggatgaggaggaattcctaccaattttggtagttcttgcaagtattggttagggatgctctgtccttaaacccatttatgcctagtttccattatcggaatgctgagcatgtgggagttatttatatcctgctgctcagggtcatcgccaaggtctgattgcagaaattcaaaaagttgcaacctcaggcataaatgagttaagggagatgccagcatatgtggctgataggttcatcaaatgtggccgtccagattgctgagtttaaaacatgctgtactttaatgatgtggtatgggagaaaaagaaggcaaatatcccagtaaggttttgatactgattacatgttgaaatggtaatatttgggggcatgttggagttaaatataatagattgctaatgaattttaccagtttctttcttcttaatgtggatcccagaaaattgaaactagcccataaggctcactctctatctctattggacagtgccggtttataaggagaagggctgtcttttcttgtatgataaatgtttccagagaaaactttgccagaatagttactaactttttcctttgtttgcggaacacagacaacaataatttgggatgcccacacaggagaagccaaacagcagtttccttttcattcaggtgagttttttgttgttgttgttgttgtttgtttttttgtaattcaaaaataataattcaggtcgagcccagtggcttacgcctgtaatcccagcactttgggaagccgaagcaggtggattgcatgaggtcaggagttcaagaccagcctgggcaacatggcaaaacccatcactacaaaaaatacgataactagccaggcgtggtggtccacacctgtagtcccagccacttgggaggttgaggtaggaggatggcttgagcccaggagatggagtttgcggtgagccaagattgcgctactgcactccatcctgggcgacagagccagaccgtgtctcaaaaactactaataataataatccaaaattaggctgggcactgtggctgatgcctgtaattccagcacttcggaaggctgagacaggagggtcacttgagcccaggggttctagaccagcctggacaacaaagcaagaccccgtttctacaaaaaatataaaacattagtcgggtgttgtggtacacacctctagttttagctacccaggaagctgaggcaggaggattgcttgagccaggaaatcaaggttgcagtgagctgtgattgcaccactgtattccagcctaggtgacagaatgagatcctgagatgccccttaaagtaactgaatgcgccgagtatggagcccaggaggcctcattggtcagaaggagacccattttgtggcaagcattgattgctcttaaggtttgcaagatagagatgacctcggcacccacctgctcagagctctgaaacacagcagtgagccagccacagaagcagtgcgggctcctttctcttgctgttctaaagggatgctgttttgggggctccctgaaaccactcccaggattggtggtttgctgcgaggacccccaggactcaacatactcacagctaagatttctaacagcacaagaatttagtgcaacattagcaaagggaaacggtgcacacggccaaatccagagcttcgaaggctcctctcccagtggactctcacaggccatgctgaattcttccaggaataagttgtaactatgcctgtgaagtgttttataccagggaagctccatagagtctcagtgcccagagtttttattgggggttggccgtgtaagcacccagtgcctagtacaagccaaaactgcagacccccagaaggaaagcaggggcacagcataaacacactgtttgcacaaacaagtgttagcagagtgagccgcttgcgtctgttaggggagggtgggaactctccggaaatctaaaatctcagtcgctagccaagggccggccttgcaagcaagcctctgtagggagatcagcctcgggcctgtggtgttagcaccttcctacacagatgtgtggccgctgctctggagccaactacatccctttgtgcactggagccaggccaggccacatgcgttacccagggctctggagtctgtagagattccgattttccagattcccacctgattcttcgtgggtcgttttgggtttttttgtttgtttgtttggagacagagttttactctgtcacccaggttggagtgcagtggtgcgatctcagctcattgcagcctccgcctcccatgctcaagcgattctcctgcctcagcctcccgagtagctgggattacaggcatgcaccaccaagcccagctaatttttgtatttttagtagaaacggggtttcgccatgttggccaggctggtctcaaactcctgacctcaagtgatctgcccacctcggtcttccaaaatgattcttcattttctttcccacctccctcctctgtgtaactcagtcctgatgttagacgtggcctcttaaaacaaagacagatggccacccgcagagctaatagactattggaagtctttagactggcttaaagtggacagaagtgggtaggtgccacttcccttaagggcaaatgtctgatccgtcttgaaggaatccctaaatatgtgggacgaaagttaactattctatcagctgtccctggggcattgtccaggaggagatctgagtgtctttcttgtcatgcagcttggggtgcttaaatgatgttctgaatgggagggctaactgcaacaaccatccaaggcagaacagccatcggcgcctggggagggctccaggcaggggacatgggccctgcaggaaacaagaccatgaaccgaaggtcccgtcgaggcacgattgtgttagatgcataggcacccacgtctgttatattccatgcagtacttcagcagggactcctcatacaggcagctcagagagtgagggagactcagggaggacgctgtttctgctctgctgccctggagagggagagccactcctgcacagcttgggacccacaccaaacacacctctcagggttgccggtgaaatttgttactggtgttgctttaattgacactgttgatgaaggtgctgagcatacgagagacaaaaggctcccaatgcaggtagcacgtgtactaggtcctccagaaagtgttcttcaccccaaagggaaaccctgtacccattccatctttccctggcaactccacctacagcctgtgatctgtgtgtcatctccatgccagacacttgctactctgtgctctagactgcaaatcaaagcaggtggctagtgagaatagccttcctaatggagttccgtcacgtttggcttaagtgccaaaacctacctttgtaggcaggaaggatgctatgacaggttcacagccctagacacgcagaccccggggggtgaggcagggatgtctaatgcagaaagctctggcttctgtttttcagagaaaaatatgcccgaggtaaacatcaataaggttcctctaacacttgtgtcttaagaattcatctgtaaagtatttcagcagaaaataatctttcccaaagtgtccccaggccctatggaagggtttcctacccagctgacccaggaagaccacaaaccacattgttctgaattgcgtgagcttctcacctgtgatctggctggccatgaggtagacccaattcccgtcggcaggtcagacatatctaggcgttacttgctctctttttggtgtcaatcagtgtgttaaagaacgttcaaaatgaagagaaagaagctcgctcttccaggtgaaacgcagctgggaagagctgtgaggagcgcctttctgtggctgtggcaggtttggtgtttaatggggcgataggagacattgccttgccccactagcttttccccagtaacacctcgtgggggcgcccttggtcaccgtcggcaggaagccttagctcagagcctcgtggtggagtgaaactcggccgcagaaaggaatgaactattgatgcacgacagccaggagagatctcaagggcattttgccgagtgacaaaagccagtctcagaaggttgcatgctctgtgctttcattgatgtaacgttctcataatgctaaaatgctagaaacctgggacccgtcagtgctgtgggagttgagggagcatgtgaggaggttgtgtgccgatacagtagctgagggagatcttagtggcgacggaacacttctgggtctcagttgcagcgatacacatctacccatgtgataaaatgacagcactctacaggcaaattgcaccagtgtcagcttgccagcgtcgatacaacgctacggctacgcgaaatgtaaccctcaggagaacctgggtgaaggagacacaggacctctctgtgttacctttgcagcttcctgtaaatctctaagtatttcaaaaggaaactgactggctgggcccagaagaatgagggctattgaaccaaactggcctatgcatgggagggagggcacagaggcccccagtgtagctcagccctcttaccggccattcacccacatggttccaagcattgtggctgcaggagctgactcagagtggggctaaccacctgagcacgggggagcctctctttagatcaggaatgtccagtcttttggtttccctgggccacattgaaagaagaattgtcttgggccacacataaaatacgctaacactaacaatagcttgatgagctaaaaaaaaaaaaaaaaaaaaaaaaaaagaagaagaaaaagaaaacaactcttaatgttttgagagagtttacagatttgtgttgggccacattcaaagccatcctggaccgcgggttgaaccagcttgctttagatggaggagtcatcagatgctggtcgccatctcttggaccgctcaccagattgtcacatttccaggtatattaatcacatgccgaaatgcagaggctggaccagaagtttgctgtttagctcaggcgatgttgtaaacgagaacgaagaaaatgcgtcaagaactgtggggctgtcatgaaacacgctgctggggatggaacagaagagatgatctcagatgtggaaaagaccattgctgacacccgcgtcctcccacccacaccttccgcctgcagggggagctggatggggaagcgaatggggtccctgtgcttatggaggataaacacatggaggcttgcacctcttatttgaagaccgaggaagaataggggcaattgatggttagtattcagagaaagctggattcttctcagttcagcgctgactgcctttaagaaacacacatggctgggtgcgttggctcattcctgtaatcccagcactttgggaggccaaggtgggagaatcacttgagcccaggagtttgagaccagccagggcaacacaccaaaaccccatctctgccaaaaacatctttgaaaaaatgagccaggcttggtggcgtgcacctgtcatcccagctactagggaggctgaggtgggagaatcacctgagcccaggagattgagggtacagtgagccaagattgtgccactgcactccagcttgggtgacagagtgagatcctgtctcaaaaaaaaaaaaaaaaaaactgggcatggtggcacacatgtatagtcccagctactcgagagactgaggcaggaggattgcttgagcccaggagttcgaggctgcagcgagctatgattgtgccactgcactccagcctgggcaacagcaagacttcatctccaagaaaaaaaaaaaaaaaaaactcacataagatgagtttctatattggtcgattggtaaggacatggtggccagagcctggcagaagctaaccctctctttcccctagaagcaatgcttcattattggctaattcagtgtttacagctaccttggagaacataacttggcaaataacagaatggaccatagtatctaggaaaaccaatgagagttcttggctgggcacacttgtagagttgccctaaccctgctgcctcctctcctgggggcatcatggagcccactcagtagctaaaagtaatttccatgggcttgcatgggaagcgcagggttacgagaggtggtcagatgcggacgactagctctcgaagtcccaagctctctgccccgtaaggcattacccccttaaattagcatgaaccctgggaagggaggcactgtccctccatttcacatgtaatggagcacagtacttttcacacccctaaatcattccttttgatagtcagggttccggacacggggctggttgtggaggtcctctccacacaagaagcctcatgatgatccttaataagagggtggggttgctcagaaccttcaggggaagggaagagatcaccagagaagggaagggaagagatcaccagagaagggaagggaagagatcaccagagaagggaagggaagagatcaccagagaagggaagggaagagatcaccagagaagccgcctcttcccctgtgcccttctgtctcggcatcgcatggccttttctgctgctcatcagttctctggcatgaggtgggaagaagcccagggaacatgatctgctggtgtggcccccgcagtggaaagagaccggagacctgagcacagcgcccttcctggcccctaggaaggcgggtgacccctgcagtccgtggacgcctgagaggaggtggaacagatgctcgctcccagccgcagacccactctctgctagaggacaggagtgagcagttgaagccatgcttccccagaagcagaagaggatgagagtgcacgggggcccccaccgtgggaacttccacacctccagcgcactccctgtcccgggcactgctgatctcctgagatgcctcggctctctcccccttgtctggggctgcttgcaacatccacatctgtagctgagactccaggaagccgtcaacctgcagctgcacatcagtaaagaggcagaacgaggaatgaggtccatttgctaggacttcagtgcccttgctgtcacctgtgcttccagtgcctctcagggcatggtccagccctgtggaggcagacgctctgaggacagaaccagggcctggcttttagcgagtgccttggccattttggtacattgggaagttgttggattcccagctgccatcctagaaaataaatcagaaggtagagaatgagacccatagctgtaactaaactacaaggggaggtcagctccccgttgttctgtctttgtgaccctgaaccacctggacctgagaaaggcccaaagtcagggagggtgtcggtcacaggccctgaagtgtgcgttccgtttcatcccaaaggggtttttattgaccctaattatcccctagtcaaggggatgccttaatgtgttacaggagagtttttttcatattgaggtatcttgaacataggacatgaaatctttcctctccttttttctcctctttgtccaaaattaaatcaaatgagctcactgcagagatgccgctggaagcagcaaggtacagagcaggcagggcggccctctcacctgcccttcttaactgtgccatgggagcgggagattctgcaggctgtggggtgcaagaagtgtcacggagcctctctcccaggacatcttgtcatccctgccaacgtggcaggagagggtctttaaggtcttagaaagagactgtgttcacgcttgagacgtttttatcatgttactaaatggggcttcttggctgggtgcaatggctcacgcctataaccctaacactttgggaggccgaggcgggtagatagtttgaagtcaggagttcaaggccatcctgggcaatatagcaagaactcgtctctgcaaaaaaaaaaaaaaatttaaattagctaggcgtgatggcatgcgctattcagaaggctgaggtgggtggatcccttgagcccaggaattctaggctgcgttgagccatgatcgcaccactacactccagcctgggtgacagagcaggccctgtctctagaataaataaataagtaaactaaagaggcttcttgattgtgctgttcattgttgtaaatccatggagctgtgcaacagtgagtaactccagatgtcctccctccctactgcagcccctgcccttgatgtggactggcagaacaacacgacctttgcctcctgtagcacagacatgtgtatccatgtgtgcaggctcggctgtgaccgcccagtcaaaaccttccagggacacacagtaagtgagagctcttgtcactggtctcgagtttgtgagaatgtgatgtgggagccgattcttgtgtgcctagaattaaaagctactgcagcagcagaccagctctaatgtgccccttggctatttgagctgtcatggttaccccatggtaaccatggtggttggattgactcagtttggggttggcagtgagaacagttcactcagaaatgacctagatggtggatttggcaacaaagcctttaaggtagccatgagaaacatgtagaggacatcaaggaaaggatgctcacaataaatgaatagacggggcacatctgcagtgaatagaaaaaaaaatcattaaaaaacaaatggagactaagtgtggtggcttatgcctataatcccagcactttgggagtctgaggccagaggattgcttgaggccaggagtttgaggccagcctgagcaacatagcaagactctgtctctacaaaaaattttaaaaagtagctgcgtatggtgatgcacacctgtagtcacatcccaggagctgaaggctgcagtgagttacagtagcaccactgcactccagcctaggcaacagagcaagaccttgtctctttaaaaaaaaaaaaaaaaaaaagaaaagaaattgagaactgagaaatataatgtctgaaatgaaagtcttaataggtgggtgtattaggcagttctcaattctctcattgctctaaagaaatacctgagactgggtaattgataagacaggaggtttaactggctcacagttccttaggctatacaggaagcatggcagcatctgcttctggggaggcttcaggaggcttccaaccatggcaggaggtgaagcaggagcaggcacctcacatggccagagcaggggcaagaggtgggaggagtggggggggtgtcacatacttttaaaggacaaaaactcacgaagacagcaagccacgagggatctgcccccatgatccggacacctcccacgaggccccacctctgcatcagggatgacagttccacctgagatttgggtggggacaccgatcctaaaccacatccgtggatttaccagcagatgggagattgcggaagtaaggttagagagcatagaaattggccaatttgaagaacagataaaagatcgaaaaaatgcataaaggcttaatggcttatggaacaatatcagagaccctaaacctatatgcgtgatggggagagaagaaagaatggaacagaaaaatcatttgaggcagtaacagccaagttttcctaaatttggtggaaaacatcaacatttaatccaagaagctcagcaaatttcaagcagaacaaatataaacagaaccacacaaacagaacagaccatatccacctaggcatatggccatcaaacaccagaatcaatgacagagaaaatcctaaaggcaagcagaggctgacaaatccattatataccagggaacaacaatgggaacaacagctgacttagcaaattccttagtttggcctctgaggcgcttcccggtctttcaccaaatctccctcagattagccaatttctatggtctctaaccttctgcaatctccagtctgctggtaaacccatttactagcctcgacctcctgggctagtgtccaaaaattccctgtgcctctgtcctcctaaagacacgtgcagccaagcaccttgccccgcgctgagccctgcctggaatgctccctgccttagacccccacagcagctctcggtccaaaacagaatcctccccagtctccaggcccattcacgtatcctctgcacgccctggggaggattcacggcaccccctgagctcctactgcccacatgaatgccacagccctggcagtagctgctggcctgcgtgtctgcctctcccagaaaacgcagagtgcatcaatgctgggaccatggcatcttgcctttctctcaccagcacccaggatatctctgtggtggggcagggtgggggtcccttgttaaagcaggagaggatggtcacagtccctggagatttgccattgtgccactaacttaactgatgtaaattcccttgtcctgattcccctaatgcccacctctccccacccctggcccaggggtccctgtcccaaaggaaggcgcttttagagcacaggcacctatcgtcctgttaacatctgtttggctccaaactgactctcttctcccggtctaaacttatttctcctctaaccctggactatccacaagtttttaatagagctgtacacactatctgcagttcccaggtgtcctgcccaggaccttgccaccagcacaggccttggccctttaagtgggtcttaatgtggctgatggccctgaacaaagctccagctcagtggggttgagtggagacccatgagccggctctggaggcggcccaggaaccggggcttgcattgcagagctagggatccgctcccaggaagttatttgttcctttgcatgggcttggctagggacagccagtggtgaccagctctacattcctgggcccatgagttttcctctgaacagctgcagtcagagccacccttgctggccttgcatacacattcacactcatagacacccatgcgtgtgcacactcacaaccctcagccccctctccagtcggccccctccaccctcccgggctctcgcagcagcctgcccctgggccgcgaaacttcttcctcctccctttcctgggccacgtgtgcctcatggaacacagatgtggccttgtcactgtccagttcacacccttcaaaactccatgttcttagaaagcaacctgaccatacagttaatccaaaccggagcccttaggagtatgaaatttagaaaattcattatgagtgtgtcattagttaattgttaggccgggacagcaggtgtcacatggtgggactggactggacatatggggccctatagtcacccctgagggagccccaagctggtacgccatgtcccctcatttctcctgggtaggctgttccccagctgaacctttgccacaggtggttcttttacacatgcctgtcccggtagtgtccccgtctcccttggcccctgggtacattcattcacctttatcctccagggtttagcctcgtggtccccaggtgtcctgagcctgtgcttttcgctacctggctgtgccgatcacgagcccccagccaggattttgcctgtgtcatgtgtgtttgtgccactcagcatttgcctctcacttgtgttgcacatgtgtgcctgcctgtgtgtgcatttgggtcgcccatcttccacctggatcagcccttaccccgcttgaactccgtaataggtgagggttcacttctcatgtttacccctccctccgcctccactcacctgcaggagagaaataccttctaatgggtgtggacactggaggaactgttacattaaaagtgcataagaggcctggcatggtggctcacgcctgtaatcccagcactttgggaggtcgaggtgggaggatcacttgagcccaagagttcaagaccagcttgggcaaaaatcccaaaaaaaaaaaaaaaaaaaaagggcatggtggtgcctgcctgtagtcccagctacttgggagggtgaggcaagaggattgcttgagtttaagaggtacatgctgcaaggacctgtgatcctgccactgcactccagcccgggagacagagtgagaccctgtctgaaaaagaaaagtgcataggaaagtgattttcaaaggccaatttaaaaagtaactggttttactggttttatttgctgcgttttatggtatgtgatttcttcacttgccttccttcctagcagggaaggtttttttcttaatgaagtatggatgagagtggctggtgttgtgtggtatagggctgtggttttatataaatgaaaaaggcaaagtgagaaaaagaggaaactagatggctggttgggctgtgccctttgatgtcaggctgaagccgaagaccttctgcagcgccggtggcgcgctgctgccccctgctggaaggtgacctcatctactcacaggccctgatgtctttttcacactcttctgctctctttcagaacgaggtcaacgccatcaaatgggatccgtctggaatgttgctggcatcctgctcggatgacatgacattgaaggtagagtcggcatggcaaggggtgggctgtttaatcctagacaaccccgggcacttgatgccagtctcacggtcactcttacatgaggattatttattactgaccaccctcccttcctctgtcatccggtgagctacgatttctcagtcatagtcccactgagaatcgcagcctccctgcagcctttctcaccactgtgcaccctccaccctgccctgggccccgtgtgcacccccgggaggaatgattccacatcgttcccggatgcaggaatggcttttgctcatgttgtgtctggtgtgttctgtagatctggagcatgaaacaggaggtgtgcatccatgatcttcaggctcacaataaagagatctacaccatcaagtggagccccactgggcccgccaccagcaacccaaactccaacatcatgttggcaaggtaagggcaggcaacacagctggcacagctcggtgttacacaaagacaacaggaaattctgctaaagcgcgtccatgcacgtgtgttgaagcccttcagaggaagcaaagcggtagctcactttgaaggggccaggatagaattaccgagtaacacctgcctttgaggtaaggatggttttgagtcaggcacagtggcttacgcctataatctcagcaccctgggaggccaaggcaggacgatggcttgagcccaagagttcaacatcagcctgggcaacatggtgaaaccccatctctacaaaaacttagccaggcgtggtgacgtgtgcctgtagtcccagctactcaggaggctgaggcaggaggatggcttgagcccaggagattgaggctgcagtgcgcggtgatcacaccactgcactccagcctgggtgacagagcaagaccatgtctcaaaaaaaaaaaaaaaaaaaacagaagaagaaaaaaaaccacccaacatgactgcagagccacagttgagggacagcaagccaggcagcaccaactcctgttgacggtgctcgaattaaggtcatctcttagagaggacaggatggaattcctgcatccactgagagacggaaccaaaaaaacaaagaacacataggccgtaattctcatatttcaagtaattgtcataaaatccacttaaagtactgtgatatagtgtgatatagtactacacactcgagttgttttgtgatgactcagaaggtgcttttgcgtcgcgtggtactattaggagcataaattatccttttagtcagcaagtataaaaggggcatcccggtacctaatgggtccctgttgaaagaaagcaagccagacaatagctttgtgatagatattactgttctaagtttgaaaataactaaaatttgcagctttcaataatgtgattacgtatgtggatgtgattgtattttaattcttgtttgattaaaatttattttctatttagagacagggtctccctatgttacccaggctggtcttgaactcctggcttcaagtgatcctcccaccttggcctcccaaagtactaggattacaggcatgatctactgtacctggcctaaaaagttttttaaatgtttattcacttaatttgctatttttccaaatatggctgtctgtattaatttagttggtaataatagatgtcatgttttaaattgtaggggcattttaggaaacttgataaatattctacaaaaatatttaccatttacgtctataggaaacatagaaacagggctgggcgcagtggcttacacctgtaatcccaacagtttggtagggtgaggcaggaggatctcttgagcccagaggttcaagaccagcctgggcaacacagtgaaaccccgtctctacaaaaaataaaaaaataaaaattagccgggtgtggacctatggttgcagcttctctgctgaggctgaggcgggaggatcacttgagcccaggagttcgaggctgcagtgagtcatgatcacgccactgcactccagcctgggcaacacagtaagaccccatctcaaaaaaaaaaaaaaaggtgcagaaacaaatgtagatatcaaattgtttccctaataagaccattaaagctttttttctgtttaatgactatggctttgtttttaatacttgtaagtagttacagtttagaagacaaaaagctttttagttattatcttttgaaacgtaaaagctgggaaaaacaactcctggagatctgatacacattatggagaactgtttgaaaccaccgtgtgtatgtgattttgctttctctcccaccttgctagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcaggtaagctcccgacccctacaccaaatccttttagtaagggatgcccaaatagccacgactccagtgcccttggctcagagcagtgccccggagggagttgagcaagctcaggctccccgggcagacccagtggatgctgtccacgtgcaccccacgtgggctgtcagctcttcccccaccagacacctccggcagctcccctccctgaggaagggcgtcgtgtccaccgtaatcatggctcttggccatttgattccaaaccctcaccttggcacacgttcttccttgaaggagccgctgtcttctgttcacttttctgagtccatggcacgaaaccttccacctgcctcttcctcttcttagcagttatcaccgaagtgctgctctctagatactgaggttagaaggtgggagtgggggaccagctaacggggtcaaggccacaccagctcctgcagctcccttacggagcagaccagggagtgggaaggaatgtgctcttgctgttgtcatgccacttcaatttttcttttctgttttgttttgttgttgttgttttttgtttttgtttttgtttttgagacggagtctcactctgtcacccaggctggagtgcagtggcgcgatcttggctcactgcaacctctgcctcccagattcaagcaagtctcctgcctcagcctcctgaatagctggaattacaggcacccgccatcatgcccagcttatttttgtatttttagtagagacagggtttcacatgttggccaggatggtcttgaactcctgacctcaggtgatccgcccacttttgcctcccaaagtgctgggattacaggtgtgagccaccgtgcctagcctcaatttttcaaatcaaagtaggttctgtttgaggacataaggtatgtcaatattgggttgtccttttagcagggattgaaaggacataggatttaaataaaggtggctgctgtgggtatcttgggccacacctgaggatagaagaattccagctgtaaagtgtagaaatggatgggaagtagcactgcatagcataaaggattgtatagggccatcagcacgtgattctagtctaagggaagagagaggtgataatatgctaggagctgttgaaaataaggaaggggtccctttcgcctcaggaggggaggaatcacacagccttccccctgccccctttcatctgcactgccttcttggttccttttggcttggttgacattcaggtggatttataccctcaagttcattccccctgtggactcaatggtgatgagccctgttcactggcaaggggtccactgagatcacaggcttcccagggacctcatgtgaaccacatcctctcagggaaggaagggaaatggtggaccctgcgtagagccaacccgacgccaagcccagccccacagccctagatagctctccgggaagcacgcatctcagcactagtgtccaagagtctccgttcctgaaatcctcgctagaaatagtaatgggtggatttgtaaaaagaacacatcaattatcaaaacaatgacatgatcagttaggtacagcctgttgtcaggaactcactgaactgtttcaacccttttttataaatcaaagaaatccttaggacttttcttttttttttttttttttggatcggagtttcactctcgtcacccaggctggagtacagtgatgccatctcggcccactgcgacctctgcctcccgggtttgagcgattctcctgcctcagcctcccgagtagctgggattacaggtgcgcaccaccacagccggctaacttttgtatttttagtacaaacggggtctcaccatgttggccaggctggtgttgaactcctgaccccaggcaatctacccacctcggcctcccaaagtgctgggattacaggcatgagccaccgcgcccggccaagaaatccttaggaattttcttaagagaaatcttaaagcccactttaatctttctccaagtataaaaatacttatctgtaatactgccgacacacacctttctcagttcatggaacaccaccctttaaggggcccaattgagcagaggatttgggacagccctcctggtctcggtgttcagatttctcctgcctgtcaccatagtgaatcatgagtgaaggcttattcgactctttctctcttttttattttttaaaattaatttttgtagagacgaagtctcactgtgttgcccaggctagtcttgaactcttgggctcaatccgtcctcccgcctcggcctcccaaagtgctgggattacagggtgagccacctcgcctggccttattcaactctttcaaaggcctcaacttcccctacctcttagatttgtcaagttaatgctgttttaaaccggaaaccaatggtctgtggtgttttccattacatgtatattatgcatttcttctttcaaatgtccaaaaatacgtacattttaatgtcatggcatattattacatttaatcatgaattacagtcaatttaattgctactggggtgggtgtattcattatgttgtattcattcaggtcctccaaagaacagacaccagaacaggattagatgggcgagagatttattgggggaaagagctgtgatggaaacagggaggaaggtagggggaagggagaattcagaccataaggccagtctgaccctgggaaggagacgggaagggtaggaagagtcagggatggcccttacaggtctgtagaaagttttggtcgtgctgatggagagtccatgagccacttacccaccagatgagtctgagtctcagcaggtgactgccatggtctcccgcctccatcagtcctcagctgggtgcagcctcagaatccacgcaaatgtggcagattccgcaggcataagtaatcaggttcactcctcgtggtgggaagtcctagaggcacatctccatggcccccagagtccttactgaaaacccttaaatttcaccatgcttgaaaatgttcatgacgaaacgtcagggccggaggagcgcacattccacacctgcatctgtcgcaggcgccccttgcgttgtaagtgacagctgctttgctttgcagagtggaaatcttgtccacagctaccgaggcactggcggcatcttcgaggtgtgctggaacgcccgaggagacaaagtgggtgccagcgcgtccgacggctctgtaagcaacacctctggtttgctggggagtggggtgttgggggcagctgatgcctaagtgagcttccagggcgtgtgcagcattcgtgtcctgaagggcctagcccagtgccaaaggaagcttctgggctggatcccatcggagttggtaccacatctgggaatggccttctccttgtcccttccagagtgtccttctagtcaacattttctcagtcaaattggtggttctcaaccagggtgattctgcacctctaaggacattagacaatatctggagccattttaggttgtcactacagtcatgtgtcgcttaatgacgggaacgttttgggaaatgtgtcattaggcacttttatctttgtctgaacatcatagagtgactgacacaaacctagatgataatacctgtcccacaccgaggctgtgtggtacagcctattgctcccaggctacaaacctggacagcgggtgaccatactgattcctgtaggcaaccagaacacaatggtaagcatttgtgcgtccggatctatctaaacatagaaaaggttcagcagatatatggttataatcttacaggaccactgcggtctgtgcggtgcgttgttgctggaaacgtcattatgtgacgcgtgactgtgcttagatgaggatgctgctaaacctcctactgtgcacagggtggccacaattgtcacccatgctgtggctgagaagcccgggcctctggtggccatcctgcaggtctcctgggccctcttctcttcccatggggcatctggatttcttattttcccctggacttgaggttgccctgacctctggggcaagcggccgttctggctgaacggccaagggtcagagtagtccccaaatgttgtcagaggctgtgtacttgggctcgtattgtcatctgccccacgattgcaggtgtcccttctgggacctctgccactctgttaattcctatcattacccttaacctggcctttctgctctgtgctgtttgcttcagtttgctcggtccgatgtccagatgccagtctgttatgagagcttctctgacccttcatgacgatgttccaataaactttactgacaaacatcggtggagggctagattgggcgtgggggccgtagcttgccgacttctcactctaaaggcatctttgtattgtctctcaagatgacaggtgctttatctttccttccaggtgtgtgttttggatctgcggaagtaaccacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggattttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagtgggtagggtgcaatctggtgtgtgttccagcagtgagacggtgttattgtgaaggtggcattcatctgcggagccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcctgcggccgcaagcaaaaccaagcgcgagatgcagctagcacccttcatatccatccccgttctcagcgggacaacaccatggacagccgttttcagagcctccagcatttgcacaccactactcaccctctctgctgctggcatgttggtagagtcatccctgtaatcaagaaatggcctgtggaatgttattgttcaacgttgtttacagctcttaaaacatggtgaggaatgcctaagtcttagtgaccaaacgtgaccttgaaagcagacatagcatgacagaccttcctagagtgtttggtcgggttcacagtgaccgagagtcaggtccagcacacacctgggaaagggatgctgccccaagggggaccaaaagggccggacgttacagggtgaaaccctctgacccctcgcgacaccgtaggacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaaagcttatgtttcttgtcaaatgcagaaatgttccttccgccactcactgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaaaaaaaaaaaatcaccttgtgtgttgtagctcatttgtttcaagagagaatcaacagatcatattcagtgtcttgaataaattgctctattttgatattaga

SEQ ID NO: 2956 - DNA, 256445 bp, human; identical to SEQ ID NO: 2955

SEQ ID NO: 2957 - DNA, 224706 bp, human
cagggagcccaggagcaacgaagggcaggctcaagggaaggccccaccatgtccttctggggggccttgaatggcaactgatacataataagacacaatctattctgctgattcacaattatggagactgtgtaagtgtgtatttttttattgatgtcctctaatgatggtgtagcaacagtcgttttgcatcattgacgttttacagcaatattttgcagggtaattttgaggtccgccgttttggtggaggaccggcctcttaaaaactcacctccggccgggcacggtggctcacgcctgtaatcccagcactttgggaggccgaggccggcggattgcctgaggtcaggagttcagaccagtctggccaatatggtgaaaccccgtctctactaaaaatacaaaaaaaattagctgggcgtggtggcatgcgcctgtaatcccagctactcgggaggctgaggcaggggaattgcttgaaccagggtggtggaggttgcaatgagccgacagcgcgccactgcactccagcttgggcgacagagcgagactcctcagaaaaacaaaaacaaaaacaaaaaaacaaaaacctcaccttaggtccccctccccctacaaccagaacaacaaatggtctagagttcgaggaagagcaagtgaggttatagtttagattgctgagtgtaccgggctcttagcacgaagctcattatatagtaaaggaaggggcaagaatatttgaaaaatattcaacgaggctgaccccagaggtgctggggagggggagtggagatctgtttaactgaattaaggctgcgagtggttgggagtagcctacgtggaggggaggaaggagcgctggggacttaggtacaccggggccaggccgtgtaagccattgcaacataaagcactttgcaagggccagagggctgatgcctggggggttggggtgggagtgatgaggcccgagtgcccaggtccccccaacctcctcagcccccacacccgagttcctggcgcctatgcctgtgtgtctgagtttgtccctaagcatttctggctcttcttgggaggtgttttgcaaaggtcgaggctccgccggaacccccactttttgagctggggtaaagactactggggtgtcttctaagacgccgattttgagggagattcaccatcgggcaggtggcagggggttctgttggggcagccgggtggcttcctttttggggtgggggagggtaacactttagcagtgatcgaggttcccctgccccctagaaactgagggggtggccgaggttcccgtcccctcgaggcagtcgtggaaaggctgggtttgggatgtgatgggggtagccctggggtcctctcagtcccacggaggccacggggaagggaccgggaccagagcaactagggagaggcccgggttcccctcacccaccctaggcgtgggggagcggggcgggcttggtagggacgctggtcccccgaccgtgggacaggggctgggttgggacgcgggtccccactaggagccgcgggggaggggcagggccggagtccctaccctcgtaggggaggggctggttcgggacgcggctcccccggggcgcaggggcggggccgggtggtacgccgggtcccctcccacggccgtgagggaggggccggcggcgggggcggacccctggcggtcctcctggctggggtccgcgcgctcgcggcagctccccgtggaggtcactgtccgtgccagtccctcccgctgtcccgccctctcccgctgccgccgccgccgccgccgcgcccgcctcagcgcccccactccgcgcttgggagcgaggagccgccagcgcccccgccccgccgccgccgcagcgccctcaggccgccattcgccaccgaaactttccagcgcccgcgctctctccgggactcggcggcggcggggcgggggcggcccgggggcggcgcgcggctgctccggggcgccgggccctcttcggccgccgcacggccgggactcggaggctgccggctggagggaggttcggagcgcggccgggcgcgcggcgccgccacaagttgcgctgctcgcgacgaggtgagtgcgcagggctcggcgggccgggcgcggggtccgcaaacttctgcggggaggcgggtcccgcgctgaccctccagggtccggccggcggctcggggcgcccgaacgctccacccgcccctggaactcctgtaggtgcaggtcgccaactgtccccgcggcgctcggactggggtgcggcgcgctcccaggagcctgaacaataccccgaggtggccgctccccgaagtgccggcgcgccttgcggggagagacggaggtcggcggggggctcctttgttttggggagggggaagtggccggtaagtttagggaagcgctcggcttttcctccggtgcccctttgtctgccgattcaggggcttgctgggcaaacctgcgccaccgcgggctccggggaccggggtggagggcggtggcgggatttccccgctgttggggagaagagccccattcatacccgggacgcgggccggccctcccggacccgggtggaagcgcagcctcgcggagtggggcaagcggcgggcgaggtggcgcgggccccgtgtctgctcagtttctgacgcgcagaaactgtcaaggaagtcgggagccccagtcctccgcccatctccccggcctgagcgcacggctgggctgggggcacccttggcccgtcgagggtctgcagagcgccgcccggggagagcgcagacctgttgctgctcctgggctctgacggggcgggtggggtgggtctcgcagatcctgggccccggccttgctatccagggggaccttccctaacgatgggaccggtgctcggagtggagtatggggagtgcgccttcgggagtcggcgctggccggatatgtgacaactgtgggtcgctggaggcccgcctgcgctgggatagggcctggacttcacgtgcgtcgcctgtgttccgtcagaccggggccggggctcgctccctgcaaggcctcgtgttcccccagccagctgcgttggacgttccacaaaggtagggactgacgtttattctcgagtcagtgatgttctggagcaaaacctaaaaagaaacaaaaacctaccctctattgtatttgcaactgtttctgctttgcattgtcatgtgtggtttgacctgccttttggatgttttcctctcctgaaacatcgcccagtccctggtttaacctggaaggcgagggggaaggaaggcaacctccctgctaaggttccaggcagtggctttggtgttggaagtggcacttgacgattttatgaaaagtttacaagtccttcctagaaaagatgtaattaggaaaaataaaatacagaagaacgttgagtatgacgcgtttattttaaagggtagtcctgtctcaaatgtgctgcacatttttgtggaaagccaccaagctgggtaactaatgcaaacaacaaaagttgttcatcactggatcaccggcccttaaggcgattccagcccttagtagaacacacacctgtagggcaaatatggagatttgtggtgtagtgctgccaccctcgctccccaactctcaggcattttgcccctttacctcagagaacttctctctgtcagtggttttaaagaggaaacagtttgcaaaaataactttattgtagacatacttagaagtgaatgtttcaatttctggagttttcccatcaattatatcagtaccactggttctgtacaacatcatcttagttagaagattttttttcaccttttaaggtgacgaacagaggcgggaaaatggtccctgcagagggaggccatctccagcaggtcccgagggtcaggaattcagattatccgatctactcctgctggataggagcacacctccgctagaacctgggtccggccccctcccagttttctgcagggcgtccagattccggtgctctgccccgcagcagtgccctgtgggcctcctggcttagctgatcagcacagcttctctgcccagcgaggcaggaccatcctcccactgctttcctgatgccttggatttgctttttttcctcccttaggaaaagcaaaaaaacctaatatgctacatccgagaagttgttaatctttcactaccacatgcattgaaaaatcagttccacccaggaagcaacactaaaggcatattgtaaacacttttttttttttagttggaaagataaacttttttcccccataactatttttagttagccggagactggactcgagtttttacctccggtcttgccccctccactcccgccctcactttctgtggggctcgaccacatggaccatgctggccagactggcaaacatgaaacccaccagaaccaaaagaaaagctggatatgggaaggggccgaagaagtccacatgtttctaaagggcaaagagcctaggctgaggagagacgtttcagatctccaggggagaaagacagccgttaaggagtccgccgggctgctgcctgcctggccagcgggagcctgacttcagatgcctgcgcctcccaagctggccccctcccacacagccatcgccatccagtatttagggagaatccaccgcatgcctgaaggttgcagaagtgaattggaaaccgttacaaatggaattggaacaaatttaaagttaagatggaagagagaatatgttgagttttcagaggaagtcgggtactgcttccttttcttgtctaggtttgttcttgtccgatgggatcagagagatttgagatggggcatgataggcggcgggttcaggagaaagggaagctttagaaatgaaggtagaaaagatgcttgcttattggaacagtattttcaacgttgagctctggaatgttgcagccaactaatggttctcatttgggacagttttgtcccccacttttgaagggagcatttgccaatgtctggagacatttcccttcctgcaactgttaaattagcaaacaggttgagccagctgggtgtggacctgcattttcctcgtggaggccctcttccaagtgtcagtaggaaaagggctcccagagtgtggtcctgctgcgggaccttggcccccacgtccaagtgagccccagaggtgccccaagccctgcctggtcatggggaatctgggctcccgctgaacttgggcgctggggacagctatgagggaaacctggtttgcagctagcttgccgtgcactgactggagctttgggcaaatcagtgaacttctctaacattaattttctcattgagagaggaggtgggtaggagtatatatatatatatgtaattatatatataggggtcgggtagagggagagagagatttcccaggctccttgtattaaaggagatagagttattatatttctcatttagtttttatttatttgtttattttgagacagtgcaattattatagctagctgcagcctcaaccttctgggcttaagcaattctcctgcctcagcctcctaagtagctgggagtaccaaatgcgcactaccatacctggcaatttttttatttttatttttagtagacacaggctctcactgtgttgcccaggctgctctcaaactcctgggctccagtgatccttcctccttgacctccccaagtgttgagattacaggtgtgagccactttactcagtcgaccgacatagaattattataatgcttggagcctaacatgccttttttgtttgtttgtttgttttttctgagacgaagtctctctcacagcccaggctggagtgcagtggtgcgatctcggctcactctgcctcccgggttcaagcgattctcctgcctcggcctcctgagtagctgggattacaggcatgctccaccacacccggctgatttttgtatttttagtagaggtggggtttcaccatgttggccaggctgggctcgaacttctgacctcaggcgaccctcccgcctcggcctcccaaagtgctgggcttatgggcatgagccatcgcgcccggctagcctaacatgcttatagtttcctgttttctgaagttgggaattgggtctggaaaggtatcaccatcagtcacgatggtgtctagtagtttgctttgtttttttccttatcttttccctcttacattttagggctgtatctatataattttattatttaaattaccatatggtaagtttgtctctttgggtgcattatgagtcttgacacatgcatagattggtgtgaccaccatcatcatcaggagagagaacaatctcctcagcccagagatgttcatggctctgtctcccacagttcctccacagtcaccccccccagccccgaatctggggcacccagccatctgctctgctctggaagtcttggggatcccatctgaatgtaacacatggtggaatgccttaggtgaatccatccgctcttccagtaccacctttgcctcctctctctgatgacacatgaacttcatgcctttgtgtgctttggccaaccgcttttcttagaacagcacattttgcactgtagatgttatcacaagcaaggaaaaaacagctttgctccttaatgtaagaaaccacagtggaaaaacatcaggtgtgttgttgaggctgctaaagctttgctcctttttaaaattttttaaaaatttttctggatacgtaggtgtatatatttatggggtgcattagatattttgatatagtcgtgcagtgtataatcacatcatggagaatgggggtatccattccctcaagcacttattctttgtgttacaaacaatccaattatactcttttagttatttgctcttttttcttttattttgagacggagtctcactatgtcgcccagggtagagtgcggtggcgcgatctccgcccgcaagttcaagcgattctcctcctcagcctccggagaagctgggactagaggcatgtgccaccacacctggctaatttttttgtatttttagtagagatgggtttcaccatgttggtcaagctggtctcaaactcctgacctcaggtgatccacctgcttagcctcccaaagtgctgggattacaggcgtaagccagcacgctcggcctatttatttcctctttgttctatgccagttagttcttgatgcctcattgtttcagatgggacattttctaatgtcgtgtttttgtttttgtttttttgagacagaatttcattggtgtttcccaggttggagtgcagtggcatgatctctcctcactgcaacctccgcttcccgggatcaagcaattctcctgcctcagcctcccgagtagctgggattacaggcatgcaccaccatgcccggctaattttgtatttttagtagagatggcatttcaccatgttggtcaggctggtctcgaactcctgacttcagatgatccactcgcctcggcctcccaaactactggaattacaggtgtgagcaaccatgcccgacctctgatgtccttttagaggatgttaccctcacctttattgcacagtcctaccaaaaggtacttcatatgtgaaatgtatcagaaggttatagtcatggctttagtttaaaaacaggatacatgttcattaaggacctttgccgttttcccaatgggttaatcacgtaaatataaaataggctaaaaatatcaagttgtttttgcctttgttgtagaaataaaaaaatgaattcctacatctgtgtttctatggagctgctaacctgtgttttactctgggccatatgtcgctttctgtgatctcatgacgtggcatgttttctaatataatccttgtcctggcattttggtgacttttgtcctgcctgaggtggtctacctggttgtgtgaagtcacagaacctgtgcatgtcctaccgtgtagagttaaagggctggatgagtggcctcaagccttttcctccctcccaggtgtgaagatttggtttggaagatggaccctgcttcaaggtctgggaggccatgtttttttcagactggttaaggatgacggttttatgttaactaaacattgggatcaagtgacagttgtttatgtccggtgcctagagtatcagttttcccatgattaaaataagcgatattttggtaaacattgataagttagttgcgcattttagttcagaaacccacagcgagtcagaaggcgctttgtgctgctgggcgcctctgagtgattccggggagtgcggcagttctccagccccaggagaccctgtgaaagaagcacaaacaatgctcacggcaaaactcacagtgtttattcttgacctgggtgtctgccttgaattcttgtcatttttcctatcgtggtggatgtagccggaatgctttaaagaaaacatgagagttttttctgcctgtttcccttgagcctggaaccgattatgaccccagatagcctgcacagggctctttcctttctggaacacctgcccaggctagaatatgggagtagggaggaggtgaggctctctcctgcccggtaaccttcccggccagctctccaagacgctgaaaccttccttcgggtctgttgaaactgcatccccagcaccatcatgtcggagcaagaagagaagggcatgtgtcccctttaggcttgactctttccaattagggacctgcctgttgttaggatttagagtccatgtgaatgtgcagtattgttcagtgctgcgagcatttttgcttgtctgaatttcctgatagaagggaatttggacaaaaagaagcttattgtacatggtgccattttattccttaaatcaataataacaaatactttatttatgtatttttagagatggggtcttgctctgttgccctgatcatagctcactgcagccttggctttctgggctcaagtgatccttctgcctcagcctcccaagtagctgggccgacaggcacaagtcagcatgtccagctttttttttttctttctttttttttttttttttaattttcaatttttttctagagattgggtcttgctgtgttgcctaggctggtcttgagcacctggactcaagcaatcttcctgcatcggcctcccaaagtgctgcgattacagttgtgagctactgttcctggccaacatatactttaatatggcaagaccatataaaataattttaagaggccaggtgtggtggctcatgccccccagcactttgggaggctgaggggggcagatcacgaggtcaggagatcgagaccattctagctaacacggtgaaaccccgtctctactaaaaatacaaaaaattagccaggcatggtggtgggcgcctatagtcccagctccttgggaggctgagacaggagaatggcgtgaaccatggaggtggagcttgcagtgagccaagattgcgccactgcactccagcctgggtgacagagcaagactccgtctcaaaaaaaaaaacaataattttaagaactggaggaaaattcagcaggactgagtcgtgatttcagtttctggtgcactgtgggtaattgggtaattgtcagcctggatgcttgtgctcctttagttgtcactgttaccttgtcatctatgtgaagatgagaaatgaagttgagtggagaactgtcgccaaagtctgccatgtaaaaatcggtagtgccaatgtgcaaaggtaattcccaggtgctataaaagtccaggtggcttcacagtttcagattgtatttcccgaaagcgtagagaattgatatccctgaataggaaattgacgtccctgccatttggttcatttggggaacagaataaacttgtgtccttgccttcagttcttttttcaacagaatcttatcaagcatttgaatcgtacacaactgtaatgccagctccatgttgataaaaactcaagaattcaaaattataaacttgaaaacagcaattgccaacttctgacagtagcaggagagtctggaggacctgttcagaggaagtcgggtactgtttccttttcttgtctaggtttgttcttgtccgatgggatcagagagattgagatggggcatgataggcggtgggttcaggagaaagggaagctttagaaatgaaggtagaaaagatgctttcttattggaacagtgttttcaacgttgagctctggaatgttgcagccaactaatggttctcatttgggacagttctgtcccccacctttgaagggggtttggtttaattcccaatttgattatgaagaaaataccagattcagcttgcattttcaagacacagtggttctatgtcaacttcagccatttccagggatctgtcttaggatacttcaaaaagcctaacctttgagatgcactcagctcataagttcgtgaaaataagaatgaataatcttccctgtccagtacatgacagaaattattgtagaccagatgagagcaaggagagatacttgttgatattacatgtcacgggatgctctgttaaattttatgggactctgagtgtaattcctttaagccagtagtctctaaatttgggggaaggacaggggacagaaatgacttgtttcagattttaattcccaaaagggtcttagtgagtttcatgccctctggcaggtgcacagcaagatttattgggatgcaggaagaaattatgaaaatgtccattaagaaaatctctaatacttgtaaaaaatatatttcttgtccatgaaatgcatgttacttgagtattttatatatttaataaattacatgagttaggagcaccttctgaaaacttttttgctgaaaaggatatatgatgaaagaaacatttatgatgtaggtccccaaaggctggaagagggggtgataccaacgtccctgcctgcaggtaggacacagttgtactcccctttcctctgacttcagctactaaggtatgtgtgcgtttgcacgcacatgtatgtgcgttaagtaactttgagatccaccagcttaaggactggacatcgttccagaggtacaggtattagtgatttgacttagggaagaaagaatatgcaataacagggaaccatgcacatactggatctattgtattttgcgtgttgtttttaaagctgaaaaaatgcgcttgtttcggaactagatgacagtacctgtttgcaggtccacaaggaaaccttggaacaatgctatgctttttaagcgttttatgactgcattgttttcataatcactgaattctgtttataaatcagctgatttcattgacggatgccctcagggctctggagaattaggcgttttgctgcagaaatggttcagaatttcaaagacatcaacgtgagattgtactggaattgagttgtgataaaagtcctagggtgctttaaatctttaaatctggttatttgtttgtttgttttttgaggcagagtctcactctgtcgcctaggctagagtgtagtggcgtgatctcagctcactgcaacctccgcctcctgggttcaagcaattctcctgcctcagcctcccgagttgctgggattacaggcgcctgccactgcacccggctaatttttgtatttttagtagagacggggttttgccatgttggccaggctggtctcgaactcctgacctcaggtgatccgcccaccttggtctcccaaagtggtgggattaccggcgtgagccactgtgacctgctgtttttgtttttgagacatatttcatctatcatggttattaagtgttttgtttttttgcatttctcattggtgttttttgtttgtttgtttgtttttttgagatggagtctggctctgtcgcccaggctggagtgctcagctcactgcaacgtctgcctcccaagtttaagcaattctcctgcctcagcatcccgagtagctgggattacaggtgcccaccaccaccacgcctggctaattgttttatttttagtagagatgtggtttcaccatgttggccaggctggtttcgaactcctgacctcaagtgatctgcctgcctcggcctcccaaagtgctggaattacaggcgtgaaccaccacgcctggcctcattaggttttttttttttttctgagttgctgctacactactggtgttacagagtgaataaacataaaaattatattcacaactcagaccacattgtgggctgtggaggtgagaaataggaatcatctctaaatttaaggtcttctggctgagctcatttgcttagaatggctgaaggtttggttttcatgagatgaaatgccaacctcaagtggttctgggtttccagaccagtttttagtttgtttaacttgagagaattgatatgtcagctttagtttttgtgtgtaatttttggtgtttgcatctgttttcttctttgtgaatattgaattcgcaacataactttgttatatgaaatgatgctcatacacttgcgcagtgcattagaaagcctgccaggagcagtacttgtagatttccgtgtaccagcaggatgcctaatgccgaccatgattaatgctcatcagaatctatgtagacctccatttgtcctttgataagctgaaatatttgtgtctactttttaaaaaacctgttgcttctctttatggtaatactcagaaggcactcactgtgaagagaggagaaacaggaagtagaattttttactatctagattgatgcacctatctcccctctccagagaccaatgcatttaggccccagtaagaaatttagttgtaatgaaccataaagcagatgcagagtatatttgggaatataccttatctgactccacagcccaacccctttaagaggaaagagatggcacaatatattttgctttaagccttagactggtcttgacttcatattggaaccactgaattgcttcagctgtgaactggaatcctctcctgtctttgttgttgagtgatgacactcttaattaatcatttgcttatttgccatccaaatcaccctatataatctttcagaagtgtatctcagagaatgaccctaagtcggctgacctctgaagcctgtaccagaattgactttatttcttaagcgcacacttcctgtgctttcaaggggcagctgtctaggtttagtttctgggagtttgaggcacagaggtatgtaggggaatgggaaggccaaatggtaaaagcccctgggacgtggaatctgtgagtacactaaccttgaaagagattatgaaaacaaactttagagcattgttgaagcaccatctacataatttatatcaatgaagacagtaacttattaggaagacaggattattaaaattaaccattttcatctttctacaaaaataaaaatcaaatcaattttagttcagataattgtatgtgaagctttataagtgaaaatttgaagttagcaaaattatataaccttagttaattatattagtgtactcaaactaaatatagaataagattagctcatggaaacattgcatttttatctcagtcagtactgctcatatccacccagtagttagtttctagttacgttttgtaattttttgaatatcctggacatggttttagaaaagttagttgaaacaagatattgtatgctttcattatttcccagttcatctttaagcataataaaaacacagagtaagttgtcctttttgaattttctttcctttctaatatgtgtctggcacaacagaggaccaagcccagggatcattaatcccatttttctgcatggcgtttgctgtgagagaagtttgggctggattcgtagtttgctatctaagagtaaatgttcaaccttctctaatttcctgttttgtttgcttttccattcagtgttctatatttggacaacaaatatatttttctgtatgggtttctggtggcccagatgttcattggagtggaaattctttctgtccacaccactgagttgggcagttactggtgtttggctttctctatctcttggagttgacttagatacattgtgtattcaggttgggcactcatcccctttgcaagctctattactttgttccatttggctttgccataaatgtttgcccttggcttgccaagacgtcagctttaagagatatgtcatttaacttagaactcttgagtctgacttaaaattaagtcagttttcttaaacattgttattgaggtataaatgacatgccacaaaagtcacctctttgaggtgtaccattcagggatttttggtaaatttactgggttgtgtagagatcaccatgatgcagttttagaacattttcaattcccaataagatcgctcctactcggttctcacccatttctgctcccacctccagccacgggccaccatgaatatccttcgtgtctctatagattccccttttgtggatattttagagttgtgcttccaagaatgagtatctctgtgcttggtcgaacttcccggatggtgagacctgatttagtgactttgccttccgccccttcatccccaggagaggaaggtggggaaaggggaaagacggcaagtatagtagtataacaggcatcgtgcctcagtttcctcatctgtaaaatcaggataaccatggactagtttcaggctctaaatgtgaaactctgtaggaagtaattagctgggaatctggcatagaggaggagctcattgtttgcgtgttaacagtgggaaatagttaaggaggtgggaaaagagctacctgtagaaaggtggcctaagtccctggagagctgagcacaggaccccagggcacacacccccttatgcttcccctgtctttcatcttgaaagcacctgcctgtgaacctcaggcttggagggaatctggatgttttcccaggatctacctctgctctatggtcctcaatccaaggtagttttgaaaccgcctttgcaaaaattatatcaatgagaaaattataacagtatgttaagctaacccatcccccatcttgcctttcccttaatattcttgggctattgggccaggtgaactttggaggacttttaggctacggtttaaatgataataggccttgtcccaaactcaaaacttgccccaaactgtaacactaatgggaggccatcaggatgggggaggagaggagcctgattgctgctaaggcaaagacatgaaccattgccagattgtcaaatacgcagattcccagttactcccgcagataacatcactgttgtagaacctaagattggccttttgagatatcttttcaggtttttaaaattttcttttctctgaactacctttggggagattctagatcttttaaaaattccttaccaactctttggagatacctcctgcgttcatggttaatccatccccttagttaaggcttattgattgcacataggaagttccctttagtaaaaggttcaaaagctagaaatgtcctggctgaaatccggtaaaaagagattttaaaatgatttttcttttgagagctctgtagttagaaatcgacttaattaaagctgatatgtgtacagatactgttttaaagcccctgttctccctctgaaagcttctgtcaatggacttctgtcttgattcttcattcctgtctttctgtgtattcttctctgttatgtagtgtttatataaaacagctctaaataattggcgtaggccaggcgcagtggctcatgcctataatcctagcactttgggaggccagggcgaggtcaggagttcgagaccagcctgaccaacatggtgaaaccccatctctactaaaaatacaaaaattagccgggtgtggtagcacacgcctgtaatcccagctactcaggaggctgaggcaagagaatcgcttgaacctgggaggcggaggttgcagtgagctgagatcacgccactgcactccagtctgggcaactgagtgagactctgtctcaaaaataaaataaaataaaattggcttaaagaaaaataagcacttaaacattgtcagaaaaatggaaactttaatggcttttacatcacatgactctgatctttcaaaaataaggacagtttaaagattatttgtaaagtaaaataaaaatgtcttcaaagttaacacactttgtctaaattaggcaggtcagatactctttgctggatgttttaaggtcataaactgcttctgtgacttttaataattgtttgacttgtctgtcttacagccattagattctaggtaaggtctggggacacatggagttagccggctcccctggctaggctgggaagaatcatgggttctgtagttttatacatggttaaaattgcttatttaccaggtttttcaccaaaaataaaagttgctgaaagttaagattgtaacacgtataattgagactactggagaaacagttttacatgcaaggcgtagaaggaaagtagaatgtgtgtgtgtgtgtgtgtgtgtgtgtttgagatggagttttgctcttgttgcccaggctggagtgcaatggcatgatctcggctcaccgcaacctccgcctcccgggttcaagcgattcttctgcttcagcctccccccggcgtagctgagattaaggacatgcgccaccacctccggctaattttgtatttttagtagagacagggtttctccatgttggtcaagctggtctcgaactcctgacctcaggtgatctacccgcctcggcctcccaaagtgctgggattataggcgtgagccactgcacctggcgggaaagtagaatgtgtcttgtgggaggctataagaaagcatgggaatatggtttttgtaaaagggaatataattttgtctggttcggaggattttaaggatcatcttaaaagagtaatgggacaaaactgaaagtttaagcaagttgaaaaaggtttgtaaagggttcatcttgtaaaggaagttctgtgggtatgagcaagttggctaagacttgaaggggattatttagtttttctgtaggttgaatattttttgtttgacttttgaatgaatgacagaaaaacgaggagagaggagcctcatactgtctttattttgtcctgtttggaaagttgagtttcccctctatcagtgagtgaagatttttgccttttaaaaattcttgagttattatggctaaataaatgacttctagtgacttgggattttattttgtaatatcaagggtctaaacatttgatatttgacaaaactttccaaagtcaaaatctaaattaagccacccccccccccgcccttattttaatctggttaaccttccagatattaaatactgtaaagtccaaaagagacatatttggcttatttgatatattaaaactataacagtaagcattgtcaggtatgcaatagtgtttggctttctttggactgtatttgtatgaatgtgttgttagtatgtgtttcagaattgtataagatttcctgtaattctgatatgttttagtatatgttatcagtaataattatgattgttaagttattgtatgccacagagatgatcagaccttaactgtggctgttctgaaacttttgtcatccacaattgttttactttggttattttcagggtggttttataatcagctataggactgtgacagttttctgataactttggagattgtgacattaaaatagacgaaaaagcttccaaggctcccattaagagctaatgtattcatggatatcgagcagaacaggagttaattacatggactgaagtaatggaagaccgaaataaactttttctggcttttcgtttgaaacattgctcattcttttgtttttcagagtccagaaaaccttttttttcttttgagctatttatagcttttaacaattggataaagtatgctcttgtgaacaaaatctgaagcacatttctctctctacctgatttctctagaatttgaaaactgtttgcaagtatacttaatttatgatgttatagttgtttgttaaatacaaatctgttttcttttgtagcaggacacaattggagacactggttattttaccaaagctttgattggaatggcatactttcagattgctttaaggaatcaaagttgacttacagagccaataaaagccccttgggtaagctggcctcataccttgtctacacagtccctggacaggttcctaagtaaagaatgtcactttctgacaggtccaggagctccaagttatcttgagcccttgaggtgaggaattcacccaattaatacaagtatttgcaggcacagataaatccgtggctgggctaaatgctttgaagtctaatgtgagatttcttagggaataaagttgcagcaaagccaattttaaaaaggagcatatatggcaaataattgttctagctgaccttatgcaaacactcgggccaggtatagtaagaataaaacttattttgcacataaattagtcctaatgtgatttgtctttagtaaaaatagggactggagagagaaattatgtttcagaaaaaaactatagaacacctgttgttagaatctagtcttgttcactatttttgaatttttattattttctgtcatttggactgaatcgtgaattctttctggactacaagtcccaaactaatgctttcaaatttttctttcatttctaacttggcctcaataaaattgctactacctctttcctgaggtcctataagctgaagcttattatgagagaaaaacatgtcagattgccaccaccttcctcgtctataactaaagatgttttgagtctaatgtctggataaattgtgcccagtgttaatctttgttttttttccgtgtctatggaaatgcctcttacagaagcttagcccatctgcagtgccacctcctgatatgggaaacagctgtttaactgatctagtcttaggacttggacactgactaaaaagatatgggacaatatatttaaattcactctttcctgtttatcccagtctctctttctaacaacatatagtctactgttgacttaagtgttgtactagaactgtgagtaagaacattaacatctttgtcatacacccgtgagtacatgcaggtagctgcacggtggtgagctcactcctattcccctgggaccaacccctgcaactatgccccctgtcagcaggaagaagccagagtgatggtcaccctttttctatctctatagccagcaccttaagaataaggtgtatgaaagccaaagggggtattgaaaccacctttgcaaaagttatatcagtgagagaatgatgacagtgaaagagatctgagctaatccaccccccatcttgcctttctcttaattattcatttcccttaattattgcatttcccttagttattccatctcccatgtggtgtggctggccttgtgtctgttaaactctttctctactaaaatgcccatggtctttatgcagccggcaggaagaacccctcaggcggttacagttttgctcccaggggacagttttggttgttataaatgaggaaggtgtgctcttggcatctagcaggtagaggccagggctggcctcctgaagtgcagaggaaggtcccctcctctttcaagagagttatccagccccaaaaggtcagcattgcagaaattaagaaaccctgacttagaagctttgcacctcgtggtagctgtaaatgaggtatttacatcctccatgaagacgtaaggaagttgaaggaataaaaatctcatggggctttgaaagcaatgcaagcatcttttagttttcatacattccatggaagtagggatttttttctaaagcaaaaagaccaacaagactttggagctcagtttagaagaaaaaagtgactttcaaaccctttagaagtattcatttacaaatgaacaatgaaatgactgtgtagatggagaaaccctgagcgccccttggctttgatctggtggtcacgttcatccgtgtctgttccctgaagaaccagtgcccacatttgcctgccttctttacctaactccccccaacaagagctgaccctcctcccatcttctcgcctggttggtctttttcctccctccccctgaagcctgcctgcctctgctttccaccctccgacaagccctgatctgtgctctgaacaaactcctatgcgggtctctttgaagtctttttgcctgcccctaagtgcatccctcccacccccacccaggtgatactgaatctatgtgaatttgtggagttctcccttccttcccctctggcagaatcaccaggattcagtctagagtacaacattatagatgttttctagcacttttcagctgtccatacgctaatatgtagtcttgggtctttatccgaatggagtcctattatatttgtttcacaccatctgctttccttatttttgtatctttactgaggtatattgaagtacagtaagctagacttgtatgaagtgtgcagttttaatctgttttttcttttttatttctttgtttgtttacatacattttttagagacaaggtctcactatgttgcccaggctggtctcaatctcctgggctcaagcaatcttcctgcctcagcctcctgagtagttgggactataggcgcatgccaccacacccggttaattttttattttttgtagagatgagggctccctatgttgcccaggctggtctcaaactcctgggctcaagtgatcctcctgccttggccttccaaagtgctaggattactacgggtgtgagccaccgtgcctggctcgttttttcatacacacacacacacacacccatatttgtgaaaccagcaccacagtcaaagaatatttccatcactctccaaagtttacttgtgcttttttgtaatgtctctccccctccctctacccctttcccaggcagccattggtgggcagtctgtgactattgcattttctagcaatttatattactgaaatcatatggtatgtactcattattttgcctggcgtctctccctcagcatcatgattttggggcttcatgttgttgcacatgtcactaactcattcctctattgctgcgtaggattccttcctgtatggatgcactatggtttgtgtatccattcaccagttgttgaatgtttgggttgtttgttttttattgtgacaattatgaataatgctgctgtaaatgtttacatggctgtacagtggttctcaaacttcatcatgcatcggaaccacctgcagagcttgttaaaacacagagcatccaggcacggtggctcatgcctggaattccagcaccttggaaggctgaggcaggaggatagcttgaaccgagaagttcgagaccagcctgggcaatgtagagagaccctggcactaaaaaaaaaaaaaaaaaaaaaaaaattagccaggtattgtgtgcacttgtagtcccagcttctcgagaggctgcagtgggacaatcacttgagtccaggagtttgaggctgcagtgagctgtgattgtgccactgcactccagcctgggtgatagagcacaagaccctgttgcataaatactccccccaaaaccccagaaaaaccaacacacagagtggcaggccccatccccagagtttgtgattcattgaattaggggctgggttaagactctgcctttctaatgggctctcagctgatgctggtgccaatggttcaaggaccacatagacttcgagggctgctgccttaaaggaagtctttgtaaattatgatagttaatcgtttgttagttgttccaggtatttctcttctagaccattccttgccatgtaatgttgcttatggtttgaagcatcaagctcgcatttttgtgtagtcgaacatgtcagtcttttctttgggcttctgggcatggcttccttccagcaaggggcagataccaagaataacttggagtaggtgaggcaggttttgatgttagcaaaactcaaaccatgacactcccccaaatgggagtctgccctcattgggcctaattgtgccctctgctgcagatgctgggatggccttctgatgggatggccgggctgtgttgtcagcacccgcccacatgagacgagtttgtagctgtgcctggtgccaagagctctgaggtgctactatgccccctggaacctttgggcaaagcatagctagtcatcaggcttgcctttcacaggcaaaccaaatccatcctttcttcatccccctgccctgccaaaatcaaccagtctcaaatcaattcacgaaagggggccaatttgcctttcgggtgtctgatctaacaagccttggagcagctaggaagctaccagaagatgtgtatgatcaatgtatttgttatttattttattttatttttttaagtttggggaaaggtaatacttttggtcaaccatctgaagggactccctcctctaggccagggcactccatagttaacctgaaaaactggttcagggcatgacaggaagggggtttgaacatgcttcattatgccctcctcccttttggaattcatgaacagccgacagcatttaacacagaccttaagtctgataagaaacagttacaatctattttctctgaagcctgctacctggaggcatcatctgcgtgataaaacctaggtctctacaaccccttatggtacctggacatttttttctattgataatagcttttttttttttattattgagacaagtgctgttgcccaggttggagtgtgatggcatgatcacagctcactgtagccttgacctcctgggctcaagcgatcctcccacctccgcctctctagcagctaggactacaggtgtgtgccaccacacctggttaatttttgtattttttgtaaagacggtgttttgccatgttgcctaggctggtctcgagctcctggactcaagcaatctgcctgccttggcctctcagagtacagcgattataagcatgagctaccaggccttgccgataataactctttcaaccagttgccaatcagaagaattttatcccagaacacacaccccccccccacgcccccgccgcctcaagtcttcccacctttctggaccaaaccaatctatatcttaaatgtattttgatatctcatgtctccctaaaatgtataaaaccaagctatgccccaaccgccttgggtacatgttctcaggatctcctgagggccatgtcacgggccatggtcactcatattcagctcagaataaatctcttcaaatgttttgcagtttgacttttttcattgacagagagcagctttaaattactgtggactctttgttgcaaaagcatcttcttgaatttgataataaagccctactcttccagtttgtccctgagtgcattctgcaggtacctccggtcaccgcttcttatctttgctgttgacctcagttcattcctttcagattcttcactcaggagaagtcgtggaacagattcctggaggattccaggctctgtaaggaggcttatctccttaggatggttaaattttggatttgcagtgacttgtaatcattggctaatatcctagtttcttcttctcttttttaatgacaactttactgagcatacacacaactcattcctctaaagtgtgtaattcaggaatttcctagtatttttacaaagttgcacaaccatcaccactgtctaatttttgaacattttcatcactcccaaaggagaccctgtacctgttaagacatcactgccccttccccttctccccagcccccctggcaaccctgaatctggtttctgcctctatggatttatctattctggacatttcatagatacagaatcatgtgatgtgtgaccttttgcgcctggattcttacttcatatttctgagtttcatccatgttgtagtatgtgttgttctagtttcttgtaaatgttctgtcaaaaccccaggtgattaaggaaggtggaacaatgttctgagataagtcagccagagacacaggctgctcctccctccaattacatttaaaatggaaaatcgttcacaaatggaacattgttcataaaattgtttatagttcagcttctattctagcatgaacggtaattttctctttcgcatttgctgtagttcctccaaatttctcccactttcctatacctaaaggtcaacgtagaaaacaattttcgtcagctagagctgggcctgcaggtctctcttgtgttgcatcttttgggtggagtcagaaggtcctttcttggtgtaagagttaggaagcttgcatttcccaaaggggttgtgtggtgttccttccagagctgaggttgtgggattccaagcagcaagacttaggctgttttctacggcgtccccaaagtcacaaccctgactgatgcaggaacagaatcataaggttgtttacttttctgaatttatcaaaccttttgtctgtgtttgaccaaaattacttttcccgggttgggttggagaatatggagggtgattttctgaaaccattcatgggacatgattttctggggcatctgtacctgcaatgaagggcttactgataagactgaaggccattgtactttactggttggtgttataattgatcatattcatttcttgtcctactgtgacaagtgactgcacatttactggcttaaacaaaaactattatcttacggttctgaaggccagaagtctgaaatgggtctcactgtgctaaaatcaaggtttagcagagccacaactttcctggaagctctaggggagaattggcttccttgccttttccagctcctggagactggccgcattcctgagcttgtggccccttcctccatctgcagaggagcagcgtagcacctctctgactgtccttccataggcatatctctctgagaccatagctgggaaaggctgtccacttttccgggctcctgtgattacattgggcccatccggaagatccagaataatccccacatctcaagagacttaatttaatcacatttgtaaagtcccttttaccatataaggaaacatattctcaggtcccagggattcaggcatgagcatctttgggggccattattctgcctactacattgtcagtcttcaaggacagacttacttcctttgtttctgtctcttaatttgctcctctgaagcctgcaagattcataggcttatgtaacgtttgtgttttgtctctcgaataattgagaaatctggtactgttgagccatttggtttgtattgctcactcactgagtcgattgattggttggttgattgagtgattaatagagacagtctcattttgttgcccaggctggtctcaaactcctggtctcaagcgatcctccctccttggcctcccaaagtgctgggattgcaggtttgagccaccatgcttgccctcagtattgattccctctgaatgagccaggatttgctttccattttggagagcccctagattgctgaacagctcagagacacacttgtgtattgaggtcctctttcctgccactcttggttttggactttatcagggactctgccagagctacttttctggacttggagtctcagagtctgtgtcagctgtgggtaaggaatgagaccaccatgaagcaagcagaggtagcgggtggggcctggcttccaggactttgcagatgctgtgtgtggatttctggggcctgaatcaagagcccctgggtttgtggcttcacagaatggtggaggaagactggtggagttaagggacagaagactcaacaataattagcttgttaatcagcattttggctcaaaaatagtttgggagtatactggtcagctttctgccatgctaatgttgcataacaaacagcccccaaattcagaggcttaaatcgtttctttcttgctcactagtcatggttagctgtgtctctcctgggcttatatgggaataggaaggcctggtcaggttctgggctaggcttagggttgaaatgatgtgtctcctcatcaggggaccctggggcatgttgtttgtgcctctcccatcaggtataggaagccaagataaatcatgcaggcacatttaaagtctctgtttgtcactacccctaacatcccattgaccaaaacaagtcccatggtgaggtccagcctccacgggttggggagggctattctagtctgaaagccctgaaaagtcacatggcaaagggagcagccatagacttccactatgggaggatggaagagttagcattgcagtgcctctgccatgtttgtgggtggaagggaaggtgatccctgtggaagagactgtggatacatccagtcataccctagaaaatcagctctataggtggatttttgaagcactgtgtgcttgttatctttttattattactttatttttgagacaggatctcactgtcacccaaactcgagtgcaatggtgagatcatggctcactggtgcttctttcttctgggctcaagtctcctcccgcctcagcctcccaagtagctgggaatacaggtgcacactcaccacattcagctactttttaaacattttttttgtagagacagagtctcatcatgttgtccagactagtcttgaactcctgggctcaagcagtcctcccacctcggcctcccaaagtgcagggattacaggtgtgagccactgcacctagccagggtgcttgttaaacctgcagcttccttgattccatcttagagccctgttctcacctgaggagaggggattgtgccccttggggaacatttgacaatgtcgggaaacacttttgcgtttcacagctgggtgggggttgctcctggcatcttgtgggcagaccccaggggttccactaagcactgtaatgtgcacaggacagcccccctcaaagaattatctggcccaacaaatgtcagttctgctgaggccaagaaaccctgcacaaacaggcaattttaggtgattttcatgcactttatagtttgagaaccatgtcttgcaagactgttccaactgggaaggggaattggtgattctttccatataagtagacacggacacatctaggaaggaaggtttgatatctcgcagatagttgtgtggagaggcgaattcaaacccaagggtcttagttagatctattacttctgtaattaaaaaatatgttctgctcatattgtattaattctttgttgtattaagtatttactcttgctgtttattagtagcttaataaatggaccgtttatttggtgtgggaagaaatctatgttttattagatttctattatgagcttattttttttctaagtggccttttgccagctgtttcttctgtcctgttattcctgctcaccagcaagattataaattcttaaaaaatttgtttttaattttttttttgagaggggatctcactctatcacccaggctggagtgcagtggctcaatcatagctcattgcagccttgaacttctgggctaaagcaatcctcctgcctcagcctcttgagtagcttgggactataggtgcatgccaccatgctctgctagtttttaaattgtttttgtagagatggggtctcactgttgttgcgcaggctggtcttgaactctagggctcaagcaatcctcctgcctaggccttccaaagtattgggattacaggtgtgtgccactgcaccaccgcatcaccgcacttggccagtatatttatatatatatatatatatatatatatatatattttttttttttttttctttgagacagagtctcactgtgtcatgcaggctggagtgtagtggcatgatctcggctcactgcagcctcgacctcccaggctcaagtgattttcccgcctcagccacccgagtagctgagactacaggtgcataccaccacacccagctagtggccagtaagttcttaatagcagtgatcacgctttatattttgtttctactctgcacagtactcagcatacgataatgatcagtcagttgctaatggtatcaattgcaatgtgagttgcgctctgtggttaaagactcatttatgaggtatccgtggaccagccttttatactttgctataaatcctgtttctaggcttttggggctgaatggttggcatattgatgctcggtttctgtgtggcaattaggagaaaaggtccttgtcactggcaagctgacagcctcctttcttctcctaccctcaagttgttttggtgattgaaatgtttcagatattaaaaaaaaatcaagaattgcttgctgataggacaacagaagtacagttcagggagttaaagcttctccattccccacctcaattgtacacagcaagcatggacagatttccttgtagaaagcatgcaagcagcatttctatggaggatgctgtgtcacctgaaatttgctatgctcagatcagccaagtattgcctctgggggctaccagcaagttatagaaataactttgttatgaaatacttctttaagggggtgttagtattgattcactgaagtggttctccttgtgtacatggagtagttgtgagacgaaggtttcttttcttcctggctccccatgtgggaaggacgcttagtggtttgtgggatgcagggagaggaacagagtccatccttcagttgctctttttactaatttattaacttgcctctcatccccttggctgttaagacactaagctggtgtgtctgacaagcagatgacctaaaaattcacgcgtagtaaaagggaagatgaaaatagaagtatatgaactaaattaggaggaggacttggcttcattaaaaaaatgagaaagccatgttgtgctttttttaactgccacttttccaagtgcaggactaacagtttcagatgtcattatgctaccagtcttggtaatttctaatcatgttttgtctaaagaatatttacattaaaatgagccagcctctttaaagtcacattttagtagtgagaaaaccaatgtccgtttttggaaagggagcccttacctcagctggtgtgagcgttttgtggaggtctgcggtgtttgtgacttgtgccagaggccttgagctagaggcaacataagaaggaatcaaacttccctttctgttcggtatgcctctgtaccaagacgttttgttgattgattcatggcacggtgatacagggtgcatggtatcagatgcagggagtggaatattgttgagattggggctagagggtgtgtgtgtgtgtgtgtgtgtgtgtgtgtgtgtgtgtgtgtgtgtgtgtgtgtgtgtgtaggggaggaaggaatggaaggatgaaaccatttgggaatgtgctggaagacatgcttttgaggacaagcaatgcgattttggcattggctgggtttctgagccagtgatgaatgtagtgcattgctatgtgactgggagtgtgatagagagatattccgctggttatttccctccacctgcttcttatcagtgccatagggcagagtctcaattccacttgccagaatgctttctaggaactctttatgctcaatggaggtgatgttttcccacttgctatgctgtgccttagggaacaggaactggtattatcacataagcaatctctaagtcccttggaagattgtctcattcatcaagagggagaggattctgattttcctgcctggctcctccaggaagtctaacttcttgcaggggacctgttctctcggcccacttgtacagcatgtataaaaggaaatgaagacttttggggatttgttgattcacttgtttggaaattggggttatgtaagcccaatttgagttccaggactcatctatgattgcctggattaaatcaaaggacacccatgtaggctggacgtgatggctcatgcctataacccaagcactttgggaagctgaggcgggcggattgcttggacccgtgagttggagaccagcctgggcaagatggtgacattccatctctactaaaaatacagaaaattagccaggcgtggtggtatgttcctggtcccagctacttgggaggctggggtgggaggatcacctgaacctgggaagtcgaggctgcagtgagctgatatcctgagatcatgccactgcacttcagcctgggcaactggagtgagatcttgtctcaaaaacaaaacaaaacaaaaaaaaccaaaaaacaacctgcgtaattgtagatttttgttgttgtttgatatactgtctcttttcctggaaagaaccctctcgtgggaacagaaatgttgaatttagtcctgatgctgtccctaaccaccccgtgacactggtcccaggaaaatataggaattgtctctctttttctgtcatctcagagcttgagacaaatgttctctgaggttgttttagcaccacactgtgattcatcttcgagactgttcacagcccttgatctgaattgatggagctgtgggggatcataccgccactgccagtgctgagagctgcatgtggtgcggtccagtggctacagcgttgtctttgggatcttcacttggcaccacagcggatttgtataattattatgttgactggaacttagagtgactcaactgccttgaacaggaaccaagaaagagaggaaccaaattccagaagagaatttgccagaacattccagcatattccatactctagggttgtcttatagggtctgagggtacttcttggttatctactcatgtgcgtctgacataattaaaggccgacttagaccctatcagagaaaatcaagttcagacacttagtctaaatggaagtaaggaaaacgattacctttatctcattatcttagttctctttggaagatatataagcttgaaccatggtgacaggtgttgcctttaaacatggtgacaggtgttttcctttaaagtccttggcaaatcaactcatagacttcttcaacttcaaaaaaaaagtttttttaaaaaatattttaaaaatatttaacttgaggatcttcattgaaaattggtcatctttcgtgaatttgcttaagtaggctttgatctctttttaaaggattccttcctgcctgatacatttggtccttttagaattcgggctagaacaattctccatgaaggtggacgtgttaaaatctatttggttcattgttaggatcactcacattacaagagaaatttcggtcttgagtttttgtttttgcttatttgctttcttggaaatgtttccacatcaggtcttagaggagttgtaaaacaggaaggaggagttgacatgctgtttcataaccaatgcttgcttctcgccttggatactaacattttttccatccatttcccacataaaacatggagacaaacaccagagctgctcctgagaggtgctgagtcataggaattgaagggggctgttgggccctcgtgtgtgggatgggctcaagagctatcagtctacagagggaaaggttcatctctgtccctcattgcctgcagtttctctttggccctggctttttccgttcacagctgccctcgacgttcattttaatcaaatttcacctgcataaaagggctatgggcagagagtcttctctgtgatggagcgcagctatcctacaagtatgtagccctgatttagtagagaagaggcaggaattgtcgagggcggaggagcaggagaaatggtgcacaagggagaggggataatgacaggtcattcagggatgtctacggaatgtgaaaatgcagcaagatgggtttcggtttctttttttttaggtccgacagagattcctgggatagctgcatcttcatgttgtacacgcatacacttgattcccattattcactggagctatgttctgtaaagtcgctgagactttatagaaagcatcaccccagggaaaatacacagtgaggcttctgcgaacctctggtcacaatgttgttgtcaagcagtcagtgcataactttgttgtatgtatttctattgtgtgtttctgttggttcctttacattgcactcacgccaacagcactgtgactcacgcctggccgaacctcatctaacgcacgtattttccccataagacgcatcccagccttgtgcttcaggacatgagacagcactgcagcatctgggggccattttaagcagcaaagtcacccagaaactacaacatttcaaaaaactggcactgtgaatagactgcgaaaaggacacttgtttacggagtgagagccttgttcaccctcagctgggaacatgtgcatttggtgacacagccacacgctgcatgtttgagaatgaccatgaaagcgctgcaggtactgattttggagctacaaataaatgttagccaataggcaaattcacagacacggaatccgtaaataacaaggcttggctgtgtgtgtatacatagtgtagtgttgatagtgtgtatacacaatacacattgatattttgggagagattttgaagaagtcaccatgaaagccagtgtgtccgtttggccctctggaaagcgtgcggtgaggaggagtcagggtacaagtgtttaaattggggacatggcctgaggagatgaaagagaggtggggactgagtagggaaagctccacaccacaatgcataactgataaggttttggccaacaagccagagaaccctagagcaaagagtgccccttgcttacagccagagggccttgctcagtgaatatagggggctaggagtggggaggcatctccaaaggagcatcgtggatttgcaactctgtctttctggaaaggatatgagagtcttgccctctcccccagggctgacacagttgtaaaccaaacttttgacttcagttgtacatatcaattattttgcacccacattagattgaaccaaatgacactggctcttttaaattaaaagtggtcaaatgctggcagcctcttagggttcaattcaatggaatcttttaaaggtgcaataatgctgtttgaaatgaggagaacgcctgtgttttgtttgctgagagaaatccactatctctcatccagaagatgattagacccataatggaagccagtcagtggcatgaggaatcatggagatgattctcacctggttgattggatcagacgttcctagcccgaatgagggtggaaagggaaccaagagatgaagtggattgttgggtttatgagaggacggtggttgtctgtctatagttaaggttgtttaaactcatgaccatgagaatgagctttttctggataactctttccttttccttctgatttttgagagtgctgaaaactcaagtcctgtatttaaaaattccatcgttgaaaacatgtttcaaggacagatgacacacttatgattatagcatctgaagtgatgggaatattaaataacctttggttggacatgtaaccatcagggctccacttggtcttaaaaccaaacacacacagttcttgtcgttaaagatatccatggcctggcacagtggctcacgcctgtaatcctaacactttggaaagccgaggcgaggggttaacttgagcccaggggtttgagaccagcctgggcaacatggtgaaaccttgtctctacaaaaaatacaaaaattagctgggtgtggtgttgtgtgcctgtagtcccagctactagggaggctgaggcaggaaaatcacctgaacccaggaggtggaggttgcagtcaggcaccatcctgcgattgcactccagcctgggagacacagccagactccatctcaaaaaaaaaaaaaaaaaaaaaaagacttacacagagaaagcctgaagcccacaagagcaattagcaaaaggaaccctgacataacaaatacggtggtgtcattagcaaccaggtagttaagctcaggggttgctatgtgtcataaacttgaaagctacattggccacgagtaacacaaatgtaggtgctaatcacagatagttggtgggcatttcaaactttctcttcatatctatggatacccaaaacagtgtgcttccatttagaaggcttccattgggaggctgagacaggaggattgcttgagtccaggagatcgagattagcgtgttcctccctccctccctccctccctccctccctccctctctctctccctccctctctccgtctcttcctccctccctctcgtttctttcttttttcttttctttctctctctctctgtctccctctctctccctctccctccctccctcccctccttcctcctcctctctttcttttgaggtggggtctcgctaagtttcccaggctggtctggaactcctgggctcaagtgatcctcctgccccagcctcccaaagtgctgggattacaagcatgcatgagccactatgccaggcctattttccctttcctgctatttcctcccagctaacgcgcttttaaaatttgatacaaattaatttttctttttttgtcttttgttcaaataatgatttgatttctgttctctgtctgggtcgcttcaataacatggatacctacacatagttttatcagtaaaggtcattgacataatcagtgtgttgtgagaacaaagataggccctcatttaagctgctccattactcattttataagtcagagaaggaaggggacagcgtcctctgttttcagatggctattgaagtgagtcagagtgacggtgagcagcatgcattgaattctagctggaaagagggtttttaggcctgcgtttgagcttgccctgaatgaataaggctggaaacctataggccctggagaacattaatgaggaatctgctttccctgacagctccttgataaacgaaatgatggatgtgcagcgtgcagccctgagcaaaggcctggcagctctgtggctgagccctagagggctgagctgggccagggctcccagtagtttgttcaggagcactgagagccacagcaggtgctgatccagctcttgccttcttcgcgagtatctgacaagtctgcagagaccgcaggagcctggctactccttgagttcactgtcttggagcaagcctgtgggggaatcacatgcccccccactctagtgcccattggggacatggaggagggagtttccctatttgcagttaggttttgcgtgctgtccgcgagcttggtttcccctttgggttgcacagtgctgagatctgagcccaaggcagttgggacattaatgatgagacagaggaggctttgctgtgttccacatctatcaggctgctttgcccagggagacgccccccttgcttggggtcttgggcttgggtaggggttctggaatgtctcccctccagcaggctctgcctccttggcttccttgattcagagagcagtgcagtggctttgttgaggagcagcccctgtggaggcgctcatgggtgacaggctgtggctgaatagtggacagccctggtcactgacattaacatggtgcaatagagccttcttatgtgttccttggttcccactgccctttcatggtcgggtgtcctgattgtctgtggctagactatgccaacgtgatcagtgtccttcccagaacccctgaaagagggtcatagattgagatgtctgtcaccacccctgtccattgcagagtcacatacatgctagagaccagctcgcccttgatgcgacctgaggacctcgcccgctagtcattacagggaggggaaagacaataaaaagatgaaagagagtgctgtccctggtaatggaagttactcatcattgtaccagtgggcagccacatagggataggtcggaagagaaaggggaaagagtgaataaaaaacgctgatgtttgtgaggccgagagaggaacagaactattactgctggtcaagggggccatccacttaaaatgttcacatcctgtttcagccacaagctggccaagatcatcacataaagggacaaacgttggccccagaaagaacgcatggtcatcttgagtcaaggctgtctcatttgatgtcagaattcttaagagctgctctggctaggtgcagtggctcatgcctgtaatcccagcactttgggaggctgaggcgggtggatcacctgaggtcaggagttcgagaccagcttggccaacatggtgaaaccctgtctctactaaaaatacaaaaattagccggacgtggtggcaggcacctataaccccagctacttgggaagctgaggcaggagactctcatttgaacctgggaggtggaggttgcagtgagctgagatcaggccattgcactccagcctgggcaacaagagcaaaatcctgtctccaaaaaaaaaaaagaactgctcttggctgggtgtggtggctcacacctgtgatcccagtgctttgggaggctgagacgggaggattgcttgagcccaggagttcgagattagcatgggcaacataacaagaccccatctctttaaaaaattagccaggcatggtggtgtatgcctgtggtcccagcaacatgggaggctgaagcaggaggatcacttgagctcaggagttggaggctgcagcgagccatgatggcaccactgcactacagcctggacagcaaaggaagaccctgtctcaaaaaaaaaaaaaaaaaaaagcaagaaaaaaaaagcatccaggtgtggtggctcacacctataattccagcactttgggaggccgaggcaggcagatcacctgaggtcaggagttcaagcccagcctggccaacatggtgaaaccccgtctctactaaaaatacaaaatattagctggatgtggtggcgggttcctgtaatcccagctactcgggaggctgaggcaggagcatcgctcaaacccaggaggtggaggttgcaatgagccgagactgcgccattgcactctagcctgagcaacaagagcaagactccgtctcaaacaaacaaaaaaaactactctccaaacagaacctgcacctacccaattgtggtgggtgcccctcctggggctcctgcagtagcggtggtgtgggaattgagaatcttgcaagtgctatgagggagctgagacactgagtgtggcagggccatgtgcccagagcatgcacaacccatcctaacgtctgccggggaaggtgggggatttctgtgcattgcttttcaaccagaaaggtaatttttgttccccaggggacactcggcaatgtctggagacagttttggttgtgacactgggttaaggagtgctactgtcatctaatggatggagagcagggatactgctgaacatcccacagtgcacagggcggcctcacaacaaccaagaccacctggcctcaaatgtcagtagggctaacatccagaagctctgcgagtctgtgggaagccctggatgccccaatcctctttcattttcttctcaccacgtaggacagtttagctggacagtacacaggactcattcaaggggtcatgagaggagacctcatagcataagggtcaagtacaaggactttgcagtcagactgacgtgggtttcagtccctacccatcctagtggtgtgaccgagagcaagttgggcatagtgacatctgtcttgattgactttggagtttgacaggcagtacatgcaaagttctctattcccatgtcactcagagtgagtgtgcaaaacatactattgttggcatccatcgtcataagagtcactgtgaacatgggtgagcttagcaccttgtggcacggggctgtggtgagggactcagacagctttatgattgagtttgggcctcagcgagatggcaaagctatgcttctcttgctccttggaccatggtgacctgtgaggacccctgggggctgccttctccactgttgcagttcagggagctaaggccaaaggctactgcagtggtggactctggggtccccctggtgacaaggaagggactttgagctttggaatgccctgggctgagtcttgccacctgcaggtttgtgaacctcatcatgccttgtttttagcacaacaaaatgggataatagtgactttattattgatatactattatgctgttttcaggtatgtgacactgctgctattttactgtttcttccagatttccgtgagggtggaagaaaatcataccatatcagatgcctcgcagagcaccaggcccaccgtgaaaggtacagcaaattttacttccctcttcttgcctcgttggaaattctttcctgtgagatttcctcccctccgccctccgcgccttctgccatagcctatagcctcctctgggagttcttggataattttgttgccttatacctttgcaatttccagtatggtagccatgcgccacatgtggctgtggagtgcttgaaatgtggccagtctagattgagatgccttgtagaagtataaaatacacactggatttcaaagacttagttcaaaaagaaagaaagcaaggtatcttattgataatgtaatacagtttacatgttgaaatgatcacttggatacgtggagtaaaatagaatgtattattaaatgtaacttcacctgttttcttttgacatttttttgtggacccagaaaattgatagacaggtggatttccttcacacttacacacttgtcttgctcaagaccagccctgcttcctcactggctgctcagtcaaatgcctcctccagtttaagctgtccatcacggggccacccattatgtgtccatctcatcttctctgctcagtgcctgtgcaggcagctggtgttcctgctcctcccgcccagctttgcttatgatgctagtcttgagtgcaggctgctgagcttctcacctttcttcccatacatgtagaacctctcctccagaaacatggggtacttaccagctggcaaggagcagagctggggttcacattcatttctgtcttgctccaaatccatgtccctaatagattactgtctccaattgctttgtggatgtaaacacatagtaagttcctagagagcagggaccatttttatttctttcatctctgctgttcaagacctttctaaagcttttttgaaagaattaagatttctagtctcttgcccttccactttctgctatgtgaagacacagtgttcctgccctctgccctctggatgctacagcaacaaggtgccatgttggaaggaagcagagaacatccctcaccaaataatcaatcctgctggtgccttaattgtgaacttctcagcctgcagaactcacgaaggtcatcaccatgtaggctgattgatcttggacttccaagcctccagaactcaaatcagtgaatttaaaaacattttatggagggcggggccaagatggccaactagaagccacggtgttgggaggctgctatcagaaaagaccataataagcgtgtgaatccttcatcagcaaccaaggtatctgggttctctcatcaaaattgactagaaggctggcgtgacccacagagagaaggaagaacagtgtggtgtggcggcccacctgagagtcacatgggaaagggaaccccctcactccagataaggcaggaggtgagtgagcacgctacccagccggggaaactgcttttccacagaactgtgaaacccacggattggaagatctcactcgtgaacccacgccaccagggcctcgtgtcccagccccagaacacacagattcttacagcctctcagctggaatccgcttaagcttaccaaactcctcggggaggggtgaccagtaccagctgcagctgcctgctgtctaagccctttgaactcctgcagggaggggcagcagccagcactggcaactgcctaacatgctaagctccctggacagggggaagggtggcacccatttctgtagctacaggctacgcttttcccctgctagagccagggaggctggacagcttggtcccaagacttgtccccacagcccaacacactggctgtggcagtctgcggctagagtgcctcttcaggcccaatcccaacccatcctttcttagttggggtgtgtgtggggcggggcgcttccctgctggatctccagtaactccagccagaggctaagggacagaatttggatctcctgggcctcagcccataggggaggggtggccgcagtctctgctgaccagcagatttagcttttcctcctggtagttccaaggaatctggacagcccagatgagtgggtttcccccaagcaaaacacaccctctccaccaagggacagagtgctccattaaacgggtcctgctccctgtgtcacccaactgggtgagacccttcaacagggcttgtcagataccctctgcaggagtgatcctactggcatcaggttggtgccccttgaggtcagaggtcccagaagaaggagtaggcacccatctttgctgctctccagcatccttaatgacatctccaggcatgggagcgaatcagatgaataaggcctgaaggtgaaccaccagcaaactgcagcagccctacagaagagggactggactactgaaagaaaaacaagcagaaagtgacaacaacagcatcaacaacaacaatcaaataaaaggtccccacaaaaatctcatccaagggtagcagcctcaaagactgaaactagacaaactcatgaagatgagaaagaatgaaaaaatgctgaaaacccaaaaggccagagtacctcttctcctccaaatgattacaacatctctccatcaagggcacagaactggacggaggatcagatggatgaattgacagaagtaggcttcagaagatgggttataaaaaactacaatgagctaaaggagcatgttctaacctaattcaaagaagctaagaaccttgataaaaggttagaggaattgctaactagaataaccagtttagagaggaacataagcaacctgatggagctgaaaaacacagcacgagaactttgtgaagcacacacaagtatcgtgaagcataaacaagtatcaacagctgaatcgaccaagtaggagaaaggatatcagagtttgaagaccaccttactgaaataagacatgcagacaagaatagagaaaaaagaatgaacaaagcctaccagaaatatgggacctcataaaaagactgaacctacgattgagtggagtaccagaaggaggtggggagaatggaaacaagctggaaaacacacttcagggtattatccaggagaacttccccagactaccaagacaggccaacctgcaaattcaggaaatactgggaacaccattaagatactctatgagacgatcaaccccaagacacataatcatcagattttccaaggtcgaaatgaaggataaaactaagggcagccagagagaaaggctaggtcacctacaaagggaagcccatcagactgacaatggacttctcagcagaaactctacaagccagaagagattgggggccaatattcaacattcttaaagaaaagaattttcaacccagaattttatatctagccaaactaagctttctataaaatcctttccagacaagcaaatgctgagggattttgttaccactaggcctgccctgcaatgtctcctgaaagaagcactaaatatggtaaggaaaaactggtactagccactgcaaaaacacatgaaaatataaagaccaatgacactacaaagaaactgcatcaactaatgtacaaaataaccaaatagcatcatgatgacaggatcaaattcacacataacaatattaaccttaaatgtaaatgggctaaatgccccaattaaaagacacagactagcaaattggataaggagtcaagactcattggtgtgctgtattcaggagacccatcttacatgcagagacacacacaggctcaaaataaagggatggaggaaaatttaccaagcaaatggaaagcaaagaaaaaaagcaggagttgcaatcctagtctctgacaaaacagactttaaaccagcaaaaataaaaacagacaaagaagggcattacataatggtaaagggaacaattcaacaagaagaactaactattctaaatgtatatatatgcacccaatacaggagcacccagattcataaaataagttcttagagacctgcaaagagacttagactcccacacaataatagggggagactttaacaccccactgtcagtattaggtcagtgagacagaaaattaacaaggatattcaggactcgaactcagatctggatcaagtggacttagtagaagtctacagaactctctaccccaaatcaacagaatatacattcttctcagtgccacatggcacttattctaaaatcaaccacacaattggaagtaaaacactcctcagcaaatggaaaagaactgaaatcatgacagacagtctctcagaccacagtgcaatcacattagaactcaggattaagaaactcattcaaaaccacataatttcgtggaaattgaacaacttgctcctggatgactcctgggtaaataatgacattaaggcagaaatctagtatttctttgaaaccaatgagaacaaagagataatgtaccagaatttctgggacacagctaaagcagtgttaatagggaaattttgcactaaatgcccacatcagaaagctaaaaagatctcaaatcagcaccctaacatcacaattaaaagagctagagaggcaagagcaaactaatccaaaagctggcggaaggtaagaaataactaatatcagagaagaatcgaaggcgatagagacgcaaaaaagccctccaaaaaatcattgaatccaggagctggttttttgaaaaaattaacaaaatagatagactgctagctagactaatagagaagaatcaaatagacaataaaaaatgataaaggggatattaccactgaccctacagaaatacaaactactatcagagaatactataaacacctctatgcaaataaattagaaaatctagaagaaatgaataaattcctgcacgcatacaccctaccaagactaaaccaggaagaagttgaatctctgaatagaccaataagctctgaaattgaggcagtaattaatagcctagcaaccaaaaaaagcccaggaccaaatggattcacagctgaattctaccagaaatacagaggagctggtaccactccttcagaaattattccaaacatttgaaaaggaaggactcctccctaactcattttatgaagccagcatcatcccaatacccaaacctggaagagacacagccaatatcatactaaatgggcaaaagctggaagcattccctttgaaaactggtacaaaacaaggatgccctctctcaccactcctattcaacatagtattggaagttctggccagggcagtcaggcaagagaaagaaagaaagggtattcaaataggaagagaggaagtcaagttgtctctgtttgcagatgatgtgattttgtatttagaaaaccctatcatctcagcccaaaaacttcttgaactgacaagcagcttcagtgaagtctcaggatacaaaatcaatgtgcaaaaatcacaagcattcctttacaccaacagtaggcaggcagagagacaaatcatgagtgaactcccatagacaattgccacaaagagaataaaatacctaggaatacaagtaacaagggatgtgaaggacctcttcaaggataactacaaatcactgctcaaggaaataagagaggacacaaacaaatggaaaaacattccatgctcatggataggaagaatcagtatcatgaaaagggccatattgcccaaagtactttatacattcaatgttgttcctgtcaaactaccattgacattcttcacagaattaggaaaacctattttaaatttcatatggaatcaaagaagatcccacgtagccaagacaatcctaagcaaaaagaacaaagctggaggcatcatgctacctgacttcaaactatactacaaggttacattaacaaaaacagcatggtatgggtaccaaaacagacatatagaccagtggaccagaacagagacctcagaaataacaccatacatctgtaaccatctgatcttcgacaaatctgccgaaaacaagcaatggggaaaggatctccttattcagtaaatggtgctgggaaaactggctagccatatgctgaaaactgaaactggaccccttccttacaccttatacaaaaattaattcaagatagattaaagacttaaatgtaaaacccaaaaccataaaaaccctagaagataacctaagcaataccattcatgacataggcatgggctaagagttcatgactaaaacaccaaaagcaattgcaacaaaagccaaaattgacaaatgggatctaattcaactaaagagcttctgctcagtaaaagaaactatgatcagagtgaacaggcaacctacagagtgggagaaaacttctgcaatctacccatctgacaaaggtctaatatccagaatttgcaaggaacttaaacatatttacaagaaaaaaacaaccccatcaaaaagtgggcaaaggatatgaacagacacttctcaaaagaagacatttacacagccaacaagcatggtaaaaagctcaacatcactgatcatcagagaaatgcaaatcaaaacctcaatgagataccatctcatgccagtcagatggcgattattgaaaggtcagaaaacaatagttgctggcaaggctgtggggaaataggaatgcttttacactgttggtgggaatgtaaattagttcaaccattgtggaagacagtatggcgattcctcaaggatctagaaccagaaataccatttgacccagtaatcccatttctggatatatacccaaagtaatgtaaatcattctgctataaagatgcatgcacgtgtatgtttcttatagcactatttacaatagcaaagacatggaaccaacccaaatggccatcagtgatagactggataaagaaaatgtggcacatatacatcatggaatactatgcagccataaaaaggaatgagatcatgtcctttgcagggacatggatgaagctggaagccatcatcctcagcaaactagcacagaaacaaaaccaaacaccgcatattctcactcataagggggagttgaacattgagaacacatagacacagagaggggaacaacacacaccagggcctgttggggagtggggatgagaggagggaactatgagggtcagtagggatggtgctactaattaggtagtagggtgctgcagcaaaccaccatgacacacatacacctgtataactaacctgcacgttctgcgcatgtatcctgttttttttgttttttttttgtttttttagaaaaagccgggtgcggtggctcacacctgtaatcccagcactttgggaggccaaggcggacggatcacaaggtcaggagatcgaaatcatcctggctaacatggtgaaacaccgtctctactaaaaaaaaatacaaaaaattagccgggcgtggtggcgggcacctgtagtcccagctactcgggaggctgaggcaggagaatggcatgaacccgggaggtggaggttgcagtgagctgaggcgacaaagcgagactctgtctcaaaaaaaaaaaaaaaaaaaagatttctagtacattgcctaaaagaacccttggatgaagtcagacacatgggtagtatgagaccccagatagcatcattttgtatgtacagaatcgcttttttttttttttttttttgagtcaggttctcactctgtcacccaggctggagtgttagttatgtggtcatggctcactggagccttgatctcgtgggctcaagtgatcctcttgcctcaacctcccaagtagctgggattacaggcacacgccaccatgcctggctaatttttgtattttttgtagagatggggttttaccatgttgcccaggctggtctcgaactcctgggctcacgcgatcagcccacctcggcctttcaaaatgctaggtttacaggtatgagccactgtgcctggtctagaattgcttttagtggatgattttttgctgtcactgttaatggcgtgcattttctgagttatcagagatggccctgcatgctgcgagtctgtgttgactgtactgttggctgtgtgtgtggagggcaggaaagtgccgtccttgctgtaacttgtgttattaatgatatggacactgtgagttgcttctagagagctacacctcacttctgtgtcagcaaatgaaggcccaggaactgacagcgttccctctagctttaattgcggtataatcaccacaccctaacattctcctgttttacctttggcaacatctagagtttggttgtcacagctgatggggtgggggtgctatggcattgggtgggtagaggccaaggatgctgctgggcatcctacactgcccaggacagccccccacaaattatccagccctaaatgtctacagtgccacaggtaagaaatcctggaccgtagggtagacagatttgactggagtggagaaattgtatcctggggtaagtgggatttggattgcagttagtgcagagcttgtgtgtgtggaacgccttggacactggactaatccaagaagttgggtggggaggaggggggctttttctttaggtcctggaaaccattaaaaacctttgaacaggtgctttagaaagacaaaactggcatctgtctgaaggatggattacaacaggcaccagcagactgtggcccacggggccgtgtccagacttggcacacaaccatgcccattcattcatgggttgtctctggctgctgtgatggttaactttatgtgtcatcttggctaggccatagtattcagatatttggtcaggtacttaggaatgttgttgtgaaggtattttttagatgaaataaacacatcagtagactttgagtaaggcagatgacttccataatgtgggtggacctcatccaatcagttgaaggccttaagaaaaagactgaggtccgccaaagaggagggaattctaccagtatcctgcctttggatttgagactgtgacatctgcgctttcctgggtctctggcctgctctggaaagtttgggcttgccggcctccacaattgtgtgaaccagttccttagaatctgtccatctgtccgtccatccatccatccatccatccacgcacgcacacataaacaaaccctattggcactgtttctctggacagccctgactaacatcactgctttcttgccacagcagccaagttgaatacgtgcttgtaagtacagggattgtgtggcccacaaagtagaaaatatttactctctggccctttacagaaaaaaggccaagcattggatttggtaagtgaagtccttccatgaaactgagaagtgctgagtcagtactcaatgggagttaaaacagagaaactgtaaaagccaagagggctcaggatggtgataatcacggtctttcattcttttctcctgtgcacatttgacccgctggcatgcaggagatttaatctctctaatccagaatgtgttttagggaatggcttgcctggcttgtgggttgaaatgttctctcctcagatgtggctcctgcaatatcagctcacctgatgacaagaagtggaagccatgtaaccacctgagacgcaagttaattagggtttatcagaaagacaacctgaacccctgtgggatgtgctgtgggtgaagaaaagataccagtattctgtgattccaaataggagattttaaaaattctacccctggaggatgggttggcatttgtcttccaaacataggttaaatacgttttatttctgtctgttttgtacacattttaatcattttccagctcacaattacagttggtacttctcaattctcagtgaattgtgtagtggaattgtttgcaacatcatactttggaaatgacgttggcaattaaagttttggtccaagtttaataatgaagactatttgaaaggccaaaaccgatggatgcttttgagatgaaatagtcatttgggaagaaaatgagggcaggttgtctacttcttaacatttatctgtttttttttcttttttgagagggtcttgctctgttgcctgggttggcgtgcggtggcgcgatctcaggtcactgcagcctcaacctctggggctcaagtgattctcccacctcagcctcccaagtagttgggattacagacacatgccaccactcccagctagttttatttttttgtagagatggggtctccctatgttgcccaggcttgtctttaactcctggtctcaagtgatcctcctgcctcagcctcccaaagtgttgggattacagacatgagccaccttggattacaggcatgagtcaccacgcctggccttaacattgatcttgatgacactgaaatcgttgatgtgtgccaagggggttcctttttctaaatggaagctcactgttttgggtatccatgaattcatcatagatatgaagagaaagtttgaaatgcccaccagctgtctgtggtagcacctacatttgtgttactcatgaccaatgcagctttcaagtttatgacacgtggcaccccctgagcttaactacctggttgctaatgtctttggacatcactgtatttgttatgtcagggttccttttgctaattgctcttgtgggctttcagactttctctatgtacgtttttttgttttttggtttttttttgggagatggagtctctgttgcccaggctggagtgcagtggcgtgatccactgcaacctccacctcccgggttcaagtgtttctcctgcctcagcatccctagtagctgggactacaggcatgcgccaccacgcctggctaattttttgtagttttggtagagatggggtttcaccacgttggccaggctggtcttgaactcctgacctcaggtgatcctcccgcctcagcctcccaaagtgctgggattacaggcatgagccaccgcacccggccagtgtaagtcttttgaaacacagacacctagtgcctttcccgtgagtctttcagggaaagattgagttccgtgtcaggttggagttgctgatcaagcgactgactatacggcttcctagccccctttatttgaaaaaccagcgtggtcttcacttttcccttgagcctacaaccacagggtgcctgttcatgtatttccaggaccttatgcggctcctttgctctgcttattccgagaaccaagccttgggactgtgcattttgaatacaaatgaaggcacccggaggaagcccccagagtctcggcacagttgaggaaacaaacaaagcatgctacacgtgcaggaagatccctctttaattcctatgatgacctctctgcttttttattttttaagttaaaaggagtcaatgctttgggttttgttagactggacaaggtagcaagtcatattaaactaacccaggttgttgcttgagttttcactgaacttagactctactgacgagtatagtcaagcagaaattcccctcacgaggtggcctgatggtgtactccagtgggggggtgcagaagatttggagggatctgcttcccgactggggcaggttaacctctttctgccttagttacctctttgcatgtcctaagagcacctgcttatcagatccttaggaggattcactgaattcgtccacttggaatccacatggaaggctgcctggcatgtaggaggtacccagtaaattttagactcctgttatttttgccagttggattcaacagatgtttgttccctggactagtgtttctcacctgggggtgatctgcacctaggggacatttgacaaagtctggagacattttgggttgtcacagcttggggagggagtgttactggcatccagtgaatagtaaccaggtgtattagttttctgtcgctgtaaaggaatacctgagactgggtaatttagaggtttatttggcacatagttctacaggctgtacaggcatggtgccggcatctgcttggtttcttgggaggcctcagagcttttgctcatagcagaaggcaaagggagagcaggtgtctcacatggcaagagagggagcaagagacagagggaaggctaggctcttttaaacaaccagctcttgcatgaactgagggaactcactcagtaccagggggagggcaccaagccatggttcctccatgaaccaaacacctcccaccaggccccacctccagcagtgaggattaccccactacatttcactgtgagatttggaaagggaagacatccaaactatgtcaccaaagatgctgctaagcatcctaccgtgcacagagcagcccccataacagggttacctggcaccagagtgtcagtagtgttgaagttaggctacactgtagttcacttgcttattgtgtgtaggaagaccggaggccagttacctggcaataacaacaacaacatcaaaaccccctcaaacccaaaacaaaaaaaccccacatgacactgtgagtgttttttttttaatttgcaggagattgagtcttaatccagttgaagacctttatttccttgctagttacagagaggtttttcctggttcgttgcctgtgtttgttgcagttagtttttattgacctttctagggttcatgtgtgtcccttgggtttgccatgttttgttctccaaagccccaggagggttccccagtaacagagactgtgttagatttttaacattttcttttactttttgttttaaatgatttcttttgattaattacacactcacactgcgttgcaaacatagtgctgtcagatcccagtactgtgtcctttaccggctttccccaaggggagtggcttctcacaggatcatagagcaggaaaacccaggaaatccacgttggtgcaacacagttacctagccttggagcccttacttggatttcaccctttttgcgtgtactcatttgtgagttgcatgttaaagatgagagtcagtaatatatttccaaatgtcaacagaacataaattgagcagaagagtttataatgagatggaggattgagcagaagagctcatagcgagccagggcgaacaacctggcgaggagctccttgactttcttggaggccgaggtgggagcgttggtgacaacccccgggaaggcagatgttatcaggagttaaaatgtgatgtgtgtaccgctcatgtgtgtatggggtgtgctccttttgtttttgatgctgaaatgagacaaatcatttcccttttaagctccaggcagactgatggaggggggaaaaataacacccaacttactgcaacctgaaatcctttgccttggatccacttcctaagttcctatagtccttattttataaactgataaaacaacttttctctctcaagtgatgatcatcttgtgttttacactaattaagcccatatacacctccctttggaattccttcttctgatctgcttggcctgtttgccagttagtcgccttactaggagaatcaaaatgtaaactcataatagacaggaacccaacatcatcagcacaggatgtggcagaatgatttttctttcccacctcttgctgagaaggcaatgagattggaaatggcaaacaccccagagttctgtaactctgagtgtggaagaggaggtggcagcccttgacctcagtagcggagccagatcatcgaacatccccgtccaggaatctggacatgcactggtcaagaattcagcacaatttcctttggtctggggattgggaagctctttttgtgagtgaggcatggagtgaaattgcagaagcctgcgtgacttgtagaaaccgaagccaggctcgtttactgccttgcacaagggagatatgataagacagaatttatttgtgagtgtcgtcgatgccaaggagcctgtccaacatttatagaggcttttgggctaaacgaaaaagggtttgatctgtctgtggagacagaaagtagatgagtggttgcctaggactggggctttaggcgggtaagaggttgtcactgctaaagggtacagggttaatggaaattcttgaaattgtgctgatggtggctgcacaactctgcaggtactaaaagttgttgagttgtactcgaaatgggtccactgtatggcatgtgttttatatctcaataaacctgtcaaaaaagggtgcaggaccactgtttttgtacatgtcctcaaaatacttcctgtaatctagtgtggtcacagctggttcatgtgcacggacatagtgtcagtgtcattgtggagatagcagtttcagattcactggttccagaaaatgtgtccctgcctgttatctccgtgttgccacaattaagaaccaagggtccataacaagcagtgaaaccatggttcatatcagaggaagtggggtggtgtcatctcttttgtatttttctcttttctctcccccactgcctttgcccacttccttctccaaaataaaacaaaagagagaaagcaagagataagtggctgagctgaatgtggtccagccctttagaagaggggagtacacatactggagggaagataagcgaaaatacagcctttctcaagggccagcacagacggagataaagagagagccacaggcacactggccaagcatcagctcctcaagcatccatctcactattcagggtggggaaatacttgatacctcaagtcctctttatcatcgcagatgaaaactgacataggtgatttcctttcggagcatttagggagaatgcaagggaaattgacaacacacttggtgcaattgggtaaccagtctttgtgttgccctccaatgactcttgcttggaaatgattggaagcccatcgttttaagtcattggaacgactgtccccttcataaagcatgatgtagcaaaatgaaaagcatacttctggttaaaagtgtttttcaaaaaaagcttaccacattgaggaggtcatttcatatttcctgatattcagcaattttgctgtgagctttgtagagttgttctggtgcttagttcaaataagaaaggaattactgaaattgcacattaagttaaaaaaaaaatcagggttttgggtcctgagacttgttacctaaacatctgtcttgctattttgttacagcacaaagtaggaattgtaaaacatcttcgttataaactgagtactatacagtctctgggagagcagaagaaacgtggtaggaaggaaccacccagggtgggtaatgacagagtagagatagtcagatagggccggagacaaggccaggaaaggcgagaggaagagcctgcaggaacgagtttcttgcacgtttgagagctggacctgccaagagggtaaggccaacatctgtgtgtgttctttgaggaaatccgagtagcctgccctgcctttgaccctctgctctttgaactgtggattccttcccatacacctgtgcattctcagtgccgtggtcagatccccaaacagacaccaaaccccgacctccgaggcccaggcaggagcataacccagccccaaggggagataaagacagaaagaatcagtattatagcagggacctttttcaggaatctgccttctgcagggcagtgccctaggtgcattcaagccagcatagcaaatccacatcactagaaagactctttccgttttataacttgggaaactaaggccaaggcagtgacaaatgccaggtccccaaactctgaactgcagatctgcaagctgaatggtggcaggtgggccagtgggattttaaagccgtgtgcttttcagggcaccctggtgcttctccaaatgccggaagggtttccttgaaaattcatagcactactcagtcaggattctgcaggacagtgccctggggagtgcatgagtggatggttctgtgggtagaagccacgagctgaagatagttttacatgtttaaagagtaaagagactgggagcggcggctcatgcctgtaatcccaacactttgggaggctgaagtgggaggattacttgagcccaaggagttcaagaccagcctaggcaacatagcaagaccttgtctctaaaaataaataaaataaaataaaagccaggcatggtggcagtgctcctgtagccccagctatgcgggaggattgtttgagcccaggagttcgaggctgcagtgagccatgttcatgccaatgcactccagcctgggcaacagagccagatcctctctcaaaaaaaaaaaaaaaaaagaaaagaaaaaaacagtaccttgttgatacatggaaatgatgtgacattcagataaagttttactggagctccgccatgcccattcatggacatattttctatggttgctttttcacaacaaggggtgttgcaaccatggcaacagacactgtctgtcttgcgaagcctaagatatttgctctctggtcctctgcagaactagcgtgtagttctgagtgcttgaaggcacgtaccatcttggtggtgtgacttggactttcacctctcctgatcccttcttcatttccaccctactctcatcttgccttgcttgcagaagcctggtattttcataattcgagagtcacttacttcatgtgaagtcttgtcccagttaaagtgccaatagtcctgggagaggtaatacattaaaccttatcagttatttatacctcaggattggaagggattgttgctggctttgtcctataacagctgcgaccagaggacagagcctaagggctgttgcatgaaatgagggaggtgtgggtcacctctgtgcagggcatgagaagagaggaggctgggtcatctgaaagatgacctttgttcatggcctttttctgtatcctcctcagtcacccagaaattgggattgttggtgacaatcttttgggaattggtgttagcttcggagagccacttagcctgaagaccctccttactccgttatcatagaaccagagtggtagccacacaggcagactgtccatgctgacgtgtaaggcagggccttacacctcctacccatgtaggaggtggtggagctgggattttacatggacagccttctgctcccctggtgcttagctacattctagtgccttctgtgcaatgccagcttaacatacatatgaagtgtgctgacccaatctcctgcctttgcgttcactattttagatggttgtgtcaccttgagcctggactagggagataacacgtgaaggagatgccgcgtggtttctgtcttgtccatggtacgtggaacacattcccctcagtaacattatggttgagacatggaatgccacaatgtacagttgccaccatatggtatacttcatatatatacacatatatatttatttagtttattttaatttttttagagacagagtcttgctctggtgcctaggctggagtacagtggtgcagtcgtagctcactgcagcctcgatctcctgggctcagtgatcctcccactgcattgtcccaaagcgcttggattataggtgtaagccactgggcccggcctacttgtatatttttcattgcaaatgtacatttcagttacgttgtgggctttaaaaagcctttctaggctagttgggaatttgaccctattttttacagcatagtttctaggagaaaaacatttctgaggaagtaacaaaagaagacttgggctgtatcccatttttaatttagagagcactgtcatttgaaaatttcttctctcaacatgttttctttttgagacatgaagtaggcaggcaggatcttttttacagtggcgctggtgtctttgggaagcggcttccttggtttgcctttgctcattttctttcttgacttctccaggcattcagctgcaggcatgtacctctgctgctgggagagtggcaaggagagggggttggaggaacggggataaaaattagctagaattcaaaaacggcagtgacagcccagatgatttttcatgctaacctactttaaaagctgccagaataattgtggagtgggaaatctctcatttctcctgtcctactctgacaagatctaaaaataactttgaggagatgggcatgtggccctttgatctccttggcctggagtatttcttggtaggagcagagcttacaagaaggtgttcttcaatgagtgttctggcagtcggagttgtgggtggggctgattactgtaatcttccttcgtcattgaacgatttcatctgcccctggtttccattacttgctgctctaaatattcctctccccgcaccttccttttatgtagccacaaactggaatatgtgcatggaaaacccaaaggaggcaaatcccacttacactgcagaactttggtgctggatttagcggctatttaccaagcacctcctcttccagaataagtagcacagatctttgaccgccccccgccccccaccgagggactgtggtctagttggaagacacaaggcagaggtgtaaaaagggaactctggagataggaattggaaatggggctgagagctgaagagatggcctggggctagagaccagggagatgggaggagggggagttccttggaagagtgtgcccctaagagatcctgaagagtgagcagagattgatgagaggcgagaggagacctagagttatcagggctgcagaggtgtccttggcacatagaggccatagtatccacgttggcttccagggtaggggcagtgcatctgcggctggctgaagatggaataaatgggatagtggctaaaaagatgggggtattgggggaacacctctccttggagtggtcctccttgcagataaggggagacgtagaacagcacttgacagggaagctggtgtgggggaaggatttttttacactaggggagacttgtggttgagttaaacaggttctagaggccaggcatggtggctcatgtctgtaatcccagcactttgggaggccaagttaggaggattgctcgagcccaggagttggagaccagcctgggtagcagcagcatagagagaccctgtttttacaaaaaatacaaaaattagctggacatagtagcatgcacctgtaatcccagctgctcgggaggctgaggtgggaggataacttgaccccaggagttggaggatgcagtgagctgcagttgtgccactgcgcaccggcctgggtgacagagggagaccttgtttctaaggggaacaaaaaaagaagttaaagagataagataaagaatggggggaggggacgtattttttgcaggagggaaattttgagggtttttagccttggaaaaggagcagaacagatgggaaggtcgtaaacgtggaacctttggaagcagaaaggaagatgatttctcttaaaaagttttgcctagagatgactaatgtgaaggtcttggtgttttaagggagcagggaaagccagaggtggtgggtccggtagatgcaggaactgacccaggctttcagattgtacactggggagcagagagtgcgtgcttgggggtggggaggctgctggccagggctgaccttcctcccatgacccctgcgtagaatcagagtagcctcatttagtgtacttgagtcaaggccttctgtttaagagcttatttgaactcattacagtcatcgcttggtatccttgggggattggttccaggacctcctgcggatacccaaatgattgcacactcaaatcctgtagtcctctcagcaaaacctgctgataggaaaagtcagccctctgtgtctatgggttttgcatccccagatactgtattttccatctgaatttggttgtgaatgcagaacctgcccataaggagggccaattgtatttattgaaaaaaatccgtgttgttcaagggtcagttatagtttgaactacaaaaagcaagcaaccaaacaaaacccccaaaaaccaaagctttaattggttaagtcagagcagactaaaaaggactacatgcccagtggaactttctgtgtagtctagtagccatatctggctatgaagcacctgaaatgtggctcatgcaacagaggaattgaattttaaattttattccttttaaatatttatttttgtctttcttcgtttcttttttttttttttttttccctgagatggggtctcgctttgtcacccaggctgaagtgcagggtcgcgatcactgctcactgcagccttgacctcttgggctcaagcgatcctcccacttcagcctcccaagtagctggggccacaggcatgagctactttgcccggctaattttttaacttttgtagagatgggggtctcgccatgttgcccaggctggtctcaaactcttggtctcaagcaatgcttccacctcggcctcccaaagtgctaggattacaggtgttgagccacaatgcccagcctaaatatgtatttcagtagctccatatggggaggtgtcttggacagagcaggttagcccgtgagactctctggtccttgagtgagagggaaggatgagggcttgcagatgatcccagtgggctggttctggaagcgaaacctgcaggccccatggcttggggaaggctgaccatagcaggtgggaggagctctctgaaggccgaggctgagcactggtggagaacagggcccgtgctcacgtatcccacaccccagaacttggtgtgctggattccagccttgtgtgtttctcattatgactatgtaaatgccaggagggttgggactgtgtgatttttcttcttgcttggatgctcgagagttcttcattaattagtgaaggaaagctggctctaaggagaagcagttgaagtggagttcattgcccccacttctctgcagcaggaatgccttgtccctcctgcctcggttgaactcactttctcaggctcccacctttgaatggaggcccttgtcaggctctccatccccagcgactctgttgacatttccccatgggaaaggaaaagaccatctgaaagtttccatctgtgtgcaaggttttctgaacatgttgacaacatgggtttaattttgtgaggtcagcaagagttcttgtggtttgggatttagtaaaaactgtaggctttgtatgggaagaaaatctctctcacctctgtcttctattcttcattctctacacagactctccacttgtctttagcactaaaaacacaaactaagcattatgttttaaaaaaaacccaaaccccaagtccagtagctgattgccctgctttagcttttctccctcgttgtcattcttcaaagaaagactccactcctttcagctgtcaccctttcaccctgatcaccgcatgcagtctggcctctgccccgcttgaaagaagcactcttcccagggcacccgggaactcggaactgtgaacccccagagtctgcccagcccctctgtccctgccttttgagcaacagcgactggtgccacaacctggggtgcccctttccctgggcagcattacccacactgggccaccgtgggccaagtcacccacactgggccaggtcacccacactggaccatatgaggccacgccactcacactgggtcatgtcacccaccccaggccacactgggccatgtcacccacacttggcagggtcctgtctttctccactctggtgtctcctttatcttgatgctcaagactctctcaaaacaccagtggttcagcacagtgtggggacagagacttcagcgaggcgcccccagccccacccttgacgggaaataagcgcaaactccttgtgcctgagactcaaagggtcgtgtgcctttattggcccccttgccttacaccagtgttcttaacctttctgtgtgtgtgcgtggctctctgtagtcatcgagtgaagccgcagaggtctcagaatcacattctaaaataaaagtagaatcataaaggaagcgattaaaagtgcaattgtcaaaatatcaaaaacatgatttgttgaatagtgcttttttcttttctttttattggtaaaatacatgtaatataaaatttagtcattttaaccttttttttttttttttttttttttttagacagagtctcactctgttgcccaggctggagtgcagtggcacgatcttcactcactgcaacctccacctcccaggttcaagcaattctcctgcctcagcctcctgagtagctgggattacaggcacacgccaccacacccagctaatttttgtatttttagtagagacagggtttcaccatgttggccaggctggtctcaaactcctgacctcaggtgatccacccaccttggcctcccgaagtgctgggattacaggcgtgagccagtgtgcccggcctattttaaccatttttaagtgtacagttcagtaacagcaagtacattcatactctgcacagccaacctccagaactccttttgtctcgtagtcctgaaactccatacataactacccactcatttccccattcccagccccagcacccacccaactttctgtttctgtgtgcttcacagctctgggacctcagatacgtggaatcctacactatgtgtctttttgtgactggcttatttcactcagcgtactgtcctccaggttcgtccacatggtagcatgtgtcagaatgtctttcctttttaaggctgagtgctgttccattgtatggataggtcactttattcctgtaactgtagatggatacctgggttgcttccaccttttgactgttgtgaataatgctgctacaaacttgcctgcacaaatatttccttaagatcctgctttcagttctttgatgtgtgctttctaaaccttttttattttttccttttgttttgagacagggtttcactctgtcccccaggctggagtgcagtggcacgatcgtgactcagtgtagccttgatctcctgggctcaagcgatcctcctgcctcagtctatcaagtagcttggactacaggcacatgccaccatgcccagctaatttttgtatttttggtggagatgaggtcttggtatgttgctcaggttggtcttgaactcctgggctccagcaatcacctgtccttggagggagttggcaatggaagtgggttggctgttggagcccattagaatattccagagggatgatggttccttggaccagggtgtggtcaaggagctggagagatgggagtcagttacagacaagacagtgggatttattgggattcttgatttctctcagtggtgagaaatttcgtctttccacacaccttccatggaaacccggaacaccatgggtcccccgtaggcagtcttaagaggatagctgtttttgttctccttccaaattcccattagacttgaggtcagagtcacactttacttgttttgaatatttaaagtagtatacctaatagctcaatagactgtatgcttttatttttattttttgagcctgccttcctaggtatttggacaaatttctccataagagaagtgaacacgtaactctaacttgtaatagcaaataccgcgggaacactgggagccacatattaagatgttattagaccttccctggagtatccaaatggtctataattgcttaataaggagaagtttttgctgagatttacatgatagagatttgctttttaaaaagaaattatccagatttgaatggaaaaattgcatagtctcctgagtgttgttttgcctttgactttgtactgtttaagaactgattatgagcaggaggaaataactcacttcagctgtaatataaatgtgcattggtatttaagcatatgtgacacataaaacaataccaacttggccagaatttaaatgtttatgtaaattacatttttggacaggcactttcctctattttgcagagaaaataattttttcccaaagagattttgtgtttaaaaaaaaaacccctaatactactattaggagtgttagatgccttcgatgtggttttctttcctctttttgcctgaaaggcttgagtgctgaagcatctagcgctattcttgtgtccgggaacgttcctgcctcatttttgtttctagtcttgtttctttctgtgtcagaaataagactaatgcgtgcagctgcacctatagttcaagatgaaggggtctgtgtgagagagagaacgtctgtgcatgtgtgtatgtgtgtgagtgtgtgtgtgagagagaggagagacgggcgggggaggggagagagagagaaaagagagagagagaaaaaaaaacacagcctctttgtaatacctggttgactcagtgaagtctggctctctgagctttactgaattcctccttacttattttggggccggaggtggagatgagttcaaaagtagataaaatttgcctgttacctaaatgagcagaatagattgcgcataatcttttctagatgaagcctgtgtttttggcattctgctctcaagtcctctgagctgatctgagagtgaactggagtgttaagttgagagagatgttgatgactctggtgtggtcttttcctttcggagaagtggaggtgaaacgacttgcccggggtccctgggaagcagagcttgtgccaagatgtaatttttcggttctaagccctgtggtttttcttctgcagcaaggtgggtaccctttttctgtaagggaccagagagtatggattttaggattttggggccagtcttggcaactattcacctctgcaactcagccacattgtgagaaggcagccctgcacattgcataaacaaacaaatgtggctgtattccaataaaactccatttatggccactgacttttgaatttcatagaatattctgtaagcatgtgtcagcagcttcccctgtgcaggtccatgctcagaggtagtcgcgttggggaaagttgctttctgccctcctggagttgatagacttgtggggaggcagatactggaaagcagccacagacacaccaaaggggggagtcagtcccctgtcatgggaattgtgatggggagcgccctcccctgtgcatttagaaaggccccgccacacggaaccactgggaagctgaggcttggagattgcgtgggatttgagatgagccaggcgtgggcagggagatcgcacaggggaaaggaggatcgccgtggatcacacaggacaaaggaggtcctgacctgtccacccccaaagccctttgcttccctagcccacgttggtgtagggtgggccgagagggggcgcagtgtgaggagtgactgtagctgcagctcagcagcgtctcaggagaagccagctgtctctactcaccacgggagtttatttccagtgtgggagagggactcttgagagagaaggacaagatgcccgtttgccctacagattcctttgaggaaaattcctataggggtctcgtctctgttgtatttattgtagtacgacctttttttaagtgattcaccataatctctctaggccgtatttaggcactgaccctaaatgtgcgttaaaaaaaaaggtttgggatattttggtttatttatttgtgtgtatgtatatagttgttaaattggtgtccttggggtgggggttgatcggtggaaccttatcttctctgctttcttgctccaccccatattttggtttgtttttgttagaggtcggcaaaccttttgttgtcaatggccagataataaatattttgtggtttttaaaccctgtagtctctgggtgttatatggcaaaagcagccattgacaacatgtgagtgactgagtgtgtttatttatgggcactgaggtgctgggatcccatattcacactgttccgccaccatcaccgccattcataactcccaaactttttctttttcttggtggaggagtggagcagggtcttgctctgttgctcaggctggagtgcatcacggctccctacagccttaacgatcctcccatgtcagcctcccgagtagctgggaccacaggtgcgcatcaccacgccaggctgattttttaacttttctgtagagacgtggtctccttaggttgcccaggctggcatcaaactcctggcctcaagcattccacccactcctgcctcccaaagtgttgggattacaggtgggagccaccgtgcccagcctcagaaatttttcattatcccaacccgaaacctggtccccatgaaacagtaactccccattctcccttcccccgcagcccctggcacccaccgttctattttctgtgtctgtggatttgactagtctgaggtgcctcatgtcagtggagtcatgctctgtttgtccttttgtgtctggcttttttcacttagcataatgtccttgaggttctcccatgttgtagcctgtgtcaggacatttgcagctcagttcatttccgaggaattgtcctatatgcagggggtcttaggaacacaggtaacttcacttcccatttgaagagcgaggagttctcccgaggccctgaacaggaatagagactgtgaggcattggcgtttggaaggaagtgtctctgaaatagaaacgactgtcagatgaagagggacagttcagtatggtacccgggcctgcctttccagacgtccccagcctctttgcctagttcccactctgggcccctgggcaggtgacccgcagctgcacatgggtttcctgggaagccacagtgctgaggatcttgggagagaggctcaggatcagagtctggggagtgcaggagcttgcggggggagggggtggggtcagtgggggcggggggtgctgctttggggattgggaggagtggactggggcggggtcacagagtctttagctgaacccatgggtgctctgggtctcggcttgtcctgactcaagtcaaggggcccaggcctttgtaaaggtccacattgcccattcactggggcctggctttgggtgagggtggcagctggagatggggggaagccctgaacgggaatcttggccacacactgctatatccgcgacaccaaattctatcccacctgttgttggctgttctggaaaccagcactgaaaaatacggagtggaaaagttttctgattttttttttcctgctttgtttgggttttttggaaaacaatttcaaaattagcatatggcttgttaaaattaaatcacaaaggaagtgcctatggtaacgttttgatcaggctctaggtctgtgtgaaccacggcccatatttgaaaatccagctttattgggacatagccatgcccattgctttctgtgtcctctgtggctgctttagtgtgccaccagggcagacttgggtgggttgcagcagagatggcatggccctcaaggtccaagatgtttactctcttgccggtcctctgttatctctggtctttgtggttgccacagttttcttggatccaggagttaaaggcagtcctgagggatgatggcctcatctccgcagttgcctggaatgctgaatttcagacgtgctaaaggaggggttgcagacattgtgtggaatgcattcagaccccagatgtgggtgcaggaaggcaggcatggcacagccaggtagagactggtttccaggcccaagcagccttcagcagctgtgcgccttgtttctgatgttgtttgggagtaagaataatgtagacatggggggtcatgaggctcagggtaaaaacttcaaggaaacctccatggcatggttgggcgcagtgactcatgcctgtaaccccagcactgtggaatgccaaggtggaaggatcgcttgaggccaagagttggagaccagcctgggcaacataaggagaccctgtctctaccaaaaaaaaaaaaaaaaaatgaccaggtatggtggcgcacacctgtggtcccagctactcaggaggctgaggcgggagcctgggaggttgaggctgcagtgagctgtgattgcaccatggcactccagcctggaccacagagcaagaccctgtctcaaagaaagaaagagagagatagaaagagagaaagaaacctccatggcagatgcatggaggaatgggttaatatctagaaatacgctgagtggtggagtaaagaaaacccacaatagaatacctgatgaatgtggggaaagcacttctgagctcctctagttttagaagacctaaaaagacgatttaaaaaaacaaacaggagagccctgttattgttgatgtcttccaaaacgaacgtgcatttataagccaggtggcattttaatgtcacgagggggtccattctcccatctgtctcctttgcttttgttagagtcagtagcttctaggtctgcttgacattggagaggatactgaatgcagaaaattttgtttaattataatgatttgattttttccttctgtattcaagtttgcctgcttctaatgaattggcagaaatgaagagcttgctcagattttgccaggaccatttaaaagcaattaaaatcaatttagttattaaatttgaaattattgtctggctaaatgatagtttaaaattcaatttatactggcacttactttttaatgaacagaccacatcacacatttttatgttctcaaattatctgtggctttaaagctgtaaaaaaaggtgctcttttaaaaaagccctgcatgtttcctttttcctctctacttccgctaaaatatttacatgtttcttttaaaataaggtgagaaaatccccttgacttctcaattttaagaaactatacttatcttttcatcacaaatgttcatttatctgtgttgaagtcaacccaagaaatcttaaaatataacggaaagaaaatgtttctggattttttcccgagaatacatatacttttaaatggcacgttttacccattgactttaattcctccctccctccattacatttttagatgtgttcaatgaaacgtagtcctccccctttaaaaaaatggaccgagcatcacgtgtgaggctgcaaagaggctccctgccaaagcatcttatctgccgctggtaaagccccgcccctccgtcagcagctaacccttgagcgggatgtgtgcttgtgccgggtgcattgcattaagagaatgcaactgaatagagaaggatcaggaccttttgtgcagaggtggggagtgttaaaaagggggaggcctgggtgggagggtggagttagtgggagatgggtatgcttagtgcttaaattccctgcattccctaacacgaatttaagaaactcacacagtaaatgagtcagggagagggagagacagggagagagggaggggagagggagagttcctttcattcatgacaggatgaactttgcatgcttcagaacaatttacatttttccttatttctaggtacttttttgaactaagaacctggagggtgtgtgtgtgtgtgtgtgtgtgtgtgtgtgtgtgtgtgtgtgtgtgttggtgtgtgttggtggtggggtttttttgccttatatttcataaatatttcttggttgattaaatgtcaataatcgctcatttctggtttgtaaagctgttacctgatccttgaataccacgaatattttgtacattctaaataattgagagaaaataacaacgacaacaaaaagacacaaataaaaagcatctccgcttatttaagaagagtagatctgtgcggggcgctgtggctcatgtctgtaataccagcactttgggaggccgaggcgggaggatcccttgagtccaggagttcgagaccagcctgggcaacataatgagaggctcttttttttttctttttgagacacggtctcattctgtcgcccagactggagtacagtggcactatctcagctcaccgcaacctccacctcctgggttcaagtgattctcctgcctcagtccccctagtagctgggattatgggcgcgcaccactaccacccggctaatttttgtatttttagtagaggtggggtttcgccatgttggccaggctggtctcgaattcctgaccttaaatgatccacaccctccttggcctcccaaagtgctgggattacaggtgtgagccaccacactggggcgcaagagcacgtcttttaaaatcagtgctgtctgtggggtgggaggggaggagaagtagatctggccatgctgaaaggttcgtgcagtggcctcctgagctgcgcacatgcttctggagctttgggtggacatttagtctgcatgtggatctctgtccaagcctgcactgggagcccctgccccaggaagcgaaggctgcatttcttttatgtcaattaacagatttctgccccaccctggacatctgagcgttaactgatttgtaagggaggggtgagggagggtaaaattacaattctatatcttaacattgggggtgaagcatttttaccctagaggaattctatccaaacacattaaacactcttaataagggacaaagggttgggacgtagcggttagggggcaagcccatgagcctcactccttgtgctctctctccaggaattggagagggaatccttttgcttagcattcccacgcctcccacgggcctggcactgggcccgcgggcttgccttagtctcctgggctgccctaacgcagcaccacgtgccgggcggctgtaacagcagcccgtaattctcccacagtcctggaggttctaagtcccagatcgaggggtcagcagggttggttcctccctaggcctctctcctgggcttgtagatactgtcttctccctgggtcctaacaaggtcatccctctgtgtgtgtctgtgtcccctcatctctagtcctgttggattagggcccgtcctaatgacctcattttaccttagttacctcttgaatggccctaactccaaatgaacagtcacattctgaggtcctggggcttaaggcttcagcatatgagttgggagtagggatgtaatatgcctaatgtccagaacaggaaaatccatagaggcagaaagtgggttcctgcttgccagggctggggacgggcagtgtggggtgactgctagccagcacagggtttcttctggaagtgatgaaagtgttctggaattagacagcggttgcaaaattctgaatgtattaaaaaccactgaattgtacattttgaaagagtgaatttcatggtatgtgaattatatctcagtaaagttgttataaacaaaaactgtgagggtaagaggtaaaaggaagggagttgaaagcagcatcaggtgtgaacagcccataattcagcccatagacgagcgcgaactcctagcacagctgtctgttgaagatgtgcgtgaatgcttgctttccgcacccttcggcctgcttttctctactctccaatttcatcatacattctcttccttcctccccctccccactttttcaaaacgtttcttctagtccttacttgtggctacacaaaattccataaacataatgctgcagttcaaagaagtgttctgatggtagggagataacttaggaaaatattttacctttggggaagttttggtttccttctgagtgaaaaccctccatgaaagagaaacttaaatgcagttttcaaatgctcctgagacattcccagccttttctttgtggagaagtgaaggcaggacaatttccaaggcaaagagggacctatcgcagacagcagaccccaagtaaagaaaggcacagtgatggtgggtattcgtgcagtgttttgaaaatgtggaggtcagggatgctagcttaccaggccagcatgatcaagttacgagaaatggagaccaggacactacctctgctgggtgtgctgctccgggctccttcgaaaggggaagcagctggtggacttccttgggctgtggttaaatggggctcccataggtgccatgaaggctctgcagagccagggatgcttgcaccctggagagaccttgctccaggagctcaggagctggtaggggtggtgacagtgaagcaccggcttgccgtgcccagtgcttgggcagtgctgagctccgagggaggaacccagaaccatgcgggagcaagggagggaggcaggcgaggagaagggttgcccaggagcctgcaggtcgggtcggtgttgtatcaaattgtcttttcctgctttgctgtctgatcccactaaagactagccagagagatgtggaggtgaaaaatggtggacagccatttttctccctttcactgtgtctacaatgtctgtttcatatcaacagcaacatctgtgcaggcatcctaatgagtataaataatgtcttcagaaaactgggtttgtgaggctcctgtcatctgaatttctttcatcatttaagtgatgattttttactcattgacatacagttgttatttagtggccacgtattattcgtatagggttctttatgtgctttctgtgtacatttgttttcgtgctcatcgtatttcagtgtggcttatatataataagatgcacctgttcttagctattgtggacttttttttaaaaaaaggtttatagagatatgattcacataccaaacacccatttaagtgcctaattcaacagttcttaataccctaatttaaaaaaaaaatacagtgttgagtattttccttttctcgtttttcactaaagtagactcaggattggggttatctgtcagtcccttggtttgattcttggctgccagtgtttactggggacggatgttggtacctcccttaataggatattgttacagcattttacaaattctggttaaaaaaagtcccacatgagatctcccctcttcccccctctctgagtgtaggcattgtcagctgcagttgtccagcatctccaggactcttttcatttgcgggatggaaacaatgtaccctctgaacaactcctccctgtttctcctccctccagctcctggcaaccactattccactccctgcttctttgaatttcacaacttgaggtagcttgtgtaagtggaattattttaaaagctggttcatgttaaagtgcttagaacagagcttggtgagcatccggtcaacagtaagtacttttattattctttttatattactctttttttttaaagaggccagacacatgggcttctgtcttttcacagcttgggatctgtgcagacccaggcttccagaagccatcccacttgaattcttactcccttttcccctaaaaagaagctctgaaatcctaattgtcaagaaggctttgcctgctgtgcatgcctgagtaatgttatttttgtcattatttgagagacagagaggaagcttccagtcccctgtaaggaaacgaaatcatcgtgcacagatgtggttctgtttatagagggaaggaaatggaggtgaagagtgtgtgtggcttgcagccaggcttgcgagtgtgcagaggaataaacttttttgcctccagagttttaactggaaatgtgtctgaattctacctcctgggcacactggcctgaggtctcccctgcatacctgatcgtgaaagtcttcgggtgtgtttgtaaacacgcagcccccctgatgtgagagtcagcacaaacttctaaagatgcgatgatgaattctatcagagaagtctttctggttttgtgaaaataaccttgcactctttaattatatccaaatgatcaaatctggctctgatgtcttgtcaaaattaatgttaaaggacagtgccctttatattttacttgtctgggtataaacatcctagtctttaaagttgagtctgtaggactacctctctacttgattactctgaaaagagtgtatagagtgagtttttaaaatggaattagtgtgcatacgaggaacagagtgacatttaacaaatccttcaatagatagtgctggtatgaggattggtgaaactagaggtagggaatgagcatttttggttctgtatcatattcccaagacattttcaaatgattcaccctttgccatcagaatggtttgaaatcgatcagcctgaatccactaatgtgggctgcggcacatgaattttaacactagaagcacacggttgtgctgtgtttcaaatgaactctggccatttgaagtgagcaggcataggcagtcttctgtcctgtgataacctcagtacatatcctttctgttttttaaagtaccttacaagctgctgcattacagtcgttattattgggccattacaaaaagctgtccaattttaagtgtcttggataattcttgtttgccccagcatcagaattgagcatttttttttttttttagatggagtcttgctctgtcaccaggctggaatgcagtggcgtgatctcggctcactgcaacctccacctcccgggttcaagcgattcttctgcgtcagcctccggagtagctgggactacaggcatgcaccacgatgcccagctaatttttgtattttttagtagagatgaggtttcaccatgtgggccagcatggtctcgatctcttgaccttgtgatctgcctgccttggcctccgaaagtgctgggattacaggagtgagccattgtgcctggccaaaattgagcacttttatcatgtagtattcatgtcttactggcaatgccctgtaaagttaaataagttacatttgtcttgcacaggtaataattatgaggtaatttccacagaatccaagggcctcattgactttgctataaaatcaaaacagtgaattctgataagactagacgcatgttactcttaaattgggctgtctcctggccactgttgtgcctttaacctcagcagaaggggagctgggctgcagagtgaaattacccggaggtcaaatattgctaatttgacttttatcatagagacattttctcctctcgcaccaaggcagtggctttaatccctctttcagtggtgagacaggtgcaaagcgtttacaaaaggctttctcttgttttgaatgcgccaagaaagatttccaggccgttaagttaccaatccttctttttaagtcttgaagcaattactgtaaggtcaatccactaatttcctttcagagttaccaaagacctctcatgtaatcatttggtacttgttgccatgtagccagtatcactgagtgcttttactgtgagcaaagcacaatgcatcgggcagggagggatccaaagggatcttggtttttacctttgagccatctgtggtcttgagtgatctacgtgcattagcaattaaaaggtcctgatattcttgtttgggcatattgaaaaatgtgctcttacagataggtttcctctctctactgccccccgccccccaattttttttattgtggtaaaatacataaaacagaatttaccatcataaccatttctaagtacactgttcaacagcattaaatattcattacattgtgcaatcctcaccacgatccatctgcagaactttttcatcataccaaacagaaaactgccccattaaacacaaactccctattcttccctccccacagccccagcaaccaacgttctactttctctctctatgattttgacactctagggaccttttatatgtgggatcatatggtatttgtccttttgcgtctggcttagcacaagtttcatccatgtcatagcatgcgtcagaatttccttcctttttaaggctgtataatattccagtgtatggatggactacactctgtttatccactcatctgtcagaggacacatgggtggctttcaccttttggctgttgtggataatgctgctatgagcattggcatatgtttacttctcattgatttaagtttacatagtcatgtgtggctagtggctgctgtattagacaggacaaccctaggcctgatagccctgaggacctagtttgggtgggaagacaggggtgacctgcagcgagttgtcggctgggggccttggtgagagccagatctgggttgtgaggccactcgaggcagggggaatggtgtggcgggaagtgaggcccaaaatgagaatttcagagttgaaagctttggaagtaacatgatgctctatgactgtgaccagactcaactgcaccaatgtgcatctgagatcaggtcattggcgttgaaatcgtgaaatgctcactgcttgggacgtttgcactgtgcttgatgtctggaggttccgttaatgttaaaatagcaattatgggactggagattaggtttaatgtctgggttttttccactgtcttcaaaagcccgggtcttagtagtaaccatgctgctccccattttagtaatttcagcctggtttatgttgctcaatagcagaaaagcggttcagatttcctttggatatcatggaccatatgtttgcccaggtatcctttcttattgggaactatcaaatagttaacacagatttctccaagggcaccgactgggaaattagtttaccaaagataaatttggtaaaaggaaagtttttatgtgcgctatccttaaactaagacacatctgtcgaaatattaggacgtgcccagtctcccatcctctgctgaaactttagactgtacgtccttcagatatcttctctttggtgctttgtttgggaacagattagcctcatacttcctcgcttgtaaaactgctatcccatctcttgctcaatgcttttcttgtaccgaagggtgagggggaggttccagctctgttttctgtatcagtttcctgggtgatgtttgtttgagggtgccttgtgtccagagccccagaaggtgtttccgttctctgatgagcctgaagtctgcatgcttcgcctttggtagggaaaggcagctggggaaaggttgcatggcccagtgccagggtgccagagtgcgtgtgcacctgctggggagaagcccgctggggcccctcctctcagcacaagatgaggcctcagggcagtgcagcagatggagggcttagctgtccttgccagcaaaagctgctgggaacgtggcactcagataacaggacggttgagaagcggtgagttagggttactctgatggggagatactgagaggaggggatgacaatcttgatttctgttccctttgtgaatcttttggtggccaaaatgaggaaaaggatacattgtgtttgaggacaacaaggaacatctaggcacattgcatacttgattaaatgcacaaagagcttcttgtgacctttatcacaagagtgtggttctatgaaggtcgtaggtacaatagaaattgtgttggtctgagagttactcagattagggtgcattgtgtcaccaccattttgcatagctgtggcaccttgtcaagttaaccttttcctgcttgcttttcctaatcagaagaatgaagttgaccgtatgtactctataaggtggttgtgtgaggtcaatgagattacataggcaaaatcttggtgcaggggcacttggtaaaggttagtttctgttataaatttggggtattctgtgatgattcctactcccctcttctcctcatggctaagttctacttattctttgacgtggctccgatatcactttcctcaggaagcccggtttcccacccagatggctttgggctactcatcagtgttctgtaaaatgctgagaatattgtttatagcacttctgggttgttttgtgatagtcttttgagatatctgtctcctcaccaaactgttctttgtgtcatgggcaggcccacgtcatcctcgtctttgtagtcctgcacctggcacagagcctggcacatagctcagtcaaacaggtgaagactgggttattacatcttcccactccacccccttcattatcaagtcgtggtcagggcatgccccaccaaatgcaaaccctactaggcagtacagctgagacttggaactagactaacccagtgactcagaaatgtgccacaggacttatttggctctagatggggtcttaaaagacattcatagttgcaggcagaacagaatatccagaacaggtgcagaataacctgtgtgtacacagtaggtggtagttataatgcaggaagaatttggcacaagaagtgttacagtttaaaatgaagtcatgggccctatccacactggggacagagataatagtaactaatcatcatcactgtcatcactagcccattgtcagaggtagcactgaacacttatgcgttagccaggatttgggttctagagggtttagtgtactagttgggttaccaagacaaagatgcaggcatggggtgcaagttaacaaaggttatacactaggtggcaactgactcacaggagcctggttattgcagcggttgtggccagagccatacaagtgttctgatgcccctcaactgtgttgaaatttgtttgaggccaaccaagtcagctggcgagggggaaggcaagccagagagaaattgtgaaccagaaaggccccacctctggcagtggctcttccattggagatgaagtcttcttgccctgtttttctctttaaaaaagtgagccatttcacaagggaagttaaattaaaaactgtgcttgttagcgcggagctgggacaaccgagggaagtgatgccaaaggcaattgttggtctttccttcaaatatgtgctgacttaggaagagcaaaatgttttatattaacaattaacaaaagactaagtctttcatcacaaacaagtctaaattcagtggttaggtcagtattatattttcctatagttttaaataagatgcttatgtattcactagtgctttggatgttctttggaaaaatctccaatttagtgacaagccccaggaaatattactcttagttggtccagcatcctatattgtttgtgaaatccctcttttattgtcttttaaaggttgtaaaatgctttttctgtcaataatcagagaaggatgccgcattcatattaccccagtttccaactcaacctctcctttccaattgaaaacaaaagtcagaattcactttttgttgtggggcattaagtagtaagcaaagagatttcactcgccagggaaaagaaggagcctgcaaatcagacaatatcaaaacataaccaaaccatataaaaacacaaaaatgttgcttggcagaatttaactataattaattgtactaatttaatattgtagacacaaatgatcataaagccatatggtacaatccttttgttcatgaatttcttattcatcaaatgttaggtacgtgatgtgggaaagccagtatgttgggcttcgtgctaccagggctagagttgaccagttcagctttgtttctccagtgaccaaaaaaaaaaaaaggtatctgccttgcacatgaaaacactggatggttagattggatttagccaacaacaaactgcaaaaatcggttctggctaactgaagctcacagggtttattagagttgttggagcccatgggaactgatggagggcaaggaggcttgtcgtgcaggagcagcaggaaccaaggaagctttgcagagatgagaaacaaaaaacagggaacacagcaacatttgctgtgtcaggaacgactgccactggtggcctggacaccatcacagccgcagaagatacttaagacacatttctgttctagtgttggtagttcaagattcaaagtatgtgtgaaagtgagtgtgtgtgcataggcagagtagctaattggttgagttggggtccatgtgcccacctccaggttggaccaggggacaagccatgcagcgttttggtcacccctcacttggcagtattcccaccaggaatgaccctcgctaggatttgaggggcctggagtcactacttactaattttcttaaagttgacaacgatcacaaacttcatggtctgggaaaatgtgaattaattgcctgatccaccttcatatcttttttcttttcttttttctttttttttttttttaacaaaaatctgtatattcatagattgtctcttcctctgctagtggttttgcagtagcattttcaggtgaggaaacaacaacagagtttagggtccagctctgtcattgccattgttgtagcgatttacaagttgttactgctagtatgaacttttgcctagttaaattttggaaacttgcctgtaattgcatttgatggatgataaaaattgataaatgacttgataagtgataaaaattctacggaagaattttccatggactggcttctggctttgatcctttccaactgtgcttctcctaccctcaggccgcccctatcatgctgtgcttgtctggccccactcaccctgtcctgacactggatgatttatttccaaatgaattgctcctggaagccattccaacaccattacaaccggcggcaacacagctgtcttggatactcctggaccatatagatagatgtaaccacagcattccggtagctcccacttccccagcattttcttttagaatgggggcatcagagttgaaggaggtaactgtgggtagtgtgtcttgtctttggaaattttcatcatgacctgagcttgtgaacactctgccttggccccgcctcgcactttggaagagactggagcaggagcgggcagcgttgccttcgcagcatggtaacttctctcagcgctgtttgtaaagcagaatgggagaggaaactccccagagggaaactgggaccctgttaggtagggctagcaagaggtggttaaaacgtaagcatccgctgcaccagactgtattctccacgactgtatattttttgttgttcataagagccccgaattgcaatgagtacgattttccctggacgctgcagtgtatggagaagctgtcacttgtcacatgacagctcagtcattcgatccctgggtgctgcagagagggaagaattggcctcgcagtggggagtgagtgccagcccgtggcctgtcccctgccacgtgtcaccatactgaacgtttgtgtgtgctctgtgtgttttcaaaacaccttcatgtcacctgccccggactcctccctgtgagcaaggcagggtgggcgttaccatccctctggaccaacaaggacagaacagcttgagacgcacagggtggcttccccatggctgcggaggcatagaaagtgagggcacgggacgtgaatccgtgtgctgggattctggccgcctgtgcctgccgatcaccctcagtgcctccctggatttgattttgtggctcttctgggtgtgcgtgtgagtgtgttgtgggtaagtctgttgtctaggggaaggaacgggaaatcatccggccaggaatctctgtggggtggtcggcttgagttggccatatccaagctctgcgtgtgtctcacttttcagagtagcaggaaggccgggtgactttgaaatcagatgggtattttcctgattcgaagagacttggcttcttcccccgcccctccttctccctcctcccccctcctccctcttgctggctcacaaactcaatggggcatcccagcccacccatgggaggccaggagaaagaggaggcagagctgtcagagtgtggcccttcgtcttgggggtgtgcaagtgaccgctcctgccccttgatggctctcctgtttcgggtataagggatgttgtccaaaccatgtgtgggactctctgttgacagttgtttttaaattgcctgtttaattgagcttctctaaagtcttctttgtgccaagtatcgggacaggtgatagaaatagaaaattcgacacaaatcgaaaattccagtatcaaaaatgacagcgatgtacccttgccccttaacgcagccaagaaacaggggtgaagggctactctccacatatggagcaggccaccacccttgagtgacagtagccgaacacagaacattctctgcagatgtcactgaggcttaaactcattatgttttaaagggataatctgctattcttaagaaaacaaaaaacaatcacaaatctccctgccctccccacccctgcccccacttagatcctggtagggtctggcagggggagttttgcaaggagttggggcaaattactccagcagatacttccaccccgtatcccaagaaatgtgtgtaaatgctgttatgaattaatttaaaggtattccaaactcctactaattattatgtgtttgctcaagtcaagatcaggagaagtacaggcattgctatcccatggggcctgtgaaactctggtgaggtgtcctagtggaagagcttggggccccatggtgtctggaaagcgggctccactggagattctggctgttttcagcttgatgcacacggggtcccctggagaatgccaggcctgcctgagtgtgcagaggtgagggatcctcacactgcccagcatgtacgtggctgggagactccagagagacatgcaaaagtgctgttaactagacggcgtggtacaaatgcaaagtgagtgggtttttttttttccttaaacgacagtgaacattcatttcaatatttattttgcttattttaatattttactcaatgtttatttatttttatgtttttgagacagagtttcactcttgttgcccaggctgaagtgcaatggtgcgatctctgctcactgcaacctacgcctcccgagttcaagcgattctcctgcctctgcctcccgagtagctgggattataggcatgcaccaccacgcccagctaatttttttgtaattttttgtacagacagggtttctccgtgttggtcaggctggtcttgaacccttgacctcaggtgatccacctgccttgacctcccaaagtgctggaattacaggcgtgagccactgcacccagcctcaatatttatttcaatacagaaacggacttaattgggtattttgttgaaggcaaatagtagcaaagtgggactggtgtgaggcagtggaataacttagtgaaatccaaggtttatgtagttattttccccccacttttttttttttttttttttttttgaaatggagtctcactctcttgcccaggctgcaatgcagtggcatgagatcagctcactgcaacctctgcctcctgggttcaagcaattctcctgcctcagcctcctgagtagctgggattacaggtacccgccaccacgcccagctaatttttgtatttttagtagagatggggtttcgccatgctggccaggctggtccccccatttttatggtttgaaaattttcaaaccctggctgggtgtggtggctcatgcctataatcccagcactttgcggggctgaggcagaaggatcatttgaagccaggagttcgagaccagtctggacaaatagcaaaatcccatctctgcaaaaaataaaaaaatgaaaaattagccaggtgtggtggtgcacatctgtagtcctactgcttgagaggctgaggtgggaggattgcttgagcccaggagttcaaggcttgtgagccttgattgcgccactgcactccatcctgggtgacaaagcaaaactccatctcaagaaaaaaaaaaaaattcaaaccctcagaaaagcttaaagaatagattcatggatcgttaaacatttttaccaaatgtatgttttctctcattactctaaggttgctccctttcccccctcactctcctcttctccttcccttcactccatggatgtgtaggacattctcctacaaaaccatagtacttacattcttgaggttgtcacacctcataattaaacatatgatggttttattaagtatgctgtcacatgtaaatttctccagttgtttgatccaagttgtactcatggatagtgtattgtattttacgtctctttagtcttctgtattgtagaggagtcccccaaccttcttctatgacataggagtttggggatttgtctgtttcccgatgtgattagagtgatgttgaacagttttggcaggaacgctgcacagctgatgattatatttcccattgcatcccctcaggaactcagaatctccttctccatccttggtgaaggtgtattcaccagatggctccctgttgaagctcccttctctctgttaccaatgagtaatctgtgctatgatacagtgagatggtgtgattattctgttcctcacagtggttttcctttggtggttttagcatccactgattaccataaattaattagtccagctttggcaaactatggcttgccgtggtgactcacgcctgtaataccaacactttgggaggccgaggcgggcggatcacaaggtcaggagatcgagacccatcctggctaacacagtgaaaccccatttctactaaaagtacaaaaaattagctgggcgtggtggcgggcgcctgtagtcccagctactggggaggctaaggcaggacagtagcctgaacccgggaggcggagcttgcagggagtcgagattgcaccactgcactccagcctgggtgacagagcaagactccgtctcagaaaaaacaaacaaacaaaaaaacccccaaaaaactccaccaagtctgtttacttatgtgttgtctgttaacagttgcttttgcactacaacagcagaattgagttgggacagagaccagatagccaaaaatattttctatttagctgaatcttgatctagtacatttttggtcaaaaaatgatgcatttctaattcttctattcatttttcatttagtagttggcattcttaaagaagagctttctgttttgacctttaaaaatcactatggattcatttattcttaatttttttttttttttttttttttttttttttttgagacggagtctcgctctgtcgcccaggctggagtgcagtggcgcgatctcggctcactgcaagctccgcctcctgggttcacaccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgggccaccgcgcccggccttattcttaatttttaaaagtgtgttatacgttgttgtcattacattattcttttagatacacaatgttgccctaaatttgcccagtgggaacccctccaggctgggcactgtgttcttctgtcacgcccccttcaggatggggcctgggttcttttgttatgctcctctaaggccctttaatctatgtcgtttcatttttttgttgttgtttttattttgagacagggtctcactctatcacctaggctggagtgcaatggcgcgatctcgactcactgcaacctccacctcctgggttcaagccattctcctgcctcagcctcccaagtagctgggactacagatgtgtgctaccacgcccagctaatttttgtatttttggtagagacagggtttcaccatgttggccaggctggtctcaaactcttgacctcaagttctccacccgccttggcctcccaaagtgctgggattactagcatgaaccactgcgcctagcctcgtatctgtgtcctttctttctgggaccggaagaggtttcaggttcccagtggaaattccctgcccctcaccttgaatcagcctttggccaaagagccttggagaatgatatttaatatttaaaaaccaggaactgagaactgagtgtgctcattgctatggggatatcattgctcctgggctccttgggtgcagagacccagggaaatagatgtttctgtgtatgctttcacactgtccctccctctcaagcccaactccacaggatgcttcctcaccttcctcttgccatctagtatcacgcttctgtagtgagaatctgctgcctacagcaacaacatattgacacatccattctcttctataggacacaaaaaaaggtttcagaaatttttacgttggtgctgccaccaccaccgctaccaaagcaatgaaataaagttcaagattccttgagattctcttgtcgttaggatgtatctcactgtgggtgtacagacaatatacaaaagttacttaatttttctccgatgtttatagtaccaatttgataatgtaagttaaattattcatctttattgaattttaagatatgcatattttatcctctttgagttaagtatttttcaaatatagaaaacgtttacgtggtccaaagtcaaaactctgttaataggtttgctcagagttctcagctcccatccttatcccaccaccccatttttactcacctcttcagttcattgccattactttttgccttatcttttttgtgtgtttctttttgcatctacttagtgcttttaagccccccatttaaaggcctaatgctaagtcttacatgtaaaccagcaaaaatgtcacctttttaagtagacttttgtgaccaaaaccttattatcaaagcgtgaaagttgagaccgtctagggagttttcatcatggtggttagacagtgtgtggaattgaaatgtacagcgtttgtacatgcaggtccgttattgagagaactgatccaaaaccgtgacgactgccaataaaatgtactttaccaaatatctgctcaaaatgcccatgtctccttaatgtcaatacccaacacatgggtacatccagttttagtctcaaatgttttaagatttattaagcttggtttgcaggagtttagtgttcttggaattagaaggatttctctagtgatgtggtgagaagagataaacctgggaccttttgtgttttcttgatacgcacatttatgttgtgtgcaacacaggaattgtcaggaacctgcaatgcaatctttcttgatttataatcttgcaaaatgtggaataaaaagtaaagtgcaaagtttaagtggtaagtgttacaattcatgtgaacaatatgatgctttttctcatgcttacttgaagacagcagctggcccttgagttcagtctcagtgcaaacagcctccaaagaaagtgcattgcactaaggaagcccttttcatctcacaaagggcaaagtctggattgcccccctttctctgttgtctttgcctgttgctccctggaccccagccagtctccccaggcctggagctgggtcagctaggtctgtggccaggaggtgggggtccacgtccactgtgctcctcagcggcaggttctgcaaactgcagcccgtggggcagactccacctccagcctgagtgaggccatccagctaagaatggctttgacatttttaaatggccagggtgaaaaaactaaaagaggattttgtcatgacacatgaaaatgatataaaatgaaagtgtcaactgtcatacattttgatttttgtcagtttcagagaaatttattttctctttttattaaatgtcactacataatatacttgattttgcctttctgctcactgaagctaaaatatttactctctggccctttccggaaagagtccgccgaccccctctctgtggaatgagagcttccaaaaagatgcagaagaccgtgcatcccaagcggttgtaaaagccacttactttcgtaggtttaatgactcaaaagaaagggcgcttgttccctcccttccttcctgggcaggcccctttttggaatggagtttcgttatacagaaagttgttctcgctgtacagaattctgcgatgccttcacttgatggctgtttcttcggggataggagggctgggggtcaggatctgatctcacacgaatggttcagagtctggacttagtagctcagagcagttcactgatttgggatctctggaagaaaagggtactgagtcactggcaccttctgctcagctcctgacagcagtgtaaaggatgctttcgtgacacccagccttcagcccaggaggatggtggcagatcagacagctctggaaatgcagggcacaatgcgcagagggttgcaccacaacagcagtcactcggtgcccgcctggagcactgctctcatttccagagtccctgtatttctgatcttggctgctttaaaaaggaggtgtgggcctgggatcccagaagtattcctctgtgattctgtaccacagctttaccttaattgggggtgtagggggtggggagaaagaggaagacagatgaaagcagggaaatccttcttggagtcatagttaaaaggataaaataagagctttagtgtagcctccgtttccagcaatccattttattctttgtccacaaactgaatgaaaataagcagtcattcaaaaatgatatttacgtaacctacaaaaatctcaatcaaccaaggaaaaggtggaatggggcttaatacaatacagggctgtctccggagttccctcccttgatttcaggcttttggtgtaaagctcccgaaagaaagcaactttgatttttattagactcttcaaaatcatctcggtagaatattgaccttttttgtgtgtggaaaaatgacttctacgaattctcttgtaggagtgtacattttggtcattttttggaatgtaggaaaaaaaatgtggggtaccctttattgcattttcaagaccttccaaagaagataattctgattgtaactcattataatctgggaaagtagattgttctggtttcaaggactgcgtgtgctttaaataatcacaggctgctctcagacttgggaacttttggtagaatacagcagtgattctcaaccagggcagttgtgttccttgggggacatttggcagcgtctggagacatttttggttgtcacgttttggggaaatgggtggtgctcctggcatctaatgggtagaggcccaggatgctgccaaacatcctacagtgtgcaggacagcccccccccaaccaagaatgatttagccccagatgttcatagcgccagaggtggaggaactgcctcgggggatgtgtaggagctttactttatgggttttttaatggaaaatatatgtatagacacgtacatatatatacgtgtacatacacatgtagatgactctgctcagcgcacccatgaagtatgcagtgcacctgtcccctgggatctggttatacgatgggtgtccagcctgtgcccaggggatcagtttcctttgtgctgctgcagtaccttgtcagcatggagagggggaggtcagttatgaggaggcccttttggggtagagtggaggaatggtgccgcctggtcaaggcctcgcatggggtagtgttctttgtacagttctaggtgaggcggcgaacacgttctcatgcattcttcatggtggtggtgatgctgatgttaagaccaacgggcctctgttgttctgctcaaggttccaagtagagtaggttttctattttcaaaatgtagttcacggtgtcccaatttttagtgcagcgtatttcaacaaaatgtccttttacacatataaatggcttatgttgcaaggtccccctcagcttcctggtgtggaatcagtgatggataaaggcagagaggctctcaggctgacatatactccctatgaagaggggggaagaactgtgttggcccatgggtgtttggggaaacacttgtattccaaggtatttgtggagaagatatgggatgtttttccatgttgggcttcggatatgaagtttaaggaaggagaatggagtcctggtgcacacctctcataagcacacgcacgctggccactctgctggctccagagtcatccagagcatcgagcatagtttctcccccggagaccctccaatctgatcagatagggaggctgtgagtctggtgacccccactgcagggggcagagctagtgcaggtggtgctgagctgactgggagaagaagggcctgcaggaccggctgcaaagcccttaggggagggaggaagtgaggaatttggtttcctaaacgggtggtccaagagaggccgggttcatcgctgtgcagtgaggtggcactggaaggagggagtcctcagatgggccaccctttggggctataagtctcgtggtttgtttctcttggcttcaagataacatatctagtttgggtgttttgggatgatgaggttggggtgtttgggaattgaggtggccgcgtaggcattgaggaagatactggtgttttgtgcggtcaaagggcaatggtgtggaactcagatcccagctctgaccctgtgtggtcttgggggatcatccaccatcagtctatttctctgtgacttggggataacagtacatgtgagcgtgaaataagagtataaattgcatcaatgtctgtgtgtcaaggttgcctgaggaggagttggctgggcttgcactgacgcttgattctttgtatcactccgacttaaaccacgacacttccaaggcagagtctaaagcctgtcctctcacaatcttctacaggtgagtaggaggccatagaccttgtgagtacagagtcctaaaagaaggcagaaatgtgtgaatctgccaaaagtaaagaaagggtgttactactggtcaaagtcgttgcaagaatgctggcttttacaactcctgtttctgctgctatcacctgctgcctgtgtcttgtttcctgggctccagatcattttcacatttctcaaaatggtccttggtagctgtggtagatggaataatggccctcaaggtgtatctccatcctaatcctggaacctgtgaataggtcattctacatagcaaagtggactttgtggacgtggtttaaggatctcaaggcctggtgccaggggctcatgcctgtaatcccagcacttgaggaggctgaggtggaagggttatttgagcccaggagttcaaggccagcctgggcaacagagagagaccctgtctctagaaaaaaactaaaaattagctgggcatggtggcacgtgcctgtagtcccagctactcaggatgctgaggtgggaggattactgaagtccaggaggtttaggctgtagtgagccatgttggcgccactgcactccagcctgggcaacagagcaagacactgtcccagaaaaaaaaacaaaaacaaaaggatatcgagatgaggttggggaggttgtctgggtgggcccagagcaatcacagaggtgcttctgagtggaatagggaagctgggggaacagaatcccagaggagataggaggatgggcgcagaggccccagtgatgtgggcccatgagccaagggatgctggcggcctctagaagctggacaaggcaaggaatcgaattctcccctgaagcctttaaaaaaggacacagccctgtgacccattttagacattgcacatcgagaacctaagagagtgtgtctgtgttgcttatggtagccgagctggagattctttgtgacagcagcaacaggaaacgcagacagtgggtgagcaccagatggtagagtcaagtttaatatgctggagcaaggagggtcagctaatcactggcaaaagatcagggcctgggacttttgctaactgtttctatggattcctccttcctcttgcaatgagaagcgacagcctcgtggtgaaatttgttagctgtttattattttcattgatctgattctactagtgtgatttatgctaagcataaatgaccaaagttgactgtggttttttgaagaacattggaaaataaacgtacaaaattatgtttttataataatggttcagtccaaaataaaggaatatattcatagaaattagctaaaattatagagggtaagttacatacatcttcttcttaaagatgctggtaccaacactggaagaagctgtacaagtgggcaggttgttttttgtttttgagactaggtgtcactgtcacctcaacctccccaagctcaggcgatcctcccacctcagcctcctgagtagccgtgactacaggtgtgcacctccacatctggctaatttttgtattttttgtagagatggactttcaccatgttgtccagactggtcttaaattcctgggttcaagtgatccagatgccttggcctcccaaagtgctgggattaggggcatgagctacggtgcccagtctcaatttttaaaaatatattttaccatcactttccaagctttttgtcctatgtgacaacagaaaattgaatttcttaatccacttacattgaatttaaaatccacttaggaaagtgagcttcaggtattagaattattaactccgaataagcagatactctagcatattttatcttccagattgtgttgtgattgtaacaagacacattttatgcattttagttttcatcacaaactggctgaaaatcatgttatgtacaaatatgacttgattcaatacaatttattgtttgggtataatttgaattagaaagccatttgtataccttttgctcacttacattatgctattatgcttttgacatcagaggaaatacacttacttaaaatcctcgcagatcccagagcaaatgaagagtttttgttcttttaaaaattggaagtagtctagttttctggttgtacagtaacaatgtgatatatattgtctttatcatatatacacacatacataaatcatctttccttcaaagatctcagatcacttttttaaaaaacagctttactgagatataatttacataccataaaattcccctattgtaaatgtacaggttcagtgaattttagtaaatttacagagttgtacagacatcgagacagcacaattttagaacattgtcatcactccaggaagcgtccctgtaaccattagcagtcacgtcctccccagcccctggcggccactgatctattttatgtctctggatttgcatattctggacattagatataaatccaatcatataacctgtggtcttttatgtctggcctcgttcatttagttttcaaggttcatccatgtcatagcatggattgatccttcactttttattttattttgtgttttttagaaacagggtcttgctctgttgcccgggctggaatgtagtggtaggatcatagctcggtgcagcctcaaacgtctgggctcaatcagtcctcccacctcagcctcccaaatagctgggactacaggcagacaacaccacgcctggctaatttgtttttagttttgtagagagagtgtcttgttatgttgcctaggctggtcttttgaattcctgggctcaagcgatcctcctgtttcagcctcccaaagccttgggattacaagtttaaaccaccacacctggcctgttttttattgttagataatattccattgttataaatatcccacatttttagattgattcatcagtttatggacatttggttgctcccatgttttttgctgttataaataaagctgctgtgagccctcgtgtacaggtgtttacatgcacatatgcttttattcctctggggtagatttctaggagtggagttgctgagtcatatggcaatgctatgtttaactttttgaggaactgccaagctgctttctatagtggctgcagcatttcacattcccacccaaatgtatgagggttccagtttctctatatcctcgccaacacttgttattctctctcagagaactttctgaatctctcttataatgcctagggggttccttgttgaagatgaaattagggactaccatgaactgctttaggaaacctgggagaaaggagtcaggcccctttttcatatctatgcagtgtaaccggcctctcagaaagattggttggagtggatgggagaataaagaaatgaatgggttgggtgcagtagcttacacttggaatcccagcactttgggaggctgaggtgggaggatcacttgatcccaggagtttgagatcagcctgggcaacatggcaaaacctcatctccacaaaaaaatacaaaaattagctgggcatggtggcacacacctgtggtcccagctacttgggaggctgaggtgggaggattatttgagcccaggagttagaggctgcagtgagctatgattgtgccactgtattccagcctaggtgccagtgagactgtgtctaaacaaaaaaaaaacaaaacaaaacaaaaaaaacagtacaaagtgttcagtgccgtcagatgttctgaatatagtatgatgagaatgcagtggtgggggagaaggtggattagtttctgtggctgctgtaacaaactaccacaaacctagatgcttaaaactacacacatttactatcttaacagttctgggctgggtatggtagctcatgcctgtcatctgaacactttgggaggctgaggtgcaagaattgcttcagctcaggagttcgagaccagcctgggcaacatggcaagaccctgtctctctctaaaaaaaaaaaagccaggcatggtggtccacacctgtagtcccagctacttggaggctgaggtgggaggatcacttgagtccaggaggtcaagactgcagtgagccatgcgagtgctccagcctggatgacagaacaaaatcttgtctctataaaaagaaactggaaaaaaaaaaaagtagttctagaggtcataagttccaaatgggtcttattctgctaaaatcgaggcatctacagggtggtggtatttgctgaaggctcgagggttaagtttctggttttttgttttgttttgtgttttttgtttttgtttttgttttttttttgctttctcagtttctagaggctgcccatattccttagctcatggccccttcctccatctttaaagccagcactgcttgttcgagtctttttcacattgcatttcccctttcacattgaaagcactcttctgatgaaccacttctgttaaaaccactcttatgatccaagataatttacttttttaaaagatgaactgattagcagcctgaattccacctgtagccttcattcctccctgccatgcaacttaagttgttcatggtttctgggaatcaggatgtggacaccttgggtggggatggaccttaactctggctgccaccaatggcgcctggtcaaagtatcctgtaggatttattcttggaaacggcgttaaccccaacgccctactttgctggctgtgtaagaaacacgaggtcagtcaggcagtaagaggagcatggacttgttttctgaaacagcgacacaatccattacatattttcgaatgacgagatgagatcagacttctgctttaggaagagtcacagggttttgtggatttgcaggggaaacaggcggtcagagggagttctgtgtcaccgtccagaggctggggtgccaaggagggcagtggcagtgggcttgaagagatgcaatggggctgctttggggctgaggcgactggactggcgtctgattgatggaataccaggagagggatgggagagggaaagagatgagtccaggatgacagttggaaagtcctggacttcggagtaaagggtagcgattgaggagttaaagggtagaatcaggctggggagagcaaatttacttttgaaatagtgacctttggatgctggacagggagatatgaagcaggcagaggaaatatgggcatgaaatagagcttcagcattttctacaaagaagccaccacattcggtgacatgacaagggagtgatgccagagggaagagaggtacaagggcagaatgctggggaaatgcctgtgtttaatgggcgtggagaacccgcttaataaataatgagaatatattgctggactgaaacaaaagtcctcattagctcattaaatgtttcctggaattcccagtcaaatctgtgaaacaattttaatgctagatgttttgtaagtatttctccggaaatctggaaatttgtccacagacccccagacattgtttataaactgaagtcagttgactcaagtattttgcaaatgtctatggaccctagtgtgattaatagaaacacaaattattttaaaggtgtcactcaatttacagtcattctgtatttttgccatttggtattttttcctgaaacattacataataagaatgcagcatgctttctttatgtaggtgatctgtgaaactttttgacaattaaaaattggtttttggccaggcacagtggctcacacctgtaatcccagcacttcgggaggccgaggagggcagatcacccaaggtcaggagttagagactagcctggccaacatggcgaaaccctgcctctactaaaaatacaaaattagccgggcgtagtggtgcacacctgtaatcccagctacttgggaaggtgaggcaggagaattgcttgaacctgggaggtgcaggctgcagtgagccgagatcttgccgttgcactccagcctgggcaacaagagcgaaactccatctcaaaaaaaaaaggaaggaaaaaaaaatatatatatatatgtatataaaaattggtttttgctgtttgttgcggcatcacttgcagttacaaagaagtgaacatagtggttacagattgggttgtaaggctggacctggccgtatgatgggttactaggcacctgttaaaaatagtactgtggaagtggtatatttattggcatgtccatgtgtttacaatatattacaatggtgttactgtaatccccaggagaccagcagcccagctgggactctgagagctctaagatacgtccttggagtaaaccaagctgcaaggaggtctgttcacttctgtattgtttatccactcataaatttgatttacatagctggactttggtgttgtacagttatctcataatgagggttattttaagaagtgtctcaaggaaatgtgtcgtgtgtttactgaggatagcgttgtatgtagtccacaatttcctctttctgggagaaattttgcacatgtatcagaagtctaggagctgtgtttctgatatttgcatcttctttattgtttagatactgtgaatccagcatctaactatagttccttctttgaggtctaggaaacttggaattggattgacaattcccttccaagtgatttcaggttgtatccgactgcgaactttggataccgccttcctgtctcagcttcgtctcctttgtcctaccatgatcttctcttggccccagtttacccagtgaattactttatttttgctattttgtatgtgtttttggaagccacccccagttttttctcttcttttcctgggtggggagttagaagtgttgcagtggatgatggtgctgtggctttttggaggttggtttgcagtagcttttgagttctggtgtgttagtgtcatcttattctaatctagctgcttcctgttgaagtacatcaagacgaagtatatttctaaatttattacgatgaatactctatcaaaagcagctggtgcttaggccctaggtagagctttaagataaagttctttaatatcaatttagaaaaagaaagattcataatgattaatggagctcctgcatcactgaattttactggaataaaaaaaattagtgggcttaaagttacattgaatgtagtggaaattctttttcttatctccattactgttggggaacaatttcatctaaaccccattgaaaactgggccttatagccttcagtatacttcataacatttgttggaaagcaggaaatgaaaacgaagtatttgaagtaaaagttcttaaatgtgtcccaagaaatgaggattactgcagaaagaatggatcagttatttctcgaattataagaaggaaatatctgcagccttttttgtcatcagtgcagcagccccggtttttctgttaatcatagctggtaataatgccctccggtttatagttttgatgagccgggagctaggctgcgtgttttacatataatatctctgttccatcagctgcataacctagatatccttcaccccatttttatgagactcatgggttcttgtctgggaccatgcacctagtaactgacaagattgcaaactagttatgtcacctgtggagttccacgacaaaggcaattctaggcgatgtttatgtagtgttccttgcatgccagggggattctgtgctctttccatgtgtgaatgatagcatccacctgctaactttgttgggagggttcagttatcctctctgtacaggtgagaacaggaggtactgaggacatctggcccaaggatactaccgctggcacggggtggatggtgattcgccctcagtccctctggcgcagcatctgtgctgtttgctgccaggccagctgcatcccagatagagtgacaggatctgttcgcgtcacatccagaaaaggctctgaggccaagctccctgcgttgcttctcactttcactctggaatcagaggtgcgtgcctggaggacttagctctgcatggacagctggtaaggtgtcacagagggtgaggtgggccattgtagcagagagttgttaagagttggttacgtgggttttctcacagggtacaaggctgaggaatgggaaaccagttaggagaccttgctaatagcgtggaccaaagatggggagtaggtccagacagattccgcagtgttcatgcagtgttcatgaagcaggtgtagacagattgcggggccattcatgaaggtgatttgccggggctttttacggatggaaaaccccttttctgtgttcatcccacctcctgttgtcgacagatgacacctgcacaatcaggtcctcccaactccttccaccacccaaagtgaaatacgcaagtcccagagaactgtgtcattcttaccgaagtggctgatgtaggatgttagaaacatctcccaccccaagttgtgacaacctgaaacatccccagacattgctaactgcctcttggagggggcacagtcacccgctgttgggaacacaggcctaaaagcttggagccagggctgactgtctgtgtaggctagaacagaattcccaatgacccatcaccatgacatctgacactcaaaccgcaccccaccccgaccccccacaaccaccaccttttaaaaatttccatttttggaaaaggctggggcttagaagtcattatgaaggcacccatttccagaagggtaagaatcagaaagttggctaattcgggtctctgctttacaggagttccgcagcgtctttcagtagagtgaagctccagtatttgtatgagtgttggggttgtttggtggtgtggggtaatgcaggaggagagaattggggaactgttaaccaccacccaaacaggctatagagaagaatgccaggggactttactgtgatggagacaggagcgttgaagtctgaagagtgacatctgggttctctgtacgttctgatttcttctgctaggatgagtatagaaacatgttctctggggtgaaagtgaagccttgtgaaattcatacaggtgaagctgctgatagcagctcttcccgatggcatgaatatggaggtggcggttgaagcaagtttggtttgtgaatagaaatatacgtgttcatatgtatgtgtgcacgtatgtgtttgtgcatgtgtatgctttaggacccagttcttggattagctgattatttttttccctctctatagacattggtgacctaggttttcagatacttatgtaagtgaatagttgaatttgtttgagcatatttaattgctttcctgaagggatttgctggctgttttgttaaatgaaattgaagacagtactgttgacctttccaggtgaggagggagtcagaagtgttttgcaaatgatggaaactgaaacgtgagtaccaggaccatatgatgttcagaaacttttatcataactacagtgaataaataaagtgcttgacaattagatttaaaattaagcttcatcctcattgcaaaatgtggagacagtgctttgggacatgaggaagagattaattaggattcttttctacctcaagatgcgctatgtcatctctgaacaaaaaactgattggtattacgtgaggattatcttcataaagttcagagttgtatctacggggacagatttgaattgctgttaattgacaatttgctgaattggaaagatcatattaccttaatactttaatgtatcatctttaaatgtgattctttttctttctctcactaaagattagtttcatgccactaaataaaatttaatcttttgctgtaatttaaataataataagtgcttacaaacatattatgcagctgatagcttgttaaaatttcctgtgggcttgttttttgtttagaagtactgattttgccagttgtacaagcatgaaatattgtttatcaagcctcataagacattaaagaggaaatcaagtttgtgtgactttaatgtctctttttctccttatttcagtggctcatacttttaccctgaacttgtaaaatctacaagcttaataagattccatattttataggaactaatggatattcaatgacttgcctgaagagtagactaagaaaatgtatttctccatgaatctttacatagaaaaatgaaagatttttcctgaatatttatttctcaatatatacagcattaatatgtctgtttttcttcaaagcagaaaaaaaaaaaatcagtgattgcctttgggttttgatcttgctctgtatttgttttaagtacacacctattacatgcccactgtattctaggcactaagctctaatgaaaagtggtttccagtcattcgaatggaacaggaggctcatgtactttgaagtgggtatacagaacttttgcactttggttttattctactttctgtctatgtccttggcactagaatgcttggacgacagtttgctatatctgtggtatttatggaatgagtgaaacatgcaaggagaatgccctggctgccgttctggcttctgccctacccagagcatccagtatacagaagcagcgtttcttaccacagcttgcggaaagacacggggagtagtcggcttgccatataaggaagttgccttcagtggccttgttcattttaggtgttttttaatacttgcttctcttataatacatgttactgttccgtgaggaacctcagcagctcccctaaggggaaaaaaggaggagtacttgaaggagtactgtttatacttcaggggcaataaaatccatgtttatgcacaaagggacctttccacttgtgtgataaccattctacaaggcccttgagttcctgtgaggaaggaaggacgccataaggaatgaaatcacagaaccttattatgaaaatagtaatggtgggatttggaaattatactcaattttttcttctgaaaacaaattgaataccacctgagagttggtgctaaaggccctgattttcgtattttaaaaaatttttggcatagtctttggatttgtgctgtcctaatatggtagccaccagctgtacatgagtatttaagcttaactaagattaagtaaaatgtaaaattcagtttgtctcacactagccacattttgagtgctcagtagccacatgtggccagtggataccttattagacaaggaagatgtagtgcagaaagttttattggacagaagaacaatggttattcagatatttccctattgggaattccagggaagaaagggaaaacttaaatctgaagaagaaaaattttataccaagggactagggggcaatgcagaaaaattaaccacatcaaaacaatttactacatcaaagttcattgtcatgacatattagaacattagcataaaggaagtatctatgcacttcccggatttaaaaaagagtcacacgaaggatcttggaatcagaatgacattgtatttcttaacagcaacacgtgaagttagaaaacagactgaacatagacttctttgaaaataattttccctcagaattttgaaggtgttcctccactaattattaattaaggatagaataaagatgtttgggccgggcgtggtggctcatgcctgtaatcccagcactttgggagtctaaggcaggtggatcacttgaggtcaggagttcaagaccagcctggccaacacggtgaaacctcgtctctactgaaaatactttcacatgtcacttctaggaaacttatggagaatatgtcccaccaaagtgagggagtaaaccaagaaagggggaggtttgggatcttggaaacagaaagaggcagaaggaattctcaaacaaaggtgttttcagggcagtggctcttgtagtacagactagagcaggagacaaattttaggaggaggccaggcgagatggctcactcctgtaatcccagcactttgggggggcccaggtggacagatcacaaggtcaagagattgagaccatcctggccaacatggtgaaacctcgtctctactaaaaatacaaaaattagctgggcgtggtggcgcgtgcctgttgtcccagctacttgggaggctgaggcaggagaatcgcttgaacccaggaggtggagcttgccgtgagccaagatcgcgccactgcactccagcctggtgacagagcaagactctgtctcaaaaaaaaaaaaagaaattttaggagaaagtttggtgttagtgtattggtcgaaggtgggagggatgtgggtgggtgttgcgggaggaagggcatggaactgacaaattatccaagagttttgatcatgtaaaaaatgtaatagattgttggagagtgtgggaaggattatcaaagagtacaaagaaaactgaaatgaaaacagaggcaaataataattctaggagaacacaaaaagtatactaaaaaaaaatcataggctgggtgcggtggctcacgcctgtaatcccagcactttgggaggccgaggcgggcgggtcacgaggtcaggagatcgagaccatcctggctaacacggtgaaaccccgtctctactaaaaatacaaaaaaaattagccgggcgtggtgttgggcacctgtagtcccagctactcgggaggctgaagcaggagaatggcgtgaacccgggaggtggagcttgcagtgagccaagatggcgccactgcactccagcctgggtggcagagcgagactccgtctcaaaaaaaaaaaaaaaaaaaaaatcataatcatactatattgcccactcagcagtgcccattccattgtcaaagtaatatatgtgaaatattgatttagctgaaaaaaaaagttatatgagctatcgaaaacgtggaagggtcagtgtaagattggtggtgggaatgtaaaaaaccaacaatccttacctatgtgtgtgaaaatcagtaagtgatatctaaacttgatgtattgattagagtatcacaaacagactatttagaaacatggaagtctggccaggcatggtggcttatgcctgtaattacaacacttcgggaggccgaagcgggaacgtcactagagccccggtgtttgagaccagcctgggcagcatagcgtgaccctttctctaccaaaaaatttaaagcattagccaggcatggtggtgtgctcctgtggtcccagccactggagaggctgagacaggaggatcacttgagtcctggaggtcaaggctgcagtgagtcgtgatggtgccactgcactccagcctgggtgacagtgagaccctgtcccaaaaacaaaaaacaaaaacaacaacaaaaaaacaaacttggaagtcactatgcagggaacagcaccaataacagaaacagctccaagaaagtggttgctttgggaagtggaattggtgatagatggtgctaaaaggcatgtaattaataaaaggagccttttgcctcacctgcattttaaaaaaaattttgtacatgtattactttgtaaagactaaaagtggtttggaaagtgaaagtataggatatactatctgtataattacagacattttggcatagttaaaagcagggtttcacaaccttggcattgattgacgtttgtgtcaaataattctctttgttaagaggacctgtcctgtgtgttgtgggatgttccgcagcatctctggcctccacccactggatgccagtggcattcctccgccagtcctgacaaataacagtatctctagacattgcccaatgtttcctgggggtcaaaattacctgtaagaaccacttgttttgaaggatttttaaatatgtcattgaataaacctcaatatataaccctgctgtttgatattggtaatacaggaaacaccagcttccttacacagaccttgaaccctggagcaaatgaagcggtttggaatcctctggcactggaacacccgcaatgctcatgctggtgcatgtattagtcagcgtctggctcttggcccggttaattcagagctcactaaaaacagaaaagggatcaggaggaaactgcagcttctctgtcatgcttagtggcttctgaaaacatattttagatttttcatgttgctttcatgatggtacaacttgaatttctctggagttgaaatgttaatcattatggcaaaaatattgcaccctttggatgcattccagtgctcaggtggctgcggacagatcctctctgtctctctgcttccctccacaattcttttgcaagttcttagttaagttattgtcaagtgtttttccctagaattgacacaggaagtcaacaggaaaatggtatctcagattttttgatgtggatgaaacctcataaatagtttaaaaccctcatttcacagctgaggaaactctggtgcagagagggttttttacaattaattgggagcacaatggggcctggaactctgttcttctgttttactctttccttttaaaatacaacatgtgtgcccagtaatgctggaggaggatgatagaacgggctggggaagggctagggcatctggcgggtcatgggagtttgtcaggattttcgcactgttagaagttctcagcatcctctgccaggggcgtgtacccttagtaagcttagagaaaatggcacagagaggcaggaagtgtagtttccatgatctttccaggaggtgctcctgtacctcagttcctgatggcccagaactgggtggagagtgtaggctggtgcattggcgtgtctgacagggaagaccctggcctccttatcttgcagctcttgctaccagggcactcatggagccagcgtgcaccgccactgcagctgttcttgaagaagtggccagaagagtgaaattggcccgttgaggaagggtgtggagctgcttctctgtgggtccctgcatgacttccctgttccttcccctgggatcaaccttcctcaccccacatggttcagcagatgagggttaagtctgccccagcttgggggacgctggtgtcccactcaaaccggttgtccagtattttggtgctgcaccaggagagtgccatctgcagtctgcagggctgtcttgcccaggtggccccttcttccctcggatggatggggcatactgttctgaccaccatgtctccttccaggccacatcctctttcgtgagcactgtgagggcatcaccccacatttttagaaacctcagcgccccatcttgcccccatcccttgcctttggcaccacttaaactacagcctcattctcttcctcctcgcctgagttctccagccaactcaagtgccacctcctccatgaagcccctgtaggtttcctccactgggacaaggacgcgcagagatgaaaggcagagaagtccagccctgggacttccaggccgtcagttcaatcctttgagcctctgtctcctcctctgtgcagtggggcagttcagtgctcccccttagtgctgtggcacgctgcgttgattggcctgggtgctgttgcggatgcccagcgagttctctgtctccctcctggttcttgtcccactccctgctccctgttacagcctggaagtggttggacggtttcccctgggagtcttgagaacccccaaagacgccatgcatcttcttgtcctcttttcgtggcatgttctgtgttgtgtgtgtgtgtctgtgcaacgtgctgtggcattatgtgtgtctgtgtttgtggcgtgttgtgttgcatgtgtctgtctgtactgtgtgtgttgtgtgtgttgtgtgtctctggcgggctgtgtatgttgtgtgtgtctgtgcacgtgctgtgcggcatgctgtgtatgttgtatatgtctctggtgggctgtgtatgttgtgtgtggctgtgtattttgtgtgtctgtgtggctatatgcggcgtgctgtgcatgtcgtgtctatctgcaccgtggtttgtgtgttgtgtctatctgcgtggtgtactgtgtgtgttgtgtctatctgtgcagtgtgtctgtgtggtgtgctctgtgtatgttgtgtctatctgtgcagtgtgctgtgtgtgtgtgtgtgtggtgtgctgtatgtctgtctgtgcaaggtgctatgtgtatgtcgtgtctgtgcagtgtgctgtgtgtgtgtctgatgtgctgtgtgtgttgtgtctatctgcagtgtgctgtgtgtgtgtctgtgttgtgtgctgtttgtgttgtctctatctgtgcagtgtgctgtgtgtatgtctgtctggtgtgctctctgtatgttgtgtctatctgtgcagtgtgctgtgcgtggctgtgtggtgtgctatgtgtgttgtgtccgtctgtgcaccttgctgtgcatgttgtctatctgtgcaccttgctgtttgtgttgtgtctctctgcacggtgcactgtgtgtgttgtgtctatctgtgcagtgtgctctgtgcggtgtgctgtgtgtgtgtctgtgcagtgtgctctttgtgtgtgtgtggtgtgctgtatgtgtgtgtctatctgtgctgtgtgtgtctggtgtgctgtgtgtgtgtctctgcagtgtactgtgtgtgtgtggagtgctgtgtgcgttgtgtctatctgcagtgtgctgtgtgtgtggtatgctatgtgtgttgtgtctatctgtgcagtgtactgtgtgtgtgtgatgtgctgtctttgtggtgtctgcagtgtgctgtgtgtgtgtggtgtgctgtgtgtgtgtctatctgtgcagtatctgtgcaatgtgttgtgtgtgtgtggtgtgctgtgtgtgttgtgtctatctgtgcagtgtgctgtgtgtgtgtgtgtggtgtgctgtgtgtgcacgtgtgtggtgtgctgtgtgtctgtgtggtgtactgtgtgtgtgtctatttgtgtaccgtgctgtgtgtgtgttacatgtcctgagctcacgccttctgttttcacatttgactgtgattactgtcctttttgagatctgagtaacagggacagggctgggcccgatgacttaggcctgtagtcccagcacttgaggatcatttgagcccaggagttggaggctgcagtgagctgtgatcgcgccactgcactccagcctaggtgacagagtgagaccctggctcaagaaacaagaccaaacgaaacaggaatgggtggccagttctgccacttcctttttatttgtgaaatctaagcacatacataatccaggtagttgtcacggaaaggggccataactcaagagaagtggtgccctggagcctaaaggctttcccattaggataaattagaactggaaattgtcataaagacaatgcagggtttgtggatttcagctggatgagtaaagaccagcctgggcgtgaaggattttcatagtcagttgctaaaggtggtgccccaggaaggctatttggcaggcgtggggcgcagtcctggcatggggtgggatggggctggaggtgctgctaatctatcttattaaaacccaggaagtttcacaggcgccttccaaaccacagctcgttgatttaaagatgtgaattccacgtgtgtaagccaacagaacaattgcgttttgtggtctctggctgatgaaaagtccctgatgaagtgctgtttggtaaaacgattcctctccattttcctcccttccaatctgtggttcacatttattcaacgttcttttctttcaaacagcatttgtgtgtagccaacacacatgcatatggagtgctgcgaagtctctgtgcattatctggaaacctgctttctccagaaaagctgactatccacttcccgtgctctcaagcccaagagacaggaatgggacgtggggagcgcgtaccctcttctcaacaagcaggttgaaaatccagtgaatttctttatgatggaatttgaatcacgtggacattcattagaatatttgggcaggattaagcccttaaaactggctctagattatggttataaaatggcctcaaaggaccctgaaactaatgaaagaattcttccatttctgacatgcttcactccctctggctctggctcttatcccaaatcaaagaatgttggtttttttagtgtttcctttataaacaaggatggtttccagattttttttttctttttgtttttttttttttttttgagatggagtcttgctctgtcacccaggctggagtgcagtggcgccatctcggctcactgcaagctctgccttctgggttcacaccattctcctgcctcagcctcccaagtagctgggactacaggcccccgccaccatgcccagctaattttttgtagttttagtagagacggggtttcaccatgtcagccaggatggtctagatctcctgacctcgtgatctgcccgcctcggcctcccaaagtgctcggattacaggcgtgagccaccgcgcccggcccaaagtgactcttatactccattataattatgaatttggaaaacaataaggatattatatgagtctgctcaggctgctgtaaccaaagaccacaggctgtgtggcttaaacaatagaaatttcttttctcacaattctggaggctggaagtccaagatcaaggtgccaggaaactcagtttctggggaggcctctcctcctggcttgcagatggccgccttcttgctgtgtcctcacacggcctttcctcggagcgtctgtgtatgggtggggtggaggggcaagcagagagcttgcacacttcgacaatatgaccatctatcataggcatcaatttagtttaacttcatttcatttacagggtgttaaaaaggaaaatcatctgcataatttgagctttttcatagtgagttctgaatctaatttattttgagttattacagaagtctgcggatatcccaccttaagatagccatatgcacaattagtcatttcttaagggatcccccaatgtgaaaagaattccccgagaaaagacgacctgaaagatcttggcctttacataagtgtacacagaattatttttattgtgataaaatatacataacataaaacttactatcttacacagtttaactgtacagtttagtggcattaagtacactcacgttactgtgcaggcatcatcaccatccttctctaggactttcccagctttccaagctgaaactctgtcctcattaaacatgagctttccattccttctctccccaccaaccacctggcacccactgttctactttctgtctctgtgaacttgatgactctggatacctcccgtaagtggaatcctacaggatttgtcccttttgtaactggcttatttcacttggtagaatgtcctcaagattcatctgtattgtagcatgtgacataatttccttcctttttaaagctgaataatattcccttgtgtgtatagaccacattttgtttatccattcatgcatcgatggacagttgggttgtttacaaggaattattttaaagccgaatccagggtggctggcttgtgactactatttagatgcagacagtgattccaggtggtgcgtggtgaaatcatgtcacacccccgcggaaaactccacagctttcctcatgtgccctttccatcacttctctgctgctttaggaactacttttcttctgaggtgacctctttctgttcctttcagtttttaaaggaaagaatagtagaagtattaaaagcagcagcagaagtccacatgttaaccctgtgccagcccacatccccttgtgatctctggcagtggggtctcttctgctagcttctcccgagcttcctgccaaaaccctgtagccggccttcgccatgtccctgaatttgcttttctttttccaccctctacaaccttcctttcctgcagaagtataaactttcaatccgtgtgtataaactttggggacacttcgcaatcagcatgatgaagttttatttttatgtgaaaactcttgatgattctgaaattgtggtgtctgtaacttaaacatcatctacaaaatcactgctctatctttggatgtgagtttgttctagcatgttatcacagtaccgaattccaaagaaactgctgtttacttaccaagggtaggctttcaactcagatgagtttatgactttatttacatggaatagtcaaaatggacttctgacatttgctgcaaagtaggacaacttaattgatattgatggatctactcatttattcagcagataacaaagcccttccgattgcaggtgttgtggagagagcaggatattcatttgctagggttgccataacaaagtttgatttgatttttggttggggatggaaactgtgtaggaggcaagcgtggagcttgatgtgagctccttgaaataatgaaaaaccagttacaaaatctgtattacctgtagcagtacacattctcccaaagcattctgttggcattttaaagtcctttaaaacacacagctgctttctgttgcttcaaactaaataaggcattatcttcacttttccttttgttaacctaaagaaaaaccttcatttgtaaagcaaatcatcacagcaggaggattttctggtttatgcactagggtgcatttaatctttattttacactgctgattaactttatgattcaaattttaacttatagtttctttttaaattaattacattattgggtgctttcatgtttttgctaaaagccttcctattagaagcactacaattgacagtgatggactgacctttaatatttttttgttatgtgaccagtgtttggtttataaaaatttttctctaaaacaccaacttttggctgcaaataccaccttttcacttgggttcttttcatagtgtttatttacatgggatattgtcactttgcacgctgtagctatttgtctttgtcagcaaatgtaggtaaaatattaatcttgtatgaaattcagataagcagggaacagatggatttatggtgcttgaaacctctgaactctgcagctgtggcaagttgttgaactgtaaataaattctggacggtggctagcaggggctggcgtgacctcatttgccccacaatacctcaccgtgccagggatgcatttcctgccctgtgccacctgtggtttggtcctagtgctttggggccgcagagtggagctgggctccctttgaggaagtcatcagtgctgagagccctcctcacgggtgagagtccagtgggatgtgtctgagcagcctacgctgggcatgggccggggcacgctgtgtcccaagcatgctttaggggtcccagtggcaaaagcacatttgtggttgtttaatctctggaggtggaggatagccccagctcctgggtcagtcagctggcggaacagggtaggccaggggagacagcactccaccctgctgggcatcttattaaatgcagcccagtatattcaatgccggcatcactacttcatgggaaaggatgcagcgcttacagcaggtagtggggtagagtggctgtgtggggattttcaaaatggaggctaaagtgatgcactttggactcgctggaaagtgcctggacctctggtgagttcagcctgggaggtcagagcaccacaaaatttgcttgctgtggctgggtgcagtggctcacatctgtagtcctagcaggagctcagtagtccaagctcaggagtccgagaccagcctgggcaacatcctgtctccaccaaaacaaaaccaaaaacaaaaccaaactggcttggtgtggtagtgtgtgcctgtagtcccagctactcaggaggctgaggcaggaggattgcttgagcctaagagttcgaggctacaagtgagccatgatcataccactgcacttgagcctgggtgacagagtgagaccctgtctcaaatgaaaaaaaaaaaaaaaaaaaaaaaaagtacttgttgcctggccacaggaaggtctgtgtgttggtttgtttaccttcccgaacctttgctggggagactttttatgcccccatatgccccagattcactaacaagaaggaagtgttctgttctgtgtaggatgtgcagaaacagccttgaaaatgttaccaatcaccgaccttctgaaacgagcttctgtggatactgggaaagcactgggacaccattcccctcactcctgcctctgcttccccagggtggaactggcctgtgcttgatggtgccagctgtcataaagaagtcattgagcatccctgcatttgcactgtgtacccagcaccatggagggatagccactttagccaaagcagtttttcagctttactgagatgtaatttacataccttcagactccctccgagggtgtttttttgtgtattcgcagagttgtgcaatcatcactatctgagtttagaacatgttcagtaccccatgcccactgtattagtctgttttcacgctgctataaggaactacctgagactgggtaatttataaagaaaagaggttgaattgactcccagttctgcatggctggggaggcctcaggaaacttgcagtcatggcagaaggcgaagaggaggcaagacacatcttaccacagcaaggcaggagagagagtgagaggggaagcgccatacttctaaaccattagatctcgtgagaactcactcgccatcacaagaacagcatgggggaaacccgcccccatgacccaatcacctccaccaggtccctcccctgacgtgtggggattacagttcgacatgagatttgggtggggattcagagccaaaccatatcacccatcagcagtcacttcccattcttccctccctgtcccaaccggtgcaaccagcaatttactttctgcccctatgcatttccctattctgacatttcaggtaaatactcacaacatagggacttttgtgttctcatttcactgagcattgtgttttcagggttcactcatgttgtcccctgtgtcggtgcttcgttccttttcatagccagattatactatctgttcatcagttggcgggcgtttgggctgcctccactgtttggcgattgtgaatagtgttgttgtgaacatttaagcacacgtttttgtgtggatgtatgcaaagtcattttttttgaaagccacttactacacgattggctaacttccatcagagaaatgttgtttggtggagttaaaaacagattatctgtgtactatattaagttgggtgaggaatgatgaagtgtaaattatacttacataaatattataatgctgtgcagaaactcttaagctatcattcttttagaaaatgaattttatgagcttgggacctttttgttaaccaatctgagaaaagtctgttgtcagtgtggacatattttacctttaaatggaggaggggagagaatctttcaaaaacattaatatcagtgagattaatactaatctgtcaagatgacccagtgaacagttggctatcaaagtattataagaaggtttttaaaaggaaagtgtctattttgtaaagatcttgagtaaattatgcttttaagtatgttttgatattcccccccctcctcccaaagtgtagcatgcctgagcgctgtcatgtttaggaggtgatgggttggggttagagggtgattgactgttagcgaagtgggttgggatgaacaagtgcacttgagtacgcgctgcacagtgtaggcatcaggccacgtcagtgtgtctctgcatttgggcagatgccaggcctattgcaggcagcataacatctaggaacgggtttatggatgaacctgggtaactctgggagcacaaacccagaccacacccatcgggagagattgacctgagtgatgcgctaacgcatatcattgagatggggccagatatcttgcttagatgaataattggagttcatgtcaaccatctgtcctttcccataatttaaagccaacttctatattttccaggttcatactttttttttcattaattgcatgtaaagttgcggtgaacaccttctttcttgacttcctgtttaaaaaaattacagttcttaaaattataagcttattcaggatggagtggtcagtttgtagaaaaactagctctttagatcttttaaaagcactacattaaaaaaaaaaaaaaaaaaaaacatcggacgtggtgggtcacacctgtaatcccagcactttgggagtccaaggtgggaggatcgcttgagcccaggagtttgagaccagcctgggcaacatggtgaggccccatttctacataaaattttaaaaattagccgggagtggtggagtgcacctgtagtcttagctacttgggaggctgaggtgggagggttgcttgagcctgggagttcaaggttgcagtaagccgtaattgcaccattgcactccatcctggatgacagagcgagactctgcctcaaaaaacaaacaaacaaaaacaaacccagagaaactcaaaaaccaaaaaagaggtatccttattttcccaggcctcaatgatgaaatgtgcccagtgttcatttgaatctgcccatcaattagtcttttcctgatgtctcagagaagcatgcatgatgtacggaatgtcttgggtgacctagagcggcatccccaataggactgccctgtgaacatggccccacattcggctcttgggcacttaaaagatgtggccattgtgactgagaaactgaattgtgaatgttatttaattttcacgtgtttaagatgtggccagagcagacagatgaacagtctggcttgatggataactgcagggagtttcacgatgctggtaggaggcacagtgagcttctggaagagccggccccacctaggcctgattttggtggctgctcaaaaccgctggtactgaattcctttagaatagtgcttctcaaagcgggtgactttgtatcctccccaccctccaggggccatctcacaatgtctggagacatttttggtggtgacagtgggtgcttctggcatctggtgagtagaggccagggacactgctcaacatcccacagtgcacaggacggcctcataacaaggaatcatctagccccatatgcgccacgatggaggagccctgctttctattccgaagaccagcagtcctaagatacgatgtggacagcacagacccagttttctaagtgaagagataaggcttgagcaggcagcagcctggtaatgccaaggccaggacagttagccaagtgtctgagtccatggagcttctcgggcagtgttctcttttctcttcagctattccagtttgtattaagtgtaagaatatgaagttgatgtttgtcgtgagtcaagacggtgacacagaagcagtctttcgtgctttggtctaatagctttattgttaaaggagagaaacagaaaactcctctttgcctctgcagttttctctgaaattgaatttagggaaagctgaccctagaccatgcgtgccctttccaccagcatcgctgtgggttccactcgtgggagatcgataaggaagtggggatgaccacgctgcacagaagtgttctcatcacttttgcgcttgcttatttaacccatgattgttagaaagcgtttagaaagttggtctttgcaaaccagccctgttaagtgctgagatgaaattcttaactttttttttccttcttagagataaggcctcactctgtctcccacgctggagtgcagtggcgcaatcaaagctgactgcagcctccacctcctggactcaagcagtccccccacctcagcctcccaaattcttaaaaatgctaacagtaaccctcacacacaaaaagtgctgccgttagagatggcactggtattgagaagcacgtgctgtcagtgttgcaattggtaatgcacaccacacttgggcatagaaattggaaatccaactgcgccaagctggagcctgcagaaaggagcacgaggagacgggacagcaatagagctctgtcgacggcgctaagtagaaccagacgctgcaataagacaagcgtccccctgtgctcagtacaaatgggttgcctgtggcagatgcaggggtggctttggcagagagacggctcctggcatcgtggaattgaattggctgtttcttttaaagatactgcaaattgcggcagcatttatcatcctaaggaagcccgcacagcttgccaaacagataatattgatgatgataacaacaatgataaaaggaaaccatgatgcctctactcaatgaaaatcacttttatcttatttgcaaaagtcagaggtaggacagatgtgtcagcgtcttaataagacagttattcaaggagttaaattgaaattattcacatacccaaaataagctatttggcaaacctggagacccaggggcctttggatctatcttagtgtaaaatttcttgaagcagagacctagtaggtactctgttgcttatggttccaggcaatgtattgttttttcttccccctaaatatctgtgaatgtgtgaagtaccctgtgtgccagagatggaaagtaaaaccacagaagcggggtgcggggagatggcagctaaattccttttcagcagagttgaagcatcttgttgtaagagtctagctccacaacagtgggatgcaggaaactgtaacagctgaaatacccaacagatgtattcaccatcagtgcattgggaaaccctctcaaaagtgtcatcacaaatgatgatcttaacttttgtatgacaggatctttaggtcacccaacagtaggtgcacagtttctatgatttcaatttttaccacttctggagacttgtcttcccatttcttgtatcagtgccttactgatagagttggaaattggaaccaaagtaattagattggctctccagatctcttacatgagccaagaaaggattcaaaagcatgccctgtttccttcttgacaggctgggagaggaagtgaccgggaagtgaattgctaagatgtggtcgtcattttcctttacaccacagagcctctgcgtttgggaactgcaggttcatccgagtcaatgtcagaagtgccttgtgtctactgtagtgaacatcctttgtttccatcgggtcctgtgggaagcagcactgcttattgggtggtttgagggtgaatgctattttacaacttgtgacccccttgacacactaccttttcattttagcatggagcacagagccatttctcccctgtgctggattttgaatgttctttcaaccaccgtgatagaatgtccaagaaaggaacaaaggaagaggcaactaagggaatctttcagtgggttcataagccatgctgctcctggctttgacaggagttaaaatcatgggtatccctaaaccactatcattattggagttgctgttactgtcgacgtaaagagtcaaactctgtaaaatatttgaagagatttattctgagccaactctgagtggccatggcctgtgacacagccctcaggagatcctgagtacatgtgcccaaggtggtgggggcacaacttggttttatacattttagggagaacacagcttggttttatatgtgaacccccaaaatctgagacgggtctcaatcaatttaggaagtttattttgccaaagttaaggatgcgcacccatgacacaacctcaggaggtcctgacgatgtgcccaaggtggtccaagcacagcttggttttatacattttagggagacatgaaacatcaatcagtatatgtaggatgaacattggtttggtctggaaaggcgggacaactcaaagtggggagggggctcccaggtcataggtagacaagggacaaatagttgtattcttacgagtttctgattagcgtctccaaaggaggccatcagatatgcatctatatcagtgagcagaggcctgtcgttgaatagaaggggaggcaggtttgctctgagcagttcccagctggattttccctttaacttagtgatttgggagccccaagatttattttcctttcacatacacatttgagggagacatgaggcattgatcagacacatttaaggtagacattggttcagtccagaaaggtgggacaacttgaagcaagggtgcagggggaagggggggtgctttcaggttataggtagatttaaaatttttttgataggccattggttgaaagagtcattaccaatagaaaggaatgtctgggctaccttaagaggttgtggtgaccagtgttttatcctgcagatgtagcctccaggtagcaggcttcagagggaacagattgtaaatgtttcttatcagacttgaggtctgtgatgatgttcgtgctggaggggcttaatgaggcatgcttgacccccacttcccggcagtcatggcctggtccgtctttcaggataaatttagttggccttggcccagaggaggaagtccattcaggtgcttggggggctttcgaatgttattgttggtttacattatgattgtcattgttattaaaaaactaagggctgtagagaaatggttgcagcatccatcatgtgtccctaggaattgcacatagctaagtgagaacctcacagaaccctttcacgtgcagcccgatgctgtcactgttcataaacaattgtattttgccttcctgaaaggccatctgagttcattaaacttgcatgcttccatatctatacattcttttctcatggcctctttgtggatggtttgttttaccatttgttgtccatcagcttgaatggtagggggaagagttcacaccgtgccccctgtgtagcagaatagcccacagttcaggcatggctctccagcaaggagctttctagggctctgatgctcaccagtggggggattgggcacccctccgcaactgccaggggacattgacaatgtctggagacattttgggttgtctcagtagctgtgtgggggatgctgttggctagtgggtggagccctgggatgctgctaacatcccaccatgcacagtacagccccaacagccaagagtgatggctcacaaatgccaacataagaaacccattctagggtacctttcatttgcttagtgctgcgagaaggtttatctgccaaagatcatcatcttggagagggccaagatcctgtatcctgtactggacagatatgcaggcattcaaattctgaaacgccgttggaaacatgaggctcggatcacagaagcctcctgtacatagagcaaatgagagctggaggcctgctgcccagcccagctgagtcctgtttcttatttcggttttcctttagattccaccgaagtttctctgaagaatgctgactcaggctgccccttttattccatttctttgcagggcagtttaggtgaagctggaacacagtgttccctgaggaagcattaggacaattagaccctgcctttgctaaatgaatgtatcaagaaccttcaacgtctttacaagaagcaggataaccattttgcagagtactgtgcttagtagcagagcatggcttctgttacacagtttcagtattgcaaaggtccccagccagtacagtcccacccttaattactgcttcagagctgcaagttaacgtttaaagtgttttcacagtagcttgaagtgtgatctcccatattacggtcatatccttggacttagcccatgttacataaattagatctttataagcagcacacttctttgcaagcaatttgcttccctttgggaatctgattccatagaaaacagtagtattttaaacatgttgattctagtacttacagttctattcacgtgctcctggtatagtacatctaataagaaagaatcccttatttttacttttatccaaatgcatgtatgttctttcagcatgagatataatttgtctgatcaagtatatagggagatgagattaagaattaagatttgtttcaagatatgagattaagaattaagatttatttcaagaaactcaattgcatggttgctcgcataagccactatgcagtggcagctttaatgaatggggttccaatgttttccttactgttttcaagaaggtagtgaataaaattagatgttaaagcgaattgcattgtgtgaagattgggacagatgccacatatatagttcagatgcttgcctgccagtccctgagatatactcttagcttgttaatatggaaattgtcaaacatattcagaagtatacagaatatcttggtatattcctgtgtattcttcactcatctccagccactgttagcgtgtcacgagcttgtctcatcgtcccctcactgttttctctttagagtaatttaaagcagatctcagacatcatgtgatttttacctataaacatttcaagttgtatccctaatatagaaggatttttttatgatactattattctgtaattgtttcctgtttgccttaacgaaaagaccacagactaggtggcttaaaatagcagagatgtattgtgtcattgttgaggaggtcagcagggtggtcaggcggcagcagggtggcttccttttggaggctccaagggagagccccttctgtgtctgtcctccaggttctggtgcctgcaggtgccccttggcctgtggctgcataacgccaatctctgtctgttaggaggacactgtgtttagagcccatgcaataacccagaatacctcatctcaggattcttaatttaattacatctgcagtgacccttttttcccaaatgaggtcacattcagtcttttactatataaggtcatattcacagagtccagggatcaggttgtgtacttaatcctgtttctttcgtgctcatgggaatgtatgagttaggggaatacagattatctttgtgttgtagggttttcttaagattatgatttattgaaaaagaaggtcaatggcatataaaggaaaatgtcattgataaatataaaaagaaatgcaagttttttaggccaagcagaatgcttataggagccagtgtcttggattaaaattatatgtgaacctcaagtgttatcatctataaagtgaaggtagccgtgaattacctcttagattgttgtgaagataaaaatgaatacagcattaacacagtatataaatgctaagcatttagtaattatagttcgcctctttttttctggaggctcaaagttgattgtaaatgtcaaaccaagaaataatactaggtactagcaacacataatgcaaaggaatgattcctgtgatacatgaagaactcctataaagtactaaggaggatgaccagcagcaggccatgagaaaaatgaaaaaagacatgaacagttttcttaaagggaaataatgaatagctctaaaatgtatggaatgaagctcaatctccctcatgacatggggaatgcagatgaaaagtgtaaggtaccatttcacctttcccattagtagaggtcagaggtgtgactgtgttccgctggcaggagctcaaataaaagcgggtgttgttgctggcaggcattgcaagaggtccagcctctttggggagcagattggcaaaagatatctgacctagaattgtcacttcttgggatttagctcatggacatagtgtaaatatatgcaaagaagtactcacatgatattcaccaaaggcattgtaaaagcagaaggatgaaagcaaccacccacagtgaacgtgttagattataataaaggcatagaatctatcaaacaataggaaaaaaagcataattctgtatatggaatgaactccacatgacgctcttgcatgtaaaaagcaagacagatacctgattgtgagtagagtttaatacaagttctatgtcaaagtgggaggagctatatgggctggtctaggtagaatatttctggaaggaaataccaaaaattggacttccctgttggggagaggtggattttagagatggggtagtagcagcttctcaaaaaccaagagaaagcttcgcatttacaatgggattattggaagcaataggaaacacccatttttgtaaaatctgtgagaatgtgtatacttggtaaaagtatagatattcagccattaaaaggaatgaagtattcatatatgctacattgtgagaattgaggatatgctacattgaaagaaaccagccacaaaagactgtataaggttccatttgtggaaaatactcagaaaaccttgggggaggaggggacaggaagtgtctgtttagtgggtattagatctcctttggaggagaggaaaatgttttggaattagatacagaggtggcggtgattgtataacattgtgaatgcccccaaatgccactaaattgtacacttgaaaatggttaattttatgtcgtgaatgttacttcaatttttaaaaaaatccaactgcaaggagagaagattctctagggaatggcttgtcaaagcatccatgtcaaagggaccatttaaaaatttccagtctgaggtgggtgcctttgtgaaaagcaattaaaatgtataactagaagagcaatcatgtctcagacaccaacgcaagcacaacttgccctaagttttctaagcacttcttacctcattcattcatcaccagagacagacagttcccaggccagaatccgcacctggatgcaacttttaatacatggatctagagttgtgttcttccagctctagaagagctccatgccacccccctcccctcccccccccgccacagcttgtcagaaatgcagatcacaggccgtctctaggtctgctgaatgagaatttgcattttagtaagctgcctaggcagctcagaagcacattaaagtttgagagggtaatttggggacagtaaagtgcagtcggaggaggatggttttgtggccctttggactggtcacttaatgactgtgaccctgggcaagggactgggttcgttccctaggctcctgtaacagagtgccacagactggtggcttaccgtatagaaacaaatgctctgcagctccagaggccacaggtctgaaactgtggtgttgtggggttggcacctgttccaggcctctcttcttggcttgtagaaggctgtcttcatgttcacatgaccttctgcctatgtgcagttctgtatccaaattccccaccttaatgacatcatcttcactaattacatgtacggcgaccttatgtccaagtcaggtcacattctgaggtactgggcgctaggactttaacatgtgaattttaggggaacacagttgaacccgtagcagtacttaacctttctaatcctcaatttcgtcatcttaaaaatgagtaaactacacattaatgtgggtaccatcaaaaaaacaaaaaaaccaacccaaaaaatagtaagtgttggcagggatgtggagaaattggaactcttatgcactattggaaggatcataaacaggtaaacactatagactatagttcagcagtttcttaaaactagaattatcagatgatccagcaaatccacttttgggtatacatccaaaagaattgaaatcagaatctcaaagagacacttacacactcaggtttagagcagcgttatttatattaaccaagaggtggaaacagcccacatgtccctcagcagatgactggataaacaaaatgtggcctgtccacacaatggaatagtattcggccttgaaaaggaaggaaatcctatcacatgccgcaattttgtatgaaacttgtggacattatgttaagtgaaataagccagtcacagaagagaaatactgtataatcccactttcatgaggtatctaaagtacacaaattcgtagagacagaaagtagaatggcagttgccaggggctgggggaggtgaaatggggaattgttgaatgggcatagagttggagttttgcaagataaagagagttctggagattggttgcacagcattgtgaatttaacactgttgaactgtgtacttaaaaatggttaagaggctggatgttttgggtcacacctgtagttccagggctatgggaggctcaggtgggaggatggcttgaggccaggaattcaagaccagcctgggcaacatagtgagaccccatcttttacaaaaaattaaaattagccaggcatggtactgcatgcctttagtcccagctacttgagaggctaaggcaggaggatcgtttgagcccaggaggtcaaggctgcagtgagctatgatcacacagttgcactccagcctgggtgacagagcaagattctatctcaaaaaaataaataaataaaagatggagaggagcgttacttttttgtgtgcaggaacgattgctgactgcagagcctggctggctaaaattagatttgccttgtcagtataataattgtaggtatttttggagggaaggatgcctggagcccggctgggttatttccgcccttggagtgagccagggcagcttagagggctacccgcgtgcagccctggaaggtaccgaaggagccctggaggcaccgagcgctggaggcctcatccctgagcaggttgccctccttctggtcggatggcagggcggaaacccatctgtgtcgggagtgagagctgtctgctgtccgcggcttgcgcttggagcttttcctgcagtccagggagagcagaggaggccagtgacttccatgaaaacacccccagtggtggggagggaggcggcatcccttggaggtagggatggggcccctgctgtgacccattagaggcaaagaagggcttggaagtttcattttgtcttacatgagtgtgtgtgccgagttcacattatttgcacatctgtgtttgtttttatataatgataaggacatcagtttccattgataaactataaggaagatgtgccatgtttaccagggccagagtgaagagactgaggtgcttgctttgggagaaaaatttgagggggtgacaaacaccacagacatcaagataaattatctgtgtgtattttaatagctttattgagatgctgtgcacagccatacaattcacgcatttgcagtgcacagttcagaggtttttactatatccacagaggcgtgcacccgtcaccacagcccagtttagaacattttcatcacctggggaagaaacacccacccagtggcagtcacttcccaccccacccccacccctgccaccgtgcattctgctttctgtagatgaatgcgtttgtctactctaggaacctcatacaagcagagtcatacagtgtctgtccttctgtgtctgacttctttcactctgcgtgtgttcctggttcattcatgtggtagcacgtgccagacattcctttctgttacacagtactgtatgtattatatatgtacacagccggctgttcatatccacgagttctgcttctatgaattcaaccaaccgtggattgaaagtatttgggaaaaataataatgcaacaataaaaaaatacaagtttaaaaacaaatagagcataacagatatttacatgacattgacattgtattgggtatgatacataatccagaggtgatttaaagtgtaagggaggatgagcggttatatgcagatgctactcccttttatctaagggactggaggatactcggattttggtatctgcaggggtcctggacccatcccctgtggatgctcaggggcggctgcaccacatttgatctatgtgttcatctgtcagtagatgtttgggttgtttccattcattttttggctaagtgaataatattttaatgtgatatttaaaaaattaaaatgaatgcaagaaattccatgaggaacaaaatattaattttaagtaaagaccacaggatcagtatttctgaagtttccttttgcctcaggatccagtatggctccatacattactgatcctgtctctctctctaacattttgatattttgtcatgtactttttgcattcattttgattttttttttttctttttgagacagagtctctgttgcccaggctggagtgcagtgatgcgatctcggctcactgcaaccaccgctttccaggttcaagcattctcctgcctcagtctcctgagtagctgggattacaggcacacaccaccacgcccggctaatttttgtatttttagtagagactgggttttaccatgttggccaggctggtcccaaactcctgacttcaggtgatccacctgcctcgacctcccaaagtgctgggattacaggtgtgagccactgcgcccgtcctcattttgatttttaaagataatgtattacactattgtttcttttgatggttgaattttctggcatccccttcaattttgcaccagaggtaagtgatcctaatccctgccctgacattttacactgtgctgtgaataccccagggcatcatgaggaataaaatttgaaagtgtatttcagtgagctaacttggctggacagaatacccatgggttatccttaccagtggtgccatatttatgcctttcagcagtgttgtgattaaactcaggtccagtaaaattatcattatactatattagttttgtagaacttctgtaacaaatttccacaaactgaatggcttggcttaaaacaccagaagtatatcctctcacggttctggagtccagaagtccaaagtcaagatgggggcagggttgtttgcgtctggagcctctacaggaggatccttcctgcctcctccagctcttggtggcgccaggctccagttcccttgtagatgctacaagggaactcttgtttatagtcgggatagaaattacacaaaacccggtcttgattggggataccttttggagtactggcaagttgccgcatggactgagccttccgatcggagtttgctgtcttgctggtgatctgcctggatgccggtgcacacactaatccctgaacacactaagcattgcgcttgctgttgtttaacttttcatccatgattgaattcaggagttctttttttaaaatggccatttttaaagatttctaattgggagtttttcttctgaaaagaatacccgtaaagcaaactatttaaattatacactgagagacgtatgttcattcttgtatccataacagttaagaatcattacctattactagcataggcacaaagcgtctcctctaagacatttgttaattacaaaagggacaaaagtagtgacatgtggggaagaaacccagcagataccacctaggtggtcaaggtcatcatcatcatcacgatgagggcatgttgacaccctgtgataatctgagaaggactcagcatcactcctgtggtgttcctgccaaaaatgcgtaagagtctaatcacgagaaaaattagacaaacccaaactgagaggcattctgcaaaacacctctcctgctcctccaaagcattaagagtgacaagggaagaacggggaaccatcacaggtcaaaggggatgtgctgactataggaatgtgggctcctgggagagagaaagggcggaaggagaaaccggtgaaattgggtaagtctgtagttcacttacttgtgctgtgccgggtcttaactttcttatattttgctaattgctatgtttgtgtaagatgtcaacataagtggaagctgggtggcagttatatgcaactctgtgctatttctgcagcttattgtaagtctaaaaattatttcaagattaaaagtttttttttttaaaaaagtcagatgaaaacacgaataagtaaaaaaaacataaaaagagagaaaaaaggagccatttatatgattaactttttggttggtgtcgccataagttttttcagttcggattcttagtaaaggatgtggatcaaaacaaatcttcatactaaaacatcagcagagaccttatttcatttgaacaaaatatcatgaagtcaggattcgttttgcatttgaatcttgaacatttaagttttttaggaaatttgtggtgctcctgtccttgaaaggaagcccacatatgttcaaaatgcagtatcttttaaatgcatttgaattttttaaagttttggtgtttgttgtttttggttgtttattgctttgatttttcatgagcagtgctgttcaggggtactattattgtcagttttaaatcactgctgcagcatacttcatttgatcttgagacttgccatgagtcttactgtgggggtggggaggatggggaaagaaaccattgagtatgagttggcatgtcccacagaacagcgggcggacacttcagggggctgtgcctttctcagagactcgagggctatgcccaaatcgttatgcagtgtgtatgtgtgggggggatagttggggggacgggtatggggaaaggagtaatctaccagggacgacccaggacagatcccagagccaggaatgagggttggatcttgggcaaggccatctctgccatgactgcttgtgggaactcctgcttactccccgtgaccctgagcaaaacttccaagtttgaagcctcaattttatgctctgtcaaagaaactagtttttcaccctccaccagaggatgaagtatcattctccacgtgaagcactcagcacagtgcctgtcccctctgcagacatgatgccaatctgtgatgatgttctcttctgtcagcattttacaaagcagatgagagcgttcacttgcacagcctcctgttgacctttcttctctcagacgccttgctgtagatcccaatcgactgcttttccttggccagccgattcatgcagtctcttgcttacttaatactgttgatatatttaaattattgtttaataaatacttgttattctggagtatatttgttcatccaaggatggtttactactgcttgctttgtgcaggttataacaggtaagggggtggaggtgtgtgcagagcatcagctggtcatcagccatcttgcgggagtgcccagaggggggaagagcaaagcctaccccttctacggagtgtgagggaggcaggcttgggtggaggcaggactgcaccagccttccagagctcagagaggtgacacctgagccaagtgacacacacatgataaagaggaggtttctggagtccagaggaggaaggcatccttggctaagaggacagcatgaactcatagggtacctccaggaatttttcccctgggcagtaggggcagagaaaggtacccaggggggcaggggataaggactggcatggagcatgggctcgatatcagcctgctgattttaatgaaagccgtttggtcacctgaagaacagctttgattttacttctgtaatctaaactcttttgagttggaatataaaactcagtgttccatgtgacaaaggggtttttaaattggtcattcccttaaacatctttacattttcgtatctgttgatgtcatttttttccccattgctgactcctgttcctgtcttctatttctgctcttgacttaataattcttggcttcttgacgtttatcattgccgactgctctgaatcctcatcttcccttcatttatttccatttgtccgctctgtttactgcctgagatgttgaccttttttccaagcatgcactaagcggcattttaaagaagcagcatcatgtcatagctcctggtagtggggctgggcctattcatcttggggcttctttatctaccttggttgtaggtagttaagaaaatcttaacccttgggtcattatttctatagtgggtcaaagagatgaccacgttactaaaactttcatgtctagttgcatattctgttttttttattgtggtaagatatacattacgtaatacatttgtaagtgtacaattcagtggtatgaaaacattcacaatgttgtgtagccatcaccctcttacacctaaacatttttccattatccttctccaaaactctctgctcattatacaataactggcccttccacactcccctccccacactcagtccctggtgacttctcttttttctctttatttgcctattctaggtaccccatagaagaggaatcatataacatttatccttctgcgtctggcttatttccctaagcataatgttttcaaagtccatccgtgttatagcatatatcaaaatgtcatcgtatttttgtggccgaatactaatccgttgtagggtcactcacacgcacacacgtagagtagctgtgagtacagtgcccagattggtacagaaaggccacagtgcccatgggtctgtccattttacatgctgtaccgtgtgcttcatgggaaatatatttcttctgtgagttttcttgtacattgcttgtttccagacttctaaaggggtggttgtggggatgtggtgctgtgtctcaggtatactctgcttatgaaatagcgggtgtgatggaagggtggagaaagggagttgagtaataatgttcacctggggtcgggcgcggtggctcaggcctgtaatcccagcactttgggaggccgaggcaggcggatcacctgaggtcaggagttcaagaccagcctggccaatgtgttgaaactccgtctctactaaaaatacaaaaattagccaggtgtgacggtgggcgcctataatcccagccactcaggaggctgaggcaggagaatcgcttgaacccgggaggcagaggttgcagtgagctgatatcgcaccactgcactccagcctgtgcaacaagagcgagactccatcttaaaaataataataataataataataaggttcacctgattgaaatagcctctgtattgaagaacaccagcaggtgaagttcgcttagcagatctgagcttcctgttaccctaaacactgccaaccttgacctacctctgaaagccagtgggatgaggtctagggccaggtgggaaccttgggaaaggcatgccctactgtttgaccaaggggatgaggaggctgggtactccagtgatggagaccctttccccaccttttctctcacctctcctccacccagtgccctttcacctttcctttccaaccccacacccatccttccgccccacttccccatttatttctctctgctctttcatttccgtggccagccgcctcccaagccctgccctcaagcttcccctcccttttctttcatgcccatagcctacctggatctcctctccctcgtcgggcccacctccctccacccttgggatcctggtcaccccctccactgcaagggggagaagggctgcactgtgtggagggttctccctaccttggctgtgttctggggatttcccaccagcccttgcgctgcactggtgatgcccgatgtagctgaaactctgccccgctcggggttactggcctgggatcagcataggagatgggtttaaaacaggatgcagggaggctgctggcagacagttatttgaggaaatgcatttcttaggatatagctttcaagaaggtgctgttattgtgcgtcacacatagagtggctgtaatgcgccagggcaaatgaaaattatgtttataaaatagggcaccttgtcaagattaacttgtgtgaaattcccaagaatatacctcaaacagttttttatgtcagtgcatgatattgtagtaactctcccagttctagatatctttattttaaaaggaatgcttgtgtgcagacacatttttaggtggaggttagtatgttttagttctcaggatttctaggagaataaatagccataacttgataggattggtatgaatagtacttggtcttgggaagttttctccatgaaaatgtttcatgttgacgttttgctccctcccgtcttggttttacactcattcttcacagaactgtcatttataggaacttatcccctggccatctctataggtgtctttcttgcccagataaggtgagaatcattttggaaaccaacttcttgagaatccacaagaaatgggttttagccacaagggatcattgcattgcattctataagatgagagcttctacaagaaaaaattctggagccagatattttagggaagacagggggctgataagtgaattgttattttaaatggttttcatttcccctcatcctgatttagaagaggagagaaaactctccttagaatcagtgggtagtcctgacttgaatgggtttattttctttttctctcttgaattgtcggtgtatacccgtgtctttcttggtttatccttcatccccattcctccggatacccctatttgcatttaatctgtttggtcacataacctctcaagtagcgatcttggaggtttcaaaacttaacatttcattttccccgctgggtcaactaccagtctggaagcaccagggtttccaaggttaggttacagtgaaggcacaggggacatcttcctgtctcctctgcagagccagcgccactgtgcagtggggtgtggaccccggctcctccccaggctcccaggcctgcagctggcacaggggtccccagaacctgtgagggggtccttccctctgcctccctgagggacttggtgattcttagccctctctaacagagggagaagacgctgtcaaaaatgtggtttgcccaaacccacatagagctgggaaaggggccagggactcaaatagcagagatttcctggccatccatcagtcaggttacatcagtatactccatgtggattccactgggtgccggcctggtggctgaccctgcctttagagggaactcattattgtgtatttgaagtgtaaatacctcttttcccagatgttaatcttgtttcagatattcgatggagagggttcacataataaataattccctcctgagtcggcttgcgtggctcctgagagcagctggtcagggcccttcttgtcggtgtctcactggcttttagcaaaatggagacgaagatgaaagggaaaccttaactatagcttgaatccttagggtggactaagcactcaaagccttccatgcaaagcagtgtggcttataaattggaggcatttttcttattattaggacaaaccagcacccgaattggtttgtcaccagtaaaagaatttaaaacagtgcccgatttgcacagctgagattttggcaacagtatcttacacatctgaatgggtggagtaagatggagcatcattctgtgatatgtttaaaataatataccatgaaatgatgcagtaagtgttggagatatcttccagaagtcttaggtcatttgttttcatgtttaaattgtttccgcaaaggcattctcttcaacataaggagagctaaaaatcaaatacacagaaattttgtaagtgtgttgtttttttcttttcctgtttagactttataacattacactatttacctgggctaaacaaaataaattattttgtacataaaaccacaaggagatggtttagcctacttatgggaccaaactgttgtattagccagtgtgggagaatattgcagagatgtgtggcttcatcaatgaagattagatgtaaagtctttttaaaatatatgagaatgttgaactaaagatggttcagatgggactttgctcgagttgcttgagtctagaaggcaaaataaatgtttgtaattgttacataggccagccttccaaaatcccagctatccatagaaaacaaggggtcagcaaaattggccatctgcctagactggtaggttgtatgggtctgaactagaggcagtctttccccaggggacatttggcaatatctagagacatttttggtgtcaccttgggggaggggtagtactggcatctggtgggtggagaccagggatgccgctcaacatcctacaatgcagcggtcaccgatagcccaccctgccccaccacagccaagaatgatgcacccagtagaagcaccatccctcttccactggtgacatccgaacatgtctacagacactgcctaatgcctcttggggggcataatcacccctagttgaaaaccactgccctaaactgagactctgaaatcaaccacttaatctcctttcctctgagctcaggggagggacgtgactcctgcgagctgccttggctttttgtaggggcacagatagaagccatcccccaacacggtgccctgggttctgtggtggtctctgagaacccatgaataaggatcccagggaagcctttctaggtcgtgctgctttaatattattctagatgccgatttaaagtcataaaggaagaagagctaggactgtgctggaggaccctaaagcccatggcccatggtttcctataatgctaaccatgcccggagtatctagttataaataattgtgctgaggtcatgaatatttgactttggttctcaaatattcctaagaaaaaagtcatgaaagcccctgatggtaaaaggaggagagctgagacctaagtggataggagactcaggaaaaagcaagttagaaataaagttcaacaaccacaggagaggagaaaatgggtccaaaagacttgggctttaggcacatcttacctaaggacaaaaaagtagagaaaagatcaaatgttgagaaaagattgagccatgcggagaacgggcagggtgttgaagtacctgctgctctccttaaacccagcatgctgttcactgctttattttagagagtgggtgtagtggtctgtttcagaagactcaagtctacactgcctctgccactgaggttccttttgactctgcagaagtctttacctttcatctcctttctgaaatgctgtgagcatttttcctcccagagacattaattgggaacagcagtgaatgcctagttccttgcagtcctttggcccacacgcatttccagctgcccactggccagactggattctaaatgccaaaagctacaggcgctgacagagtgcttttgaaaagaaagaaatgcatgaaatgccccgaatttatgggaaatatttatacccagcagtccttgagccatgcgtgtcctttaggaacggtgctaccagacagccgtcggcatggccttgctcctggtggtgcaggctctgatgttccactgatgtgagcccaagagaggaatgaccagtcagcctgtaaccccagctccagtgttgttaatgagtgtcaccgatcaggtttcagacgttagtcagtgtcccggctccagtgttgttaatgatggccacggattgggcttcatgcgttagtcagtgtctctgttaggagctgaattgtgtccctgcaaaagggatgtatttaagttccaaccccttgcatctcagaatgtgagcttatttggaggtgggatcttaaccgagtgtgactggcttccttagaaaaagaggaaatttggacacactcgtacagggaaaaggccatgtgaacagccacctccaagccaaggagacaggctcagaacagattctccctcacagccctcagaagaaaccaaccctactgacgccttgatgtctctgaattctgcactccagaaccgtgagagagtcagtttctgtgaagccaatcagcttgtggtactttgttatgttgggcctatgaaattcatctactgttactagcctttcccaaatatttcagtccatgaaatgcacccagcatggcaactcttcaacttacagaaatggaaaagagaaagaatactgtgcttcagctagttttctcattacccagaaatgaaaaggcctgacctctgaaaccttgaggaatctctttttaagatgccagagcctgtacttctgcctgatccaagcagagtttgctcgctaccccgggcatcacttctcactgcccaggtggcactggatgatgtccaagactggccagatctggatggattccataaatagctcgtgctgtttctggtcagtgaagaaagaggaaggcaaagccacgtgcataagtttgttgtggatgccataacaaagcgctgctggagtggctaaaacgacagacgtttattgtatcccagttctggaggccagaagtccaaaatcaagatgtcagcagggctcttcctcctgagggcttgaggcaggatctgtcctgtgcccatcttccagcttctggtggctgctggcagtctttggtgtcccttggcttgtagctacatcacccagatctctgccttcatttgcacatggccttttccctgtgtccaaatttccatccccctaccttttttttttgttttgttttgttttgttttgttttgttttttgtttttttttttagacggagtctccctctgtcgcccaggctggagtgcagtggcgcgatcccggctcactgcaacccccgcctcctgggttcaagcgattcttctgcctcagcctcccgagtagctgggattacaagcatgagccgccacacccggctaatttttgtatttttagtagagacggggtttcaccgtgttggccaggctggtctcgaactcctgacctcaggtgatccgcccacctcagactcccaaagtgttaggattacaagcatgagccactgcaactggccaaatttcccctttttataaggactccagtcacattggcttagagctctctcctaatgagtttacatctgcaaagaccctatttcccaataagaagttactcccaggtactaggtgttagggcttcaacatacgccttgggatgggcagtcttgaatccataacaccgtcaattaaaaggttctgctttcattgccgccaggttgggaaaagttgccagggtgggcttggtggaggagggtctctcagcagggcagggtcattgcagggaaaaggagagagaaacagagacacacaaaagcagatagattgccttggcagaggtggccagactagagtctttgagttttgtagagagatcaattgattacttctagaaatgtcctcttcaaagtctctagttttctctcccatttccttatacaaggctctggccatattactacttctggcacagttgattcagtgacttttgcatataggtttccccaaagctaaagctaaaaacgaacaaacaaaaaaagattattcatgaatatgccacaaactttgcccatagataagactttgtgattacaagcaaaatctgattggaaaataaaatacattatatgttagaataccaggaaacttctttttggggagcgtctttatgaaatgaagccatgctaacctccctgggactgctgatcagaatgtgctccaccccaaagcctcggagagggcaggacagccagtgactctctcctgtcagtagacacactaaacctgaatccaggatgggaaatcaatgtttgacacagctgtatctctttcagttggatcagtaacactcgctcactcactaggacttccatttgcttttagctgcctgcaatgaaaacctggcaagacgtcttagtctgatccggctgctgtaacaaaataccgtagactgagtggcttataaaaaatagaaatgtattgctcatagctctggagactgggaagtccaggatcaaggcactggcagttttggtgtctggtgagggctgctttctcacagacagcatctttttgctgtgttctcacatggtggaaggggtgagagcgctctctggggtccctttgataaggcactaatcccattcatgaggccccaccctcatgaccgcattacctcccagaggctttacctcccaacaccatcatattgtaggttaggtttcaacataggaatttggtgggcgggggggggggtacacaaatgtccggaccatagaataggacattacagcttgaaaaagcactagagagaatgacgttgttcctttgtaacacagaaaagcattcacctctcaatttagatgagccattttgaccccagttggttctgaaaatccttgttgacaaacaaaattggagaggaccatagcctgcctgcttttcccgaggcccggggaaagctttttcatatgatgttattataatgttaggtgtaacaataaatgaaagttttgtatggtctgattgggtaggacaggcctgaacacaggcaaacccatctgcacagcatgctcaattcagtcagtgtacaaaccctgtgtcatgggagcagagagaagggtctgcttccattccggaggatgacagaggcttaaggacggtgctggcgtttcagctgagcctttaagaagtggaattttatccagaggtgatcttcttggaatagagagaacaaacaggtcagggcatgcagacttgattacaggtgctctggggaccactggaatttttgttgaacagaggatgatgaaataaatcagtgttctagtgtgttacctttgggcagtggcgagatccgagtctccatagtgaacaaatcagtgcacagaccagggcagaagtgcaggggaacatggaacattcagggcctggagggtggtacccaggccaacactgccccctttttccagctcccatctctgtccacatagttgggccagtgtagacatctgggtcatatagggaggcattccagtggccccatgtggtttccatggagatcttcaggaaggggttttggggtgagagttggtatctcgtggcaaggacacactccctgggctaggtacatatgggtggttttcttgtcctacagattgcaaagatacaggggtagctgttctgctctgggcagcttctgtagagacaggatgtgtatttgcttgcctgctcctggaagccagtcactgaggcagacctctttactcgtccagaagcatgacttggggatgattatagttcaaggacataaggcctagtggtgtctttcatcagcgccccccattttacatttctgggatccccctttctcttttactctgatctggcctcccttcccacccctctggccactcaggtgaggagatgccagatcccaggtgggcaggaaggaatcccactgaatgagatccttggaattgcagcgtagcctggagctgtatgttcattttagatagaaatattgacactattgacactatttggccgggcgcagtggctcacacctgtagtcccagcactttgggaggcaaatcactttgaggccaggagttcaagaccagcctggccaacatggcgaaaccctgtatctactaaaaatacaaaaaaattagctgggcatggtggcacacatctggaatcccagctactcgggaggctgaggcacaagaatcctttgaaaccgggaggcggaggttgcagtgagccgagattgcgccactgcactccagcctgggcaacaggtcgagactgtgtcttgagaaaacaaaaagaaagaaatattgacactatctgtccgcaaaaggtcaaaggcataattacaatatgattttgtttccatttttctttttcttcttatttcatgcaaatgctgtctttttgagagaagtggttataagcacagcgatattctatgctatgtacagctctcatatatagaactctctagaatggctcaagttaccattaagcctcaggtgatatcaaggttataaaatgtaaaatgaatgatcatgatcattaagtagaaatcctggctgtgtcttccaagttctttttctttctttcttcctttttttttttggagataggtactatctgcatttcagcttagcttgccgccagtgttctggtttcttgaccatgctgagtaattttcagccacaccttgtatcccttagaagcccttcttgattctgaggtacggggctcagaaagctttgtcgtgggaggttgtaaattaggaaacatgaaaatcagatcaacaacagtggctggtcctggctgcagggctcatctgcctggagtagcttgaagttgaatgttaatatatacttttaaattgcagttgtttaattaggtaaagtgcacaggtgactttctcacactaaatggatgatgagtattgggaagagttgactaaaatttctctatcttttgcccatatccaactctcattgaattttaactcttatgagatatgtgctatttaataaataatgagtctgagttttctcccttttggaaatgtcaggaaagtctcaatgattttaagtatcttttattttataatagcaatagaatctagaatttctaaaatcaaactgagttcttgattaaatgttgaaatgcttgtcttcatccacctgggagcagtcgttgtgaacgagaagccccagtgcataaatcattgaatgatacattggagaagtctcagagtaaaggaagatttgtttacttttcagacatcctggaaggtgagcatcaaagcaggtgagtggctggctcttggattcaagcttccctgatcctttccagaagtgtatccttctcctttaagagaa[450 bp omitted]cagaggttgacacccaggactagagctcagtagaggggccgtttcctacctgcagttcccttggaagagaaggggtgaagcttaccatgttggtggtggtttgtttcctggggctgctgtagcaacgtgccaccaactggctggcttaaaacatgtatggtctcccagttctggaggccagaagtgcagaatcaaggggtccgcagggcccagctacctctgaggcctccaggggaggatgcttcctgcatccccttgctgcttttggtgttgctggcggtccttggcttgtgggcacagcactttcctctctgcctcggtgactacatggcctccctgggtgtctctgtcttcttgcaaggacaccagtcatgttagattatggctccaccctgctgcgatttgacctcattttactttaactaactatctgcaatgaccctttttccaaatgaggttctgaggtgctgcacgttaggactttagcatgtgatttctgcggactcaggtcaccccataacagtagtcatgccccaccccatcccactccacccttctcccaattcccctggtatactccagggtggctctgtggccacacatgacccaggcccactggccattagacactttggcagggtggccaaagaaattctttgtgctgaataaaattaatgtgtaaatgcggcggtgctccaagggcagtgttgcgtgaaagggcaatagaaccatggctcctgataaacagaagcctgttaagcagcaaggtcaaaagccagatgcagaagtcagaattagccgggtagactttttatttcactttcccccccttttttttttgccagtggactgccaactgttctcttaacagaagggcagtttttgagtaaatgaagcaggacttgatctgggttgtcataaattgtctctccctcaagaggtaacttctcgtgtttgccagttcagaggtgtagggagacatctctgatgtgtagatgtcctagtttggggtgcagggtggctttgggtctgagagcctgctgttggccactgggtgcgcgtgggcttctccacatgacaagacgggaatgctgtgaaggaggccgctgttccgcttgggatgttggccgagcgccgctggcctgtgtccctggaatcctctctgattcaaccattgaacattaactctgtgaggtcacagccaccagcggggcttctgagcccggccctgttctggccatagagggtcaggaggagaagacgtttcacccttggattttctgtgtttggaatccaaggcctttcccgtggagtcttgtgaggttttctcgggaagaaatgatcctctgggagaggcttgggcgcgaactgaaacatctttcaagacactgtggctcttttcagggaaatgctaagccaagcaaacatccactcagaaatgttctgtatttggaagcctcagagtgttaggggaagccttgaccctggaatgtcatctcctggtggtggcggcttcacgtggtaaacaggaggtaacctgggtgtcatgtcacccaggtgacatgacacagggccacacaggatcatcttccagtggcagtggtgaagataggggatatgatttcacatcctcattagagcccacacatgagatccagctttataattggaatcccagataatgagcatgtgaacgtccgtaagttccgcctattctgggtatgatgtcacactcataaacaagctaagcacacaaactggaatttcactttggaggaaaaaaatttcaattctgttacatgagataatacaagtagtttaaagccacagagggtctctttcgatcaggtagatctattcttctgtgctcatgcaatatgatagaagagcttcttgcatctttatgtcaagaatttgctaaaataaatcagacaagtttaggatttacctcatagtaaatcaagaactttaagcaggggcttttcttctaattaaaaatgtcatgtataccacttagacatggaaatgcttaggtaagtggagcaaattattctctggggatttagaaaaaagaaaatcagtctggtttctatggctgcatgaatctggaaggtaaattattaacccagtagactaagattttactaaaaacagactaatttgttgtggcaagacagttccagtctgtgtgctagggcttttgtttgcatgcttgcttgaaggcagacaagtcaaattaaacaataattattggcttggagggggagcagatgtattggattagtttctgtgccacatttctctcatttccaccaatgcactccagtttcagcccttgtatcagttatctgttgattgctgtgtaacaaatgaccccaaaactcagcaggtgaaaactacaaacgttaatgatctcacacaggttctgagtgtcatgaatccaggtgcagcataaccaggtggttctggctcagggtctctcgtgaggttgcagcctgcgctgcagcctttgagacctcgtgtggggctggggggtcagttccaagctcccttagggtgtggctgcagcagaagtgatgcaccatgtgcaacaattctcttggtcctgtggatcaacctggtgaatgtgggacaggccggtactggagtgtgaatgccagggctcacggggaccgaccgtctgagaagctgcctgtcacgtctctctttgtcttttacacccataaatgggcaccttggtcagagaataactccttttgagtccataatcgtctatcagaaaattctgggaaaattacttgttgatttagccacgttcatggcctatctttggagccatcagagcccacaaatggagactgtcaacagcttagcagtcagttcattagaaagtagtgttactgcagcctgggtgacacagtgagactctgtctgtacaaaaacattaaaaaattagccaggtgtggtggcgcatggctgtagttgctggaactcgggaggctgaggtggaggatcacttgagcccaggaggtagaggctgcagtgagccatgatggcatcactgcactccagcctaggtgacagagcaagaccgtgtcccaaaaataaataataaaaaaagaatgaatcacataccaatttttttgctcttaattgcatttttgaacagaaaaacagttttccctgcaatcaaatgcaaacagttcctgagcccctaatggacgagcgtcctcagctcccacctgcactataaatttgcgttaatcttccagttaacttcagaactgctgctgtctctctatgttccttctgcctcaagacatataggaaatgttggcctttccctttcaaaagaacaaaacagttgaataacctactacagtcttctgtgcaaagttagcttcaaaaattatcaagaatgttttctccaaacattcacaaagtttacagagttttcccttttactcaggatttcagcccctttgttgctcttggctctcacagcaccaagatcgtctgtccactcgttcattgggcagatgtttattgaatacctgtgtgtgccaggccctgggccctgaagtcagggccataaacacagagcacagtcctaagggcaaacgattttctcaacagggatttgaggcctgtgaggtttgaacaaatgagcctcgtgagtgccagttctggacactcggcctgacttatcggacatttcgcagattcctaagattttagaattgggagagaatctttgagatttgcttgtagcccttacattttctagacaaggcagaaagaagtccagtgggatgaggcagtgctggtgctggcaccgcctcaccctggcacttgcatcgcctggaaacaaggcagagcccactggggcccccagggtccaaagcctccaggtacgtgtctgagttctagcattggagttgccgctctcacccttgccagttgctttggcatgaagcttgatggtaccagtgtgtttctgtcttcacagcttgtggccctggccctgagacctgaggcttggatggcactcccacttcttgctttaattcttccctggagagttctcaccttccctgctttccaagtccagctgagatgggcaaccaaaatttcccaagggagaaaatagctgaaaatagaagtagaacatgaaagaggatggcttttcttttttctttttttttctttgttccttttatttttttaagttgatttatttatttatttatttgagatgaagtcttcactctgtcacccaggctggagtgcagtggtgtgatcatagctcactacagcctcaacctcctgggcttaagcaatcctcccacctcagcctcccacaggtgcatatcaccatgcctggaattttttttttttttttttccaatttttgtagagacagggtgtcactgtgtttcccaagctgttctcaaactaactgatcctcccgccttgggctcccaaagtgctaggattacaggcatgagccatgtgcctggccgagaatgtttttcaatttgggcttgttcagtggttttcacatgattggactggggtggtaggttttgaggaacgagaccccagaggtgaagcgcccttctcaccacatcatatcaagggtaggtactgtcaacctgactcaccactgttgctgttgaccttgaccactgggtttaggtcatgggtgttgggttgcgattaatgtttttccctttccatgtagtattctttcaaaatccccactcgggtggaggaggggtgttaagcatctcttcctggaggttgtttatttcggttttatgttaaaatatatcagtgcagatccattcacccatctcttgatagaaggagtaggatttttcttgggacagggatcctttattcctagtttggagtcagcttcccccattccggatggtgcagcctctacaatgtttgtctctttgaagcggagtgggaattgaaagagatttatgaaaccatctcggtatagaatctatctaggattttattttcttttcccaaatcccttgaggcaatctgtcttggttaagtctctaaaaaagcagtcaaagtggtttttgtcgaaaaaataatttgggggtactcctagttcaccattttatataatattcaattacttttcgtaaatgcaataacaaggccaactgacataagcgagtttgaagcagtcagcagtttgggtgtttcagacccaggtaggcagctgaggtgggagatcccaggggaagctcagggagcagctgcccgccttggtcagttcagccaggttaagtggaggccttgggaagagagtttctcctcttgagtatttttagaagcagcagatatcagccataaatatttaatgttgtgtttctaaactttagcgtcataaaaatacaaaaaggtgactgggcgggggttggtcagtatatacctaggggagaaaagaacttcctcaacacatcacactgcataaggaaaaccgtcttaaacgttcttagaagaaaagtcagtaggtaaacagctatcgtgtaatctgatgaatacccaccggaggaagtattagtaattattctttgcttgccagggttttcataattcttttccaattataaaaattaatatgctgtaagcagtttttaaaaataaaagtaagcatgaaaagaaaaacatctataaacccacccctagaagttttgccccagcattttggtggtgtgttttcttccaggtgtgtgtgtgtgtgtgtgtgtgtgtgtgtgtgtgtgttgccccagcattttggtgtgttttcttccaggtaggggtgtgtgtgtgtgtgtgtgtgtcctgctgtattctgagctttgtagtatgccccttccacttgaccttctccaggaagcatttgatcatccagcaacatcgattgaaaatgtttgtatgcatctctttcatgaagtacatgttccatcatttatatcacatgtgttgctggagatttcaattgcttccattttcctttaggataaattgctggaaatagaactggagggctcttgagaccgattaccatattgctttcctgagaggctgtgcgggttgcgtggcagtgaggagggacgggggtaagtggaggggctggggcacaggcctctccaacacttcatgtgaacatggtcagctgagccaggaatgcgtgacatctttatttttccccttgcatttctttaattcctaacgaggtggaatatttgatcacatttgtcagctatttgcatttctttttccatgtattagacctaagcctctttgaaaggtgttatctcaggttctttccaatattgcactttctgagtttctcttgaatcccagttattttaaggattgcagtgttggagtttcagctgaaggggccatgtctgatgtttgctggtccattagcctcctggcctgagccaaaccatgcatcttcatgtcagagctgcatatgaaacaagagctaagtccagaaagcaagaagaagctagcagattgattttcctaggtggggcctaccagggcacttctgttgttgactgtaccactctctcctgaagggccctggttgtgtactgcagttgggactgctgacgtgttggggtgttacaagagcatgcggaggctgctcctctcctgtttcctggtgtgctgatcaaaagactttttatagaatgacagttgtaggaaaagcacagattcttatgttagccaataacggattattttttaatgttattataaattggcaagcttactaatttgtttctacttgtcattagccaaagttcagtgtttcccaaggatatatgtgaatgtgtgtctgtgtgtgacatctgttgtatttttcacatgaattaattgagtatctattatgtggcaagctctgtgctgtctttgaagcactgaactgtcttatgatacacacaggatgaggacaggatcattttctatatttctgtgaagtcctttttcaaattcccattcttttgctgcttctgcatctcctttgactgctttagggcatcccaggtagaaagcttacctaatgtcaactccagttctttcttttgtagtcttcattttaagcatgatttctgtttttctttttccctttaaagaaagcttctcaaactttgaaatgaaaacaaatgaaaggagagggaaaagattcagaaattattgatagattgctaaaaacaaatgctatgataattttgggtcggagcatctgtcgttttacagcacaacagatttagcttcttaatgatgtttgtatgtttttcctcaaaagtgtattgactaggtaggagttgagccaagccttgaatgaatcatttcctgccaaattcaatagactgagcaaatcctcggagaaatggccatatttctctaacactgggttcctttcagggctcaagattccattttctctcaatactttgctcctacagactaggagtcctcttcatgctacagtatgcagtgtgtatggaaactgtgaatggagaagcagccgttcatgctgccaagtttctttcagaaggtggctccaggtggatgactttcagtctgaactcagtgtcaccaggcatgtgtgtgcccacacactgccactttaagctgtggacaaacagaacggatattctcccaccaaaataaacatacaagcaaaacactctgtcttcattcagcatcatttgcatcctataaaataatggtttctccttgatgcccacctttcttatgggtggttcttaattagttccaaacagaacttaacgtggccatgatattccacttgctaaaacaagggcagtcgagtgttcgatttgccatcattgattagacgcatgcagtcacccagtgctgtttgcccaagcatctgtaggcggggattccccagtgctgattccccaatgcttgtaaggggcaggacttaattaaatcttaaagtgacagctgaaaatgtaagggtcaggaagtcatgtctaaaaggggatttagtataacaataataacagcagtgactaagactaatcctggctcaggcattttgtttggggtcacctggtcttaattagcagcactctgggatttgagtggcgctgtgctgttgcccacaaagcccatcagtggcaccattgcctgtgtctttcggggcagtctgttagggagggggtggcacaggtgttggcacggccatccccattttatatgtgagggaacctcagccaggcaggatccttgcctggatgctctgtggggagccctgtgagtttgtaaccctccgtgcagcctgccaggtcagcggccccaaaatggagagatacagagggcaccaaattgtaaggcagagcgttggctagtgacacaagctgcctttcgatcgcctgggcgttctgaagcccgcaaacattcgcctggaccttggtcaggtgtctcacagaacctacagtaattcactgttaagaataacttcaaacacagaaaatcgctttttgtttcctagagaaggctagtcttcagcgagaacaacttgtgatttttaatctgtttcacactggtcggggaggggggaagaaaagatgttatgggcatataattaaaaatttgtcggcagatacaattacaggaagaatcatgtggcctaaaaaactgaaagcctccatatgcctcttcatcttgccagctacagtccacaaattgtagagcctgcgggcactgtggaagccagctagatttgctctatccagtagcagcagattgagagccatacatggaatttatacttttctagcagccacaggaaaagagtacaaagaagcaggtaaaatttatattacaacatcttttttactgtgtattaaattattattgtaatacctattttaatatataataatgccataatatattttatttaacccaacgtatccaaaatggcatcatttctacaagcgattcctattttaaaaattatccgcaagatattttatgttctttcttttttgtacaaagtctgcaaaatccagtgtgttctttggtcagtgatgtctgagatcccaagttccaatgtctgtctgaaattatgaaaatcaagtcatgggagatggataccctattccctacgatccacttatttcacattgcatgcctgtatcaaaacatctcatgtactccataaatatatacacttactatgtaaccgcaaaaattttaagaatatacaaaaaattttaaaaactgaattaaagagcattgtagataattgtatttttcaaaaaataagtaaaatatctggtatataacagttaaaaaaaaaactgtattatcaactctgtgaccttagaactacctttttacattttcaaagattaactctccttaaaaaaataaatgtacaaattattaccaaaaaaaaaaaagaaaatcaagtcataatgtgaaaaataatttttaagctgaaagttacactgtttctaggagttttaaactaggatagtttgtggttattaatctgtttggaagtagtccagaaaaaaatgctatgggtcaataacttgaaaatgtgcatgtggactacttaaagaggaatcgtgtggcctaaaaagtccctgttatccctccaccctgcagactccaataggagaatttccgctgctgcagactctccttggtggccaagctgcccagcactctcccgtcccaccaatggtgtgactcctatcactgagaaacagaccccttaccatttcatttccttttaattaatttaaatttaaaaatcaacacttccttggttactggaatgttgggaaccatgtgggtgtgtgcatctatattttccagggtctattttgttacctataataccagtcatgtatttccaatgaaaatttaacttgtgaattgagatatagtacaaatgtaaaatacatacactgtgatgatttaggaaatttagtaggaaaaaggaacgtaaaagatctcagtaattttttaaatagaatacaagttgaaatgatactattttggatacactgagtaaatcaaaatctatcatgaaaattaatttaaggctgggcgcggtggctcacacctgtaatcccagcactttggcaggccttggcgggcggatcacctgaggtcagcagttcaagaccagcctggccaacgtggtgaaaccctgtctctactaaaaatacaaaaattagccgggcatggtggggcatgcttgtagtcccagctacttgggaggctgaggcaggagaatagcttgaaaccgggaggcggaggttgcagtgagctgagattgcgccactgcactccagcctgggcgacagagtgagactccatctcaaaaaaaaaaaaaaaaaagaaaagaaaaagaaaactaatttaaaattatacataaggcttgccttagatttctgttgggttgtgcagatctagaccacagttgtcatgtaacaaaggaaggagagtttgaaattacaggctcacagttaatgataaaattccaacctaaacccaagaccagacattccaaacactcaagtgagtcaatctgatgatttgtaaggcttaatgttgaaccgtcttcaaatgtgatgacctcatcctaactctttccaagctcccactttgggtatatcaagaggctgaatgtggtggctcacatctgtaatctcagcactttgggaggctgagtcaggaggattgcttgaggccaggcatttgagaccagcctgggcaacacagcaagaccccatctctacaaaaaaaattagccggatgtgttgatgcacacctgtagtcctggctactcatgatgcttgggttggaggatcattgagtccaggaatttgaggctgcagcgagccaggatcatgccactgcactctagcctgggagacagagcaagaccttgtctcaagaaaacaaaacaaaaaatgaattggccaagagaagtcaaggctcatctgacttggaagggagccaggttctcagtctatactgcttttctcatcctggcagcatccccatgagataaaaatgattattcccattgtacacttaaggtaaaaggtctcaaacagatgaaataattgcaccatgactatagaaactagtaagagtcagcgcctgaaattaagcccagggctgtctcctttgacactggccaaaaagcagtaacctcttttgatgaaggggcttacttcaagctttgtttatgtgatgaaaacaccccagggctccagaaacttaacatttggttccacatccagaaaagtaaatttacaaaatggtactgcaagtgataattctcgttgacctgggattgctagggtataagcattctgggaatacctgggtttctgatcaggaagtcattcgcagctataatggtgatcctcagtcaccgggactctgggattgctagggtacaagcactctggggttacctgggttcctgaccaggacatcactcgcagctatagatggaatgctttaccccttttctcctgtgttatatgacatcggttagcaccttttaacctttttagaagataggttggaagttgagttagataaatcaacaggtagctgatggcctagaatataactttctgtagctttcaaagtgaggatgaggggcatcttgttccctaaactgcttcctcatgatggggaacctcagcattgtcttgccttgtgtctgagtacccatgtaaaattcagtatttcattcttaaaagataaaggggaagaaggaataacaatagacaaagagattccaccctagtccccatcctcattctggtgaaaagttgtcattactaagacaatcacacactcgatggagaattgtaggctgtggacaacagagccatagatggtgtactaatagctgctacaaaggacgcctctgtcctacctttcatgcccagctttgagtatatcctgtctcttgctcattaccgatgctgagttttagccctgtaaccagagtcctctttctttttccacagatgggactatgaactgtgttttaatgattagagggagtagtgaagattttcactgtgaacattttcaccccctttcccatccttggccagagatgatctcacatggtcttggcaggtatctttttacaggagtgcatgttgtttatcttgggagctttttgcacagggaaggcctttgtcttccagctctgtgaatccttcttcactgcgtagcaccttgcagaacatttgcacatattaggctcttggtgaacacttagaatcctcagtcatttgcattcacgtcatgtttccataacacattgaatgaaccagcaagtatttattgaacatttactatgtgaaacacagggaagacagccatgaacagaccagacacaaatcttacgtgctactggataaaaatgtaccccacggatgacactttgggtattatgatgccaacaatgagaacatattaaatcactttggtatttgcattagattgtgtcctgtaagtttcagattggtgtatttgccaaagaacaattgtgtgtaccccccacccaccagaaaagaatacagtaaaagtgctaaactattgaatatttttaaatggtattatatttgaaacgtgtgtttgtaattttgagccatgtaattagaaatctagggtttatttaaattcttgtttgttttagagaaatatgtaaagccacatttccctttatataaagtacttggttgaaaaaacaatttttttctaaagaaaaaaaacactctttagtgtacttttgccaattaaaagacagtacagagaaattgattcctcctggagtttgtgtagaaattagaaaacataatgcttttccctaggcatgaactcgcttaaaactactgagaagcttatactcacgcaggttgaatggagtgaatagtggtttagagaattgagctgattaataagaagtccctgattttcttttaataacacgttctgacccaataaggaaaatttgcactatgttttcctacagcgatggtgctgttaaaacttatgcaaatgggacaactttattattactaagccttttacagtatgttgctttccagggagctttgtaaatcattataattgtgtttcctcagtgtatgggttctgaatgctcctgttgtcctgtgaggtgaatttccatttggtgaagatgatactgttaaatggaggtttctaccccatagaaattaagaagagataaatgcagacagacccagcccttggaaattctgctttgtgatgaattatttccttatacttatggtgaacttttttacccgtgatgtgcacaggggcccagaatcatatatgacaagtccttccatgtggactacatccatatgacaccatgttcactagttggagccttggaaatccagtgggaatggtgagatagtgtgaacagctccaaggcaccgtgtttttaatgtaacccattcgtttctggctgaataggctagttgttgatgtggtgggcattatgagatagtgttaatggttgggccacggcatttcaaagagatgccttataagtcctgagcccattgtgcgtctctgatcattttggtcttcatttgctccccttgcccaccgtccttccacagagcattctctggaagcgctcagggagcagaacagggcaggcccacgtagaaaatggtctcttgagagtagaaggtcaggttcgctgagatctctgactcagaccacccgtacccatgctttttgttgtgatggagaaggtgctctcatatatacacatttgtgtagtaattactgcatattgatagcaatgttactgcacctgttaattaatataaccaaatggcatagctacagtgttttattctagttcaatttaggagagtatatttgttctcaatgggaattgatctggggagacccagagagtggggacatgagggttatttgtggaggggatgacacagcagcttcagaaaacagaaacattaatgcattagactgctgacctgtggggtcacacttccttcagtgatgcccataagagtcttggagtgccggaaagtataagcaacgctgagttcctgccagtatcacaaaggtgtgttttggataagagaggagccagaaagattacacttgtgtagaaagtgaaaactgagtttgagggaacagtcacattctcatggcaataaggtgggtagaatgggccgctcagcctctgcactgtggtcagctggagctggaagatggttgtggtggggctgccgtgtgcacggtgggaggtttagcagcatcccaggacccaggagataccagtagcaccgcctcccccagttgtggcaactgaaaatgtctccagatattgccagatgtcccaggatgccatagggggagcatgcagtatcattgcctgttgagaacctctggaataaataggtaaatgcatacaaatataaggatcttagtcttgcattgggaggcggcgtctgacatgtaaagacaccactagagcacactgaagtaggttctttcagagcattgcatgcatgataccctggagcccaaggagaaaatgatcaggccatgcctcctggaatcaagaaggcttgacttcacggcctggaggagataagttttaaactgatccttgaaggtagaggtaggtgaggaactagatgaaaggatcagtattaggtgggcttttaaaatattttctggccgggcgcggtggctcacgcctgtaatcccagcactttgggaggccgagacgggtggatcacatgaggtcaggagttcaagaccagcctggccaacatggcaaaaccccgtctctactaaaaatgcaaaaaaaattagccgggcatggtggcgcgcccctgtaatcccagctacttgggaggctgaggcagaagaatcgcttgaacctgggaggcggaggttgcagtgagccaagatcgtgccactgcactccagcccggacgacagagtgagactgtctcaaaaaataataataaataaataaaatagaatttttctgagtattttgtatgctgttgaaaaatttatcacttcgtagatgtatctcactttgtctatatctaagaaaaaaactatgtgcataaatgaatttttattagctagttaatctagtcagtggaatggagtattatttccagagttccacttcatattccttggtaatattgagacgctggttgtagtgaaaatactcttaattaaggcatgttgtaggttcagagtttagatggctgaatttcatgaagggtcttcaaagcattgggggtgtttggtgtacggtagtgattttcttgtgttcatttgacattttaaagtgatagacgtttaaccttgggctttctcaggactctagaatatgaatgatcactgttaactgtttagaaactcatgatgtaagcccatatgacttatggatttatgcacattctaaacagataagcatcatacaaatataacttgagttttctatgaaaggacagtgagacaccaccccccgcaagtctggcctgaacattggtggactgggaatcataaaaactgatacatacatgtcttactttgtgtttgtttgttctaagcgaaagcatgtgaatatgcagtcatctgccaatactttgtgggccagcccaggcctctgctctgaggatggcccacagcctggagtgccccagtgatcccagcactgtccacacccgcggtgcatccctcctggcttctagtttccagttaacttaagcaaagctgcacagacatctcactgtacatctctctagatttatacctcccctctctaccttcccggtcttgctgcccacacctgtcctcaagtaaaaactgattcacacttaccctgtctctcaaacattcaatgttattttcattttgaaaaaaggctgtgaccctgtgtgtactcgtacttcatccgtctgtgtaatatttaaagtttgtagttaaaatagtgaggacactgagtgaaatggggctgggagcagacttggatcggctttgggagatggtgtaggcagcgatggggacaggtggaggtgcggaccggagtgccgccctctagctgcgagcttacatcctcatgcttgggtgtctgtccttcagtttcttctccagtgccacgtcacctacctgagctgcctcaggtttgctccctgctgctgtgcacacgtaaatcagtgtctggcgggaaacaggcagacgcctttacaagaactagttgccatttatctttttattgttagacctcccagtaatgtgtgaagtctagtaattgcctgtgtgtcagactaactcagttgtaagctctacattatggtgctattaatctcttcaatgtaggcaaaatggggacagtggctcccacagcaagcccatctgctctacccatgtaagttgggagggatgtggtaccgtgtggcttctacttctccatccactttacggttgatgttcatgcttattgtaaaagccctgcaagacctagagatgctgtgagtcctcacgaaggaaaatgcagtgttccgtggggttgtgctgtccactacaggctcttgacttctgaactttctgaagtttgtatatttatccgggaactcatacttaccaagctgtattttaagtttctttcctgagtcaggcaccctccaagctaagtgctgtggctgcagaggcccctgccctgatggagcttgcctgttacttgggagacttgtagcaaacagaggaacaaagaaacaaaataatctgatgacagtaacacatcctgtgacagagacgaacaaggtgacatgggttggaggggtttgcacattagaggtaagaagactcctgtgaggaagagatggatgaaccgaagtgtgtaagatgcagccggaagagccaggagaagagagtttcaggtggagaggccagcacatgcgaaggccaggcacccaggaaactgagggaaaacacaggccaggccagcatggtggagcgagtgaccaacagagcagaggtgtgcacggtgaacaaagcctacagtgctttgccggccataatactaagaggatgagtgtggacctgaaaccccccagcagcttcctaccacactaaccagtggctggctgctggctgagggacggactgtgatgactcccactgggtcccaggcagggagataacctcaccttccactagcatagctcagcggagccaagaaggggagaggacagattcaggacactccagtgcagaatgtcagcggacgtgcatgtgtcctgccaggggagtgaaggtgtggcatgtgagcacggagtgggagggaggtgtgacttatggagactacaggctagaagagagacgagatgccatggttgggtgggtggaggtctctgctgtgggcgtgttgcgtttgagatgctgcttggaccttcaagtggccaagtcatgcagtccctgcagggataggtgaggagctatggaggttgggggctggagacatctgggatgtagacctggagactagattcgttcactggagagacccatggcggtgtagtcagcgaggggcactcaaaggtcgggaagatgcctttcagaaactcagggtgcccaaagcatttccaaaatcatttaacacctccttgcattttcacagggacttggaacctcttaggagataagaatatagggaaccagccatctggagacttctgcagagaatatacattaatatcactgtcttattctcactgactccccacctttttaaaataagggagatggcctagactaggaattttgcttaacttctatcctcctgtcctttttttctgactctgcagttttcatctgaggtagagagaaatgatgcactctgctaaattagacctgaatatctgttgtttttcttagacttgtgaagtttttactaacaaccacaagcacagtcctgaacatcgtataacagcatcatttgttaattttttgaatgaattttgtgattaaccttgatttaacaagaacacccagcccatttcccaacgacacaaattaatacaaatttaatgaaccgaagtgtgcccttctgctgccacgtagctcagttctccagggatggaagctggcctgagaatttctaagtttgacgaacattcagatgttccagaaactatcaagattctgagactgtttctaggaaaggccacaactctactggaaagtatatcagaatgacatttttgaatctgaaaagaaaaaagtcctgtacatttttaattttagttaagagtttgaatctggcttaatatattcttaacttgctagtttgaaaacaaactggtcgatgctcattttcactctcataactgtttcgatatttctgattttttttttttctttaaccaacagaggggtctttggaagacatatgtgcttttaagtttcaattttcattgcaattttgtttgtggtaaaatgcacataacattacatttaccattgtaagcatacagttcagtggcattaagtacagtcaccatctacctccagaactttttcatcttcctgcactgattctccatcccccatctccacacccccggaaaaccaccatcccactttctagctcttgttttgactactctggtgacttcatatagtggaatcatacattaattgtcctttcatatcgggcatatttcacttagtgtagcgtcttcaaggttcacacacctgtgtcagaatttcattctttttttttgtttttgaaactaagtctcactctatcacccaggctggagtgcagtggtacaatttcagctcagtgcaacctccgcctctcaggttcaagcaattctcctgcctcagcctcctgagtagctaggattacaggtgcgcgccaccacaccctgctaatttttttgtgttttttgtttgcttgtttgtttgtttctttgtttgttttttgtatttttagtagagatggggttttgccatgttggccaggctggtctcgaactcctggtctcaagtgatctgctcaccttggcctcccaaagtgctgggattacaggcgtgtgccactgtgcctgaacagaatttcattccatttaaaggccaaatatgtcattgttcgtataaacagcatgttgtttatccactcatccgttcatagacatttgggttgctattccaaaatagcttttggctattgtgaatgatgctgctgtgaacattgaggaacaagtgtctgtttgagtctctgcttccagttcctttgcatatacctagaagtggacttgctggatcacatggtaattctgtttactcttttgagggcctgccatactgtttttctgaaggtttaagtttttgtgagatgtgataaaggtagggtccaaccgtgactcctatgatttgatgcaaaggttaacccactgtatcctgcaagccaaatttagcccttgctaattttgtacaggcaacatgctaaggatatttttaatattttcagatggctaaaaaaattgaaggataatatgtcattatccatggaaattcaatgaaattcagatttcactttacatagttgaagtttcattggaacacggttatacccattgtctgttgtctatggagcagactttgtatggcccatggagtgggatttgctatggcccttcgagaacaaatttgcaggcctggcatggtggctcatgcctgtaatcccagcactttgggagggtgaagtgggaggatcatttgagcccaggagttcgagaccggcctaggcatcatggagaaaccctgtctctacaaaaagtacaaaaattagcggggcatagtggtgcatgcttgtagtcccagctacttgggaggttgaggtggcaggatcacttgagcttgggagatggaggctgcagtgagccgtgattgcaccactgcactccagcctaggcaacagagtgagaccctgtctcaaacaaacaaacaaacaaaacacatttgcaaacctggttaaaatgataaggagttcgacaaagcttacttacgtctgttgactgctctgcccaactccgtgggcttttccaagggtctgagtaggtgcatcaagctgtccacctaattactcacaccatcctacacattatttgtcacttttttgcatgtaagcaccaatcccagttgcttaagcctgcagggggcatttccttcagtaggagatgcagagtgtaaaaactccaacccatttgcatcttgcttatttcaggtacatttcctttcctgtttataattccaaagtgtggcttcctatcatgccttttaaggaactatctattcccattgactaggagataaatctctgtatagtggaggaaccaaactgaggaagacttctcaaaattgttctttttatcatacacttttttggaacgaagtttatagccaactaagaggcagtcttctatttttaatctgtgatatttctgtaaagtcatgtaaatgtcataactgcagtgttttcaagttgttgttgtttttgcaaagagctgttctctgcagtgagggctgagtgtgacttgttaaaaatgaaattcacatagcatccgtttcctccgttagcttctttcacttaaaggacatcttcaacatatcatttaagggcaacacttggttcatagtgtttaatttgttgtcaggaatgtcagcctcagaacttcttaatatacacacccaactctactgtaggtgcctatataatttacatttaacctattattttattttattttattcatgagggtgatcttaggacctgagataaatttgaacaggatcaatacaaatcaggctatgtttaaaccaggaagcagaattaaattctatttttcttgtatttgggttttgcaggaaatggggcatcgtgttttctcttttgaaattgtgtttgaagtgatatttgcatgaagaagcagcctgttttctattagactggtaaagtgggaatagtagaaaagagaaaggcgggatttgggaaatgtgacatgaagacgttgttaaataaggtatgcgtataactaaatgtggcaagaacaatgctacttagatacggaagctgctaaagtattttaatgttctctttacaaaaaaaaatttaagaattttaacatctgctagagctcaatctagtctgaattttttttctcatctgacctttttcatttttcctttctcaaacacacttgctcatttaaaaaattcagttggagaaccaagtaatatgtttccatttaagaaagccacagataaatattgttccatttgaaactacagcttcactcacttgatacttgtatgactattttaagttccttttaaaaaaatggctcaaatttatccttttgggagggactggtgaaaacgtctgcaggttcatcttggtttttaaatttttatgtgtttaattgtggtaaaaacacataaaagtttcatcttgctttcatgtttgcttttaaggtctgagaatattaatagaacaaaaggaacacaacagcattccaatgaccagtgagtgtagctgttcccactgtgtggttatattgtttttttacaagcctacatatgtggctttacctatattttaatatgtgaattcatacagtgtaactataaagcattgtgctcacttagtggcacagagaggttaagttactgactgggggacatgcagccctcagcacgaaattctgggatttagccgagaacagcctcactccaggatcatgctgcttctcagagtttgctagcttgcattgttagagtgtaatttctggaaaacaaggccatactggaatccggaggagagaaagatggcttacactgggtatgagtacagtgtagttgagatgtgcaaacaagatgtaggtaagataaaagaaaatgcaaactaggccgagtgcggtggctcacgcctgtaatcccagcactttgggagactgaggcaggtggatcacgaggtcaggagttcaagaccagcctggccaaggtggtgaaacccccgtctctactaaaaatacaaaaaattagctgggcacggtggcaggcgcctgtaatcccagctactcgggaggccgaggcaggagaatcgcttgaacccggcgggggggcggaggttacagtgagccgagatcatgccactgcactccagcctgggcggttacccttttttggttgtttttattttttattttaagataggtcatgtggtgtaacgggaagctgatgggacttagggtcagacgacctgggatcattcctggattccaatctccctggcaatgtagtaaaaggtctccttgtctttgagatgtcgggacggtgatgcagtgaggggcagggtgttagggaagactaaactcatgtaacacgaagcatgacacgtgtcgcgtgtgtctctttgtaccacaatatccttggacatacatattcctgacctggtaagatgagattctgtatgttttttgagacctcagcatcccatgcccagacactaaagtcacaggggaccatcagagtcccctagtagtttggaaattctgatcaccagtcagcaaagatatttgactgttggaaattttttaaatggtgagctctctttttctgtttcaagattcggtcatcctttctaatagtagacacggaagtctttttgacaaaggtaatgctaggccctgcactggctgacactccatgcagtgtactgtccttccatagcctgtgccgttagtttacagaggtcagtagtacctgcccgccccacagggtttgtgtccaagtgcttcatcgtggtagaagtggtttttaatgaaacaatagatttcttggtcttgcttcaagtgaaatccctgaagtgtttgctttcccgatgatttcatgctgtaaactgcctatttgtggccatggcccatgagcataaagcagcatcattgctattcaggcacataaaagccagatagaagaaaacctcactatttagccatcgtgtcagagagagccaaactacatgtctttctgggccctggtttttaggggattgaatgtcacccagaccttgagtcttagttatcagtgtcgcatatcaagaaaggacactgaggaatcagaattcttacaagggtggcaacttttattttatgaattgaaaaatattcctattcagcggctgtagtcacacaaaactaggcctgatgtaaggttccacacttttaaaaagcattgtatatatttaactaggattctgtagtcatttatattaggaatattgttgctagttgttttgcaagtttccagtagctgtaatgcaactagggaagcatttacatattgaaggcaggagccaccaataatgtacggattttaacagtaattagggtatctgggaattgcacaggtttcattctcgaaaagttaactgaattgcacagatcaaaagtgaaattgattcactcatctaaacatgcactctgttgctttcttggtgagaggaatgacccacctacttggtcttcatggagctcggtctcctcatctataaataatatattaagtgttgatctaagaatctatgaatctgaattttacataatgagagagatgtacatgtgagtgaaaagcaaaaccctgtgataactcatttttgttccagctacaatattgtggactctgtggactaactatagccaagacttatctgagtcaggaaaaaagtatcatagaaaatccaaaaattaattgaaggcagttgtttgtaggtacagcccaagtgactgcataaatttcacaccaactaaaagtgttaaagagtaacaagatgaaggggttagaatgatttgtgatggatacattgtgcattggaaattgtttgtaagacttccccaataattgtgtttcagttgcccaattcctgtttattctcattgtgcagaagtaagttactactcccttcaatataaattagtgtaaattgtgaattgctttcgtctaaaacaatgagagcacccaacatgaagccaggacttggggttcaaatcctactacttgttacctgtgaagccagcctagattgttcacttacactcttcagaaagcagcctctttatctacaaaatgagaataaacagggctgatgtgatggttcagttatataatggacataatattaaatagactctttctttctgaatgggaaagtgaggagttactgtatttagaagatgcataaccagccttgctgttcaagaatgttaggaatgaaaacagttgatatgtggttctcatgactcaattaaaagatgctatgtttgtgtaaaaattaagaatacatttctgctgaacttgtggaagaagcttagagcagaggctgcctgtgcattaagactgagaggacttggaaagagaagatttttaatgttttccttttacattagggtttcctaactgtggcactgttgacatgtagggctggagaactatctgtgggaggtccttcctgtgcactgtaggaggttcagcagcatccctgggcgtcccccactggatgccagcagcaccctctccgtatggtgaccaccataagtgtctccagacattgtccaatgtcccctggggggcaaaatcacgcctgcttgagaaccactgaaaatttccccaatataaacatgcattacttctgtaattttaatagcaacttaaaaaaaaagatgtcatttccaaactgacaaggctagtctgtacagcttcacatattgaagactcagaagagttggactttttttttctttttcttttcttttttttttgagacggagtcttgctctgttgcccaggctggagtgcaatggcgtgatctcagctcactggcaacctctgcctcctggattcaaataattatcctgcctcagcctcccaagtagctgggattacaggtgtgtgccaccatgcccagctaatttttgtatttttagtagagacagggtttctccgtgttggccaggctggtctcaaactcctgacctcaggtgatcctcccaccttggcctcccaaagtgctgggattacaggcatgaggcactgcgcctggcagacttggatgtttttacgaggcgttttgggcttgtgttctgtaagcatcagcttaacagaaagtgatgttgcatgactgccccaaagactcctggtggcagctgtgaaagcatccagggaccaaaacctgtgctgaggttgccctcaggcacctgtgggcctgtcagtggggccattctaagtaaccaagacaaacctgctctacttgtggaatacggatcttcttcttctgcatgttagttgtctagggtcaccttgatgatattagtaggttatctgttctactttagtaatgtgttaggagtgcacagcttaatcaatctaatatgatactgctctaaggtagggctcagcaaactactgcacacaggccaactggcttgcagcctgcttttgtaggtagttttattggaacacatacacatctgtttgcataaacacacccatttgtttacagattgccagtggcttccaggtacacgtgactacgatggctgcaaagtccaagatccttgctatttggccctttagagaaaatgtgtacctaccactgctccatggttctggaactttctccccttctgttgccatatctaggtatatctcccatctgttaatctcagtttcagaaagggggaggatagtaaacagcatagccaaacaagacaaattatgatagagagcactgtgaatatttcaactttattcagtgcttttagtgagtatgcgtgtgtttctctgcatatcagatgcatgtaacgtgtaccagagtgtatttattaaaatgcctggctcatgtacttgttcatgaaagaagcaaaacaccatcgttttccttgatttaaaaaaacggtagcagcatttgtgctggagaactttgatagaacatggcagttgcgtgtaggatattggaccagacaggctgttggggccagagttttaagagggtttctctagaaacagaccgtactaggattacatgggaagtgagtgtggaatacttcgggatcgctgatcgccggttgtatgggagtgaggagcaggacggggctcagtggggagctttctggaatgccagtcccgctctttcctgcatgtctactacccccgtccaagcacttccttggctctagtatgtcctcatgagcagggcccatgacttcccggtgttatcttctggataatttaatacagggttcaggatatttgttaagtcccataaaggtgttttaagtgaacagctgaatggcaacctcagtttgatgatgctctgtctcctggaggggcctaatgtctggctgtctccagtctccttctaacagaccggcatcatcgtgtcgtgttaagttcgcttattaattctctaccaaaggcatctgcatttagtgtccaggaatcactcgatgtttcgtttctttttatgttttctttgcctccgaaatatcttccacagattccctaaggacgtgaggaatggaggaagttgtgaaggaggagaactgtaagctgaatagaatacagtcatccctcggtatctgtggggtattggttccaggacccctgtatataccaaaatccagggaggcgcaagtctctgatataaaatagtgtcctatttgcatataaactatgcacatcttcctgtaaactttaaatcgtagattacttggaatacctaatacattgtaaatactatgtaaataattgttatattgtttttaaaattgtttttattgtattgtttttattttttaaaaatattttttttctttctttttttgacacagggtcttgctaagctcactgcagccccttcctcccgggctcaggtgatcctcccacctcagcctcccaagtagctgggactacaggcgtgagctaccacgcccagctaatttttgtattttttgtagagactgggtttcacaatgttgtccagactggtctcgaactcctggcctcaatcagtcctctcgccttggcctcccaaagtgccgggattagaggcgtgagccaccacacctggccttaaaaatattttcaatccgtagatgcagaacttgtggatacagagggctggctgttcatattttcaaagactatatatcaacaacatataatcaatatataacatatatgagatatatggataatatatatatatatattcagtaacgatatacatgtattcaaagtagtaggtttgttatagacagcatagagaagactctggctttttaaatccagtttcacaatctcggcctcttatttattttgctttgatttttattttatttttgaactttttaggttcaggggtacatgtgcaggtttgttacacaggtaaactcgtgtcatggggggtttgttgtacagattattttgtcacccccagtattcagcctggtacccaatagttatcgtctctgttcctctccttcctcgcactcttcacccggcagtagcccacagtgtctgctgttcgtgtctcagccttttcgctggagtggttataccatttaccacttgctctttgttttctctttgtaccacttactctgtgtttcctttttcctcggttcctgtgtgcttttgcataaattgcggcttttttgtgactatacttcacagtaagcttattagcaataactcattgctttattttttagggtgttgctctagtgttgacaattttcatgtttaaccttatcacaatctatgtttgaaagatattttacttcacatataagagccttacaacaacaatgtgctttcattctccttccattcttagtgctttgtgctacatttgccgtatgttttacttttatacatgttacaaacaccataatacgttgttattaattttgtactaagaagtcaattatatggaaaaggattcttttaaagagaagaaaatatttttatgtttatatttactatttctgccacttatcatttctttgtgggaatccacattttccatccgaagtttttcttccccttcatggactcccttcagtctgtcttgtaatgcaggtctacaagaagtgaattctctctgcttttgtttctttggtaaagtctttattttgccatcattctttgaaagatatttcatctgagtgtagagttttgcattgatacatcctctcagttctttaaagatttcattgtcttctgccttgcatagcttttgacaagaaatttgcagtttttactatcatttttcccctggatataacttttgggttgttttctggctgcttttaagagtttgtcactgattttcaagaaattgattgtgtcttgttggggttttctatgctgtttatcctgcttggagtttgtttagggttttgaatctgttttactttccttaactgagagttttacaacttgatttgatcttggaatccttaaaatgcgtttttggtttttgtggtttttttgagacagtctggctctgtcacccaggctggagtgcagtggccgcgatcttagcttaccgcaacctccgcctcccgagttcaagcgattctcgtgcctcagcctcctgagtagctgggactgcgggcgcatgccacaacacccagctaacttttttgtatttttagtagagatgggatttcgctatgttcgccaggctggtctcggactcctggcctcaagtaatctctccacctcggcctcccaaagtgctgggattacaggtgtgagccactgcgcccagccaaaatgtgttttaagtaacatattttatcatctcagtactagtgttttattaatgaacactaaaaccagttagagaaacactgatgaaaaccagtgtttattatttttacatatttttataactccatattggctccttggaccttttagagttgggttacgagaaagcaattgggcatttgcctggtattatgtagagggtatgcaaacacggttagcttgtggaaaagatatcagtaacaattgcctgtgtaaccgccagctttatgggagtgctccagtagtaacatttttgcttgtttcagctataaaagctattaccacaatctgtctctctcattttgtacagtaatgatccatgaacatactaaagggaaattgatggcatacccagggttaccatttacagatggcagtactgaaatgttaatttcaaaaacattcaaactgtagttttcttctgtagacatgggacaagcaatttttatcatttaatcatgcagacttggttttaaaagaaaactcttttaagatgttctttgcttttaatttatagccttctagtttgcttataacatatatgcttatttttaaagaacattaaaggttaggcctaaggaatttgtgtgcaaaattggtcattgattattaagaaaataatatagaacctttttttatgtcataaatacaactttaaaaggaaggggactcttcagagttgcctctgaggagcacatatgaaaaagaagggcagaggtttactgcagtggtaaaaaataatccacctagatcaagactattccaaaagtgaatttaaaaagaaaaaaagatgagatggtaagatatgaggaaataatgaatgcattgtgactttccacctccccatacccattttcatagtttggtgagtagaaagagaaatgaggatgctggcccaattttgattcccagtggatgaggctcacacagaactgccctgcttcttgacactattatgatattaaaagtaacttgtatttttataagttattaccatcttggcacacttgcattcattttagtcaagtactgtcacctttagatttcaagcttgcagagtcttaaaaaaatacacattggagaacacatagtcttttaacagtaaaatctcagcttattagaatgtttagtgactgaggtattcagagtcagtcagaaaagtatctttaggatttcagcatgtggagatgtctttcatagagaaaccggggagagtcaggcaaaccctagcacgttgagcatggcgtatcctcatctgcacgggcacttagacacctggacaagtccattagcagtaaggcaggatagaggggttcacaggatacgtgctgcccaggatacgtacgtgcagcccagagctgggaggaaatcatgaggaccgactagacatttattgtacagatgcatgactggctggtatggcctgggatatgtcagtgaagatacaccgtgaggttgtgggaggtaggattcacagtaaatcctaaattcttcatctttgcactcacgacgcacaatagctgatcaaagcttttagcaaactgcagcaaatgaaaaggcggcagaacctcatggtgacaaatgcaaaccctggagtcggactgcaagcattcacaccccagctccaccagtccccagccctaggacctagacatggagctgcatgtcagtgtgtccgttccctctgtgtgagaacgggatagtaacagcgctccctcacacgctcctgtacacatggaaaccaccactgccgtcggacacagtgtatgctgtagaagcacttatggtactaagcacattaaatatttaaaattattaattagattatttaatccaagctcaaagctctcagaacagagccaggcatgtaacaggtacaatatacatgttagctattattattattatttaatagagatggggtcttgctatgttgcccagactggtcctgaactcctggcctcaagtgatcttcccacctcggcctcccaaagtgctgcaattacaggcatgagccactgcgcccagcctattattttttaataactttatgtaacccggtgttgccaattgttttgaagtgtggagccgtttttcagatgacacatactaaacatctactaaacagcctgagaaacggcactctgaagagcatgccttggcaaacactcccctacttactctaaaactccagtcgattggcttccaagttcacttggttctcatttttcctggcaacaactctgcaaattattacccccatttgatgaggtgctggctgagaaggccccttgcccaggtatgtttccgacctgcctgtgacaaagtgttagattctgaaagccgggagtgctggcctcggttagctgagtgataccagcgtggggtctttcgaggctgcaggcaagatgtccgcccacctaaaggcaggatgggggctggaggggccgtgtcccggcgcctccttcctgtggctgctgagttggtatggctgtaggcagggggcctcagtcagtgttgtaccgtgctggcctcgccacgagcacccgaaggaattttatcatacaaatttgattctgttttatcaagagatgccagtagcacctccacttccagttgggacaccccaaaatatctccagacattgcctaatatcccctgggagatggcggggggtgtggggagggggcggcagcgggcactgtctcccctgctccagaacactgtattgaaatacagaaacgtgatgccaatcccatgcttttatttgggattaaatgtgtaatccatatgcttctgagtgggaaaaaaaaaaacttggctccaagcagaaaatggtgcatcctttgttgtcattgggcaaatgcttggtagggatttgatctgtgtagaggaatgctcagtctgcagtggcagccaggtagtgagcatgtgcggccctgcacacagcatgagcttgtcagacagacagtgcttgccaagcagggctctggcatgcgcttgttgttggctatggctcttccatgggcaggctcccggctcctccttgtgcatccatcccctttgttggccaccctgcctgctggccttaggccttctgctcctttccccaggtcctggctctctccagcttggcctccctccgcccatcctgtgcacctttcattcctgggtaggaggagactcaggtaaagaaggataaaggcagaacgatgccaggcaattccactgctagccattgccccaaggacatgaatgttcatagcagcatggttgacccaagccaggttcctgtcagctgctgcctggaaaaacacaacgtggttcagccacgcagtagcatagtattcagccataaaaggagtgaagccctggaacgtgctacaacatggatgctctgggaaaacatgctcagtgaaagaagccagatgcaagaggtcacatattgtatgatctcatttagtgccccaaatagggaaattcatagagccagaaagcattctgtggtcaccaggcctgggggaggagggaatgggagtgactgcttagtgggcaccagaactcctttccaagtgattgaaaatggtttggaacttgacataggtggtggttgcataacatctgaacgtaccactaaattgtacactttaatttggccaggctcagtggctcacacctgtaatcccagcactttggaaggctgaggcaggagcatcacttgaagccaggagttcaagaccagcctgggcaacatatcaagacctccatctctatatttaaaaaaaataagaatttttttaaaagaaaaataataaaatggttaattttatgttgttacttttattccaactgaaaacaaagcaaaacaacaacaacaacaacaacaacaacaacaacaacaacaaccatgtatggtccaggggaatgtctatgttgggcctgaggtgtgctgttctggtttttcttaggtgaatgggttctgaaggctgcatcaaaagaggagtctttaaagttgctaattctttcctgataggaaaagaatataatttctcaaaatgactgctttcgaggaatgcccctttctgaatttgaaaacatagtattaaaaagaagagtctctcagtgctttagattattatttcttgtattcgatgtaaaaatcccttacagtggttttacaagtctgcagaggaattcacaaagcacgattgaaaagtgatgtacaggatttatagttgaatgggaacaaaccagctgatctgcatataggatgaaatttagctgagggtgctattgagtttggacaacatttggctggacctttgtaactcttcagctctatgaaacaatagttgtgtgaagaattaaaaggtggaaaatgaactgtaggtggctggctcacatatgcctaggtctatttccagacacagcgaacagtgaaatgacagtgtcggtgaggcaccagttcaaggaaatacacaaagactgcctactcataaatacagacacaatggggtgataactggtgcttgcacttggagatctagaattctaaaacatcggaaaacaatagcagaccattctgtgtccttttctttaaaactatctcttgaaattttcgtgcttcccccaagaacatcctcaaagatgccagtaaaaataactccacaggaatctttctgaattccaatatccatgtgaaaaggctgcattttattctgatttttcacaatagaattaaggcagacatgatgaagaaatgaatgtgtagaggacttccgaaatctgtattaacgtgtgtgatcagcaactgtaatgttttgattgattatatatggtacatctttcattcattaagctaactttaatcaagtatgtgttatgtgtcaagcctggactgtagaaatgaacttgaagaagaaaggactcttcctcctgttcgggtagaaaaggtataatgcgtgttatggatggtgtgaccgaaggaaacaccggataccatgaggaaaattgagatcatcacccagggattctgtattctacttagggaataggctaaacatcaaaatacagcaatttgagacaaaggcaggcggtagtcccagaagggtaggtgtcaaatccccaagagcatcggcggatccaggttcctgttgtgttactatcctgccttcctaagggtcagacaggctctcaagcaacccccatgaccacaagttgtgcacatcctttcccagctcctctcacctaccattggcaagaactcagtagtggaacacctggggtctcttaatgaggtgtgcttgtgtgactaaaagaaaaagaaattttgggggaggagcaggctggtggatgtgcagtttctaaattatcttgtattttatttgattacagtgtttgaattcagtgttttgaagagatgtatgtagcactgcaagctctattctaacctactttctttggagaagcaggtacatgctgtgttgtgtcagcttagagagccccttcaaaacctctccatgttcaatgtggagggactgtcactatacatgcatggcacaccacaccaagaacagagggctaccagaaaattagaatcccttttatatttgtcacatatcagcatttatttagctgtaaaaataaacagcatatggcatttgttaaaatcgtttgtatttcacacaaatatttggcaatatgtaaactttcttgccagggctgtttattgtggttctatttgcatactaataatggggaaatcagtaatgaccaggtgttggaaggtctgatttctcatttaaatgtattgtttctagcaataaactaattatttttgacatgtttcataaccagaagaatgttattaaccaaagtcataattcctatttttgtgttgatcacacacagatgataagttaattatacttattgaatttaacaacatatataagagataatctcaaatttcaagactctcatttgtgggttaccatctgttttggaccaaagaataggaatttgattgcaagctttcttctgaacagcttgtaataagagctgtttgtatattaattacttattgaattattgtggattttaatgttttaatttacaagcaatttggaacttattgtggtgacagctgctcatattttgatactttatggtatttagcaatttcatcataaggctattttttcccctggtaatttataacccaatcctgaaaacagtaatttggtctctccagctcactataaggagtattgtcctgtttcatccccactgcagatttttttcatagttaaaagtatattttataagcaaaatcaagattcctttgtgcctgcttccctggtgccctttcatttctattcagagttacagatgaatttagtttcactctcattattttacttcagtggtagattttttacaaattgccctggttattactttcatcttgaatatccttatggtttttgttttcaatgtactgtaatgcactttaggggcctgtgaacctgcttgtaggtttttttttaatctccttcctttaaacaacataactataaacatgactcagtgggaataatttgcttgaatttccttaaaacacttgagtttctatataaactccctaataagaaacaccttcactcatagcttcacttgtggacttcaattatattaaacctggtacctttttattatcactgaagactattaaataagaatttagagaaaatggtggacatttaatttccttagttcttgaattcgtagatgatagaggataattgatactctctaggaggcaggaatcattcacaaccaaagaaattttataaggtaaatatcattaggtaaatggtttactgattagtgtttatagtgactgagaaataaaaacaatttttgatataaaggattatcattttatgagccataaacctggcttcctcataaatcagtgcaaatggaacacttgtgaaacagaaatgtctgaagagtaaatgaaaagttgagacgttagtgggtgcctttggttttcttgattttagaggagccggaggagaaaggattctgacccgtttgtgtgtttttatgagcacagtacatgaggatgcatatatgcacacaaatgtgcctggtagagttattggaaagctagcccaagcgatggggaatgtttagctaaagcgtgttgtcttctcccgagggtgtgcacaggttcatgtatcagctgaataaggccctgttccaaaaactgatatttcaagggaaccttaatttatctttaaatttaatgtaatttaaaattaatttaaatctttaaattatctttaaataatagcagtagcaatagctgagctaacattaattttatctattttgagactcttttatttcagaacttctacatgcataatgcctgaccggccacttttaatttctcctttctttcactttgcaaacaaaaccttacaatctgtgctatggactaagacagaaattaagaaccaataaaatgtgttaagttttaattaggaagaagaaaaaacctaaaggaacgggatggttgagaggtaaacacaccccaatgatttttaagtcttttgtttcaaacctttccctttctccctaggctggtccctgcagacggcttcccatttttatgaccggatgctgggaagcctgctggtccacaggtccatacatgaagtcaccataaggtaagcagcccagcatgccattggatccttgcccttgtacctgaaatccgtttgaggagcagaactgcattttcccaaaatggaaccccttctgttttaaatgatgttgtcaggggaagtgcccggtctttctccttactgaaggttgaaggtagtagacagacaatcattaaatcattgcgagctgcatagtcaattccaaatgagaaatttgcctttttactgacttctgagaattttgggttgtgtttttgttttgttttgttttgtttttgtttgtttgttttgagacagagtctttgctctgtcacccaggctggagtgcagtggtgcaatctcggctcactgcaacccccgcctcccaggttcaagcgattctcctgcctcagcctctcaagtagctgggattacaggcacctgccaccacacctggctaatttttaaaatagtttcagtagagacagggtttcaccatgttgtccaggctggtctcgaactgagctcaagtgatccgcccaccttggcttcccaaagtgctgggattacaagtgtgagccattgcatctggcctgccttctgagaattttggatcctgaaggagctataacaaatttttctgggtcttaccaggcgaggatgacaccttctaaaatcaacctctcttgtcaacattatcaattacaattatgcagacaagttaattataattgggtgcatgagtatagattttatttggctcctatatcttaattctatgctttatcagtttcttaatatgatttgtgtctgtctccaaattgatttgctagttaactttgaaacttattagaaaatcatggagattactatgtgtaaatctggtgagatgctaaggtttcctgactagcacaccaaacaattgtatgtgcacaggtgtcaagagttgagaagcccgtagcccaaactaaaactgagacccatgccccaaaagttctgtaaaagttatcttactacctttcggtacgtgtgattttaatttcactttacttaattgttatttaattttctgtttctttctctaatgcctttttagttaaaaaaacaaacaaacaaacctgtagaacttgggcagttttaaagtgtaaagatagaattttgaggaagctttttgatttactattttaagagaaccaactagaactaaaatgatagacttaaatttaattaaaataagcagcttactgtttgaggtacttttgtttaaagccagacatatgcatatgtaggttgttttaacaagttaaatatgtataagtattttaatgaaaggtgtagtctgtttataaaaacaaaatttgtaatgtattagtgaatttgaattttctgactggctttttcactcagtataatgttttcaaggttcgtgtgcattgtggcatgtgtcatttctttttatgtcagaatattccattgtgtggctagaccatggatagaacatatttgattcatgcatcagttgatggaaattggagttgtatttcccttttggttattattaaaaatgatgtcatgaacacacatatacaagtttttttgtgtggacatatgtttcatttctctgtggcatttacttaggagtgggtcatatggtacctctgttgaacattttgaggaactgaatttttccaaagtggctgttacaccagtcaatatttttcgaaatgccattgaaccatattttaaatgtcagagggaagcagggaggggatctttctcttatcaatgttttgagtgggtattagttcagtactttgggaacataagcttcaatttcattgaatccagcacacattggatttctcctctgcgtgaggtatctgtgtttggctttatacctcagtcatttatacatgactgagtgtttttgtagcctttgataacttgtatggtttatacatgcagatagtcatttggcattatcctcaaaaatggtactctattgctgtagttcattagtaaggttgggaataacctacataacatactctttctgcctatgctgcgtgctgcgtctcagaaagtgagggcttctaacggtttccttgaggtgtgtgtggtttcaacacatgtcctcctttcaaaggcatccatcgcagaccctggtgatagtgttttttgtatctcagtcttaaaggggttggtatggttatgaggaatgttcacattcaggggcgttcactgttgaagttctcaggcaggaagattccaagccgagaagggactaggcagtccgttctcggatgtagaggtgggaaaatctgtggtagagcaggaaggactgagagcaggctcagcaagcatgttctgtgatgggcccgatagttaggggcttaggcttcgcgggccaggcggtctgtgcggcagctgctgtactctgccattgcagtgtgaaagcagtgtaggccctacagaaatgtatgaacatggctgagtgccaagaaaaccctatttatagacactgatactgggttgcagtttgctgaccctaacctagaggaacacaactgttttctttccaccttttctaattgtggccttttgagttggaggccacctggaggtgaggctccgagaggcccacccaagggccatgatgtgatgaagacagactctaaattgtgattacgtagcgaaggcactgcagatatttgggggtcaggacttttacgtaaggaatttgagggcctttctgccacataagagggagtggctctgggcctgtgtaactgccctaacttgggttctcaccctgggggagtctccacccccaagataacctgggaatgtgtggagacatgtctggttgtcaccactgggggagtgggtgctactggcatctagtgggtagaggcccgggatgctgtcaaatgtcccgcagttcacaggacatcctccccaacccctaaatgtcaaacgtgaggagattgaggagtcctgctcaccgctgcttctgtcagccctttattttgtacttgttgtcagtcatatggctgtggaattataggctatggggcattaaattacaaaatttagtacctgtgtttgctgacataagtgtaaggatggttggactctgatctaatatttgggttcatgatgcttttagttttttccttttttaaaaacgtctttgtcattcatttaaatataagcctccaaaattgatataggccaggcacggtggctcacactttgtactccctgcactttagaaggccaaagcaggaggatcacttgaggccggaagtttgagaccatcctgggcaacatagtgacacccccatctttacaaaaaaagtaaaaacataataattagccagaggtggtaacacatacctgtagtcccaactgctcaagaggttgaggcaggagaatcacttgggcctgggaggttgagccttcagcaggctatgattgcaccactgcactccagcctgggcaacacagtgagaccctgtcactaaaacaaaacaaaatgctgatataacactaagatttatatgagatccaggccacattgggggatggggcaccgcctgcctttcgaactgtagggtacgcttcagagtttatttttcacaacttcacaggccacatcatatgtgtaggtgaacccactgctgactccatctactgccagaaagagactcatcatggtcaaattaaattcttcatatgtcagtgaaaaatcagtgtcttagagatatcatgaccagagtgcatgtattcctgaaatttgtttgaaggcccggtgcacattgtgtagaaactgtgttcagtctatctaaaagataattaaaatccataaattaatttctggctggaaaataggtcataatggatctggatatcagaagtgctaggttaaagaccacggtcatcaggaaaataggatgagctcctgctccgtggaagcagtagcatcagtgccttccaaggcagtctgctctgaaatcttgggcacgtgcatctgtgttgaactgtggccagaggaggagaggatgaaagggaggcagtgctctttttcttacatgcattgtccggctcatgtgatgtgggtttccctggtagtggcttgctcttgctaggtggagcattttcaagagggcttccttcctgtcaccatagcatctgccgttgacgtgcatgtgggctttggatgaaagccccagccagccactaattaacccagaagggtggcagggcacagaaaggaccttttctgaatgcctcatcatggggattttttcttttcttttctttttttttttttttagatggaggctcgctctgtcatcctggctgcagtgcagtggcacaatcttgggtcgctgcaacctccatttcccaggttcaagtgattctcctgcttcagcctcctgagtagctgggattacaggcgtgcgccacaacgcccagttaatttttttgtatttttagtagacatggggttttgctatgttggccagtctggtctcaaactcctggcctcaagtaatcagcccgcctcagcctcccaaagtgctgggattaacaggcgtgagccaccatgtcccgtcagggatgattttattctgtgaaaagcggcattccttttctaacacaaaacctctcctctgctctgccctcccaaccctgtagcctcatttcctatatagttgttttcatactgattatctctgaagacattgccaggtcgtttttgtttgttttgagacaaggtcttgctctgttacccaggctggagtacagtggcacgatgtcggctcactgcagcctccacctcccagggtcaagcgattgtcgtgcctcagactcccaaatagctgggaatacaggggcatgcctccacacctagctaatttttgtattttttgtagagatgggtttcactgtgttgcccaggctggtctcaaactcctggactcaagtgagcgaccacgcccagccgacattcccaggttttctttacgttttaataaatatgagtagtccatgttcagagtagaaactatacaacgtgtagaaagatacacatgcaattgggagccgtgcttttcccacacagtcccctgtcatggacattgcccctgcctgaaatgctgttttcctggccgcatcttatgccactagtttattccatatttaaatggaggcgtcactgctcggcattggaactctagtaacgaagaaataattctttgattatatttaccatttcagaccattgactccaagtaaataaatataaccgtaaaactaatgggaaattttttactttgcggggaatattttcgtactgaaagtattgtatatctgattgtgggtaaatggagagaagtgtatgaaagaaagcaagcaacataaaatatttttatgcatttctccccaaacttttcctctgtatgtgttttcctacaggtttgggtcaaactgtaaccttgttggccctcttttctgttttgttgtcgccccctgccacccaatttgggacatatcataaatatctttccattaacctagctttgaaatttttaacttgcactggaagaccacagcgtttaatgtcaaacaacgtaactttaaatcctagcttcgctgggatttaagttggttatcttccctaagcctttatttgttaaacctataaaatggtaataagagtaatggtcatatttatctcttggagttatgactggtgagatcgatcgtatcgtgcacatagcactcacacctgatagctagcatacaatccatgccgtgtattggtttctaaaatcatcttcatggcggcctgatagttcccatatgtgttcactgcaatttatttcatcgtgctgtcactggacaatgagattgtttcgagaaccacacattgtcttctttacaattacataggatgaaaagatgtgcaaagtggtaaaacaagcctgtgtcagcccccaaataagctgctccccaggcagatgttagaaaaggtgtattgggatttatatgtaaactttatacatacatttaaaattctgtcttaagctggttactgattgtgaaatgaaaataaactcagtttacatctgagcagagaaaagagccgctgcctccaaatgggcagagtttgctcgtttccatgaagcaacttggagaaagaggtgccctttagaggctgaggtcagttcaagcagatcttccagtgaccctggctcggtccagtctgcatggagacaagccccaaagacctgagccttgtccaggccatccctccaagcaatggattcttccagcacagacgccaacagcctgactaatagcagcctaactaatgacactcactttctcaggtgccttcagaaaccaagggctgctttagaagatctttaagatgtttacataacagggcaaatggctgaaagataaagcttcccctccagtgatgtcagaggagctctgtgcgctgcccttcctacaatacacgcccccttcatcagctcgtgcttccttcgctgtttcagaacacggctggcctcttggcaagaaacgaacttgccctttctgtccttaactaccagcaccagctctccagcaggccccatgtgattctactttttaagataattaaaacagcaattaagattttgtttggggccagtgttctcccacagaatgatggcatattgagtgctctaactacatactcaatgaaatgaaactcttaaacagccatttctcctgggaccgaatgctgaactgttttgtgaagggaactgcgaattaataggacttttggccaccttgaaaccaaggcttaaaaaaaaatactataaataatctccccttcagcttcttgacggctctaaaccccaaattatcacttatattgaattacttatctttagcagagaaacttcaaaaatgccatcagcccatgctcgtttgttcttctttgccttctttaagcagcacagtgagagaatgttgtggctttaacccaaagtggaaggtggttatttcgtttttgcgcaatcacaactccaaacacctcaaatcaacctaattgaaggtgtctttaatcaaagctgggtcaggcaagaaaataaacacagttgctctaattaagactcccctctcatccccctcctgtttggggccaaggaggagctgtgagtgctgccaaaactctcctttattttagaactggagaaattggaaaacatccacaggagttctcagaactcgaaggctggaagcggatgctgttcgggaaaccggttaggtgttagaatgcggcttgtgtctccagctgtacatactagaaaagaatgcccaaacacaggcctctggtggtagttctttttggttgggctttatgtgtgccaccttgcctgcttgacattgctgatgagccaggacgaggagtcgagccctgagtggtcatgggcgaggcaggtgtgtgtttccctgatcctctcctactgacctttcaggtctctcttggggaattgctggaggagctaaaataccagctcccacatactggatattttctgtgcatcgggctctgcataaaagcattgactcctcacactctcccctttacataggggctatttgatactcagtttagagataaggaaacagccatataactgaccctccaatcccagggctagatagtggtgcagctgcccctagaagtcagggtctctggcgcttggccaaaggctccctgaatcccacatctttacctgttctctgtggctctcaggacgtgagctaccttatctctagccaataagcctatacggatggggactctcaccctgatttaccctaactttattgtaataaagtcataactgtcataagaagtaatagttgcaataaaaagtagtaattgtaataaagcatgaacattccaaactccatgttatttgtccacaaaaatagttcttggcacagaagacaaaggcggactttttcccacagaatacatagctgtcgatggcactttgctttgaaccttggtgtagagggcagtcctcatgccctgggctgaggggtgcatgtgacacatcattaaaagtcaaaaatcattttcatagagcaggtcctccccacatgtacacccagagctcctgtgcttctctcctctttctctgacttcttccaaaatcgtgggtcttgtctccatcagtcaagaatttaacttttcttccaaaacatccccctcctcttctgtgaaggaaggtgcttgtggactggccttaggaaatgtcgcccagacaggaacggcacaccagtgtgccatcactcaagccagaaatgaggtttgcagtgaccttctctgtgcttgagagttctgctacactacgaataccactataataacagcacatttatttgtgggaaattaaacagcaaagccctgggtgggagatccataatttaccatcttcctgtgaaatttagttctggtcttagaaaaaagaggaggaggaggaatttttattcccagccttgtgtgtggtgaggtttgtctggaacagtggttcttgcagaggaatactggccaggagactcacttgagtcaaaaaactgaagaagatccatgaaaacaaccaccaccttcaagtgagccacttagagataagcgcagctaaacgccgggacacccagctgatggatggtttctcttgattttggtgtgatgaagcccacagagctgaagggcattaaatacagctgttagggttaggagtccattcagagaatattctcatgcttgtatctaataatctaagaatatatatgtagattctacaatttttggaattaggttttaaaagaaaaataatcatttaaaagctagcaaagtaagtgtttgttgggggagaaaagtttgatccaaatattaaatcagtcttaaaaaattaaaatatgtacttgagatggagcagtcagtcttaccaaacattacatcctggctcgattgcaggccatggatagtttttgttttgttttctcttctgcttagaaatcaaaaccctttagaaagttaacaatgtattggggaaagcattccaatccttggaccctaacttatacatttaaaaacaatgaatctgtgatcagaaagcagaaagccagagctgaagcagaagtttttctagttggaagaaagaaagatgtataatgcaaattagaggaacagataattaaaaatggcccgtaatccccatctcctcaggatcttatattctcattctccatagttctatataaacacatgcagagacacctgtatttatcacagatgctcctggggtggggaatattaaccaggctgtgtatacaggtgtttcatctccacgaatcagagtatctgctcttattttgaggcaagatctcactctgtcacccaagatctcactccactcactggagtgcagtggcataatcatggctcactgcagcctcagcctcctgggctcaagcaaacctcttgccttagcctcctgagtagctaagaccacaggcatgtgctaccatactttgctaatttttaaaatttttttgtagagagggcatctccctatgttgccaaggctggcctctaactcctaagctgaagcaatcctcccatctcagcctcttagagtgctgggattacaggcatgagccattgcgcccagctggtaccttttcagtggtcaggtcaccaagcagcgtctgagcctgcaccagttgccttactttataaatggagttcatttcaaacacaaaatgcttattttccctctaaagagcaatggttctcggccagctgcagttttgcaatgtgggacatttggcaatgtgtgcaggcatttttggttgtcaccactgcaaggaggttgggggagtccaaggatgctgcagaacatcgtgctgtgcctggaacaggcttgcttttttttttcccccagagtaaaagaggaaaggagctaggcatggcaaacaagaagggcagctgggaagctggggtgtttgccaggtcctgccagacatagtttcctctctgtgcctcagtttcctcatctgtaacatgcagagatgagatgccctccaagattggtcctttccagctgccctcactgggagggggcaccgtgccctgcctcccaggctgactcgtcctttgtaattctcttcctttccacgggactccagattcatgccggtcccactagccctgttgccctgttcctaagcctgtccagaaatccttgggactaagtgaggctgaagctatagcgctctgctcttcctacctttttaagaggtcttacattgtaaaacttcaatttttcaaacactcactggctcacagaagaaaataaaataaaaagctgcaattgtgaaaatgtaattgctcaactttagctcatgctccagatcagtgattttctcttttagccaaacttctttataattatttcctttatttttataatagattcttcaaaattaatttcaaaattccttatctaccgtctttcacaaatgtatgtatagcctagagaattttggtaataattttgtgatacatttatattgggatttgtagctgccagcctttttttttttttttttttttttttttttttttttgagaaagggtctcacttccgttgcccaggctggagtgcagtggtgatcgcggctcactgcagcctcgacttcccaggctcagatgattctcccacctcagtctcctgagtagctgggactacaggcgtgcaccaccacactcagctagttttttcgtttgtttgttttgttttgtttttgtagagacagagttttgctgtgttgcccaggcaggtctcaaactcctgggctcaagcgatccgcctgcctcggcctcccaaattgctgggatgataggtgtgtgccactgtgcccggcccaagccattttttcagtccattctttttgctcctcctagtaacccttcgtagcaaccagccttccattgttcagtcaccagaagttaatgatagaaaaccagagatttctagctgtgcaagatgtagagagaaacctaaactctatacatttgctattggcactgtgttgccatagtcactgcagcactcagcatcaccaaaagcctgcccagtgctgcaacattctttagatagatttttgttgttttattttgtctccttaaataatatttaatttttcattaggtcatgctatgatttcatagcttattttgtctctaatattttcttctgcatgctgtcttttgagagacctctccagagttcaagcacaaatcctaggacagacttgtattttgactgtcaaattttcattgcagtatgtgcaaaagtacagaaatgtcatcaaattaagcaaagaagataagaatttttgaatggcagtgttctggcaactataaaataaagtctattaagagtgcaaagtgagaggtggaatgtcgccagggcagctgcattcattatctcttgctggataacagacgaccacacgtttagcagcttgaaacaacacacattcattctctcaccgtggctgcgggtcacgggtccaggcacagcacagctggggccagtgctcagcgtcccacaaggcttggtccgggtgtcagccaggctgcgctctcctttaagctcaggggttttcttccaagcacaggttgttggtagaattcagttcctgtggctgcaggactgagaccctcagctccctgcaggctgcctgccattgcctggacagatcatgcaatgtggtgttaataatcacaggagagaaatgtggtcaaccttgccatgtaatgtaacctaacctagggagtggtgccccatctccttgacgcattctggaagcaagtgacagatcttgcccatactcaagggtcgggagtataccagggcaggactttgtgggggtaaggtatgtccctggcagtaaccattactttgaatcctcccattaaatgtaaaatatcttccaacttgaacatatactttgtacttttctccccctaaacaaacaaaaactcaatcctcattcaacaatgaaagttttgctgcctgtaaagatacttgcaaatgtgtgatatagacaccaaagacagttcccaaacagcctaaagatgtttagtgctggccgggcgtggcggctcacgcctgaaatcccaccactttggaagtctgaggcaggtggatcgcttgagttcagaagctgaacaccagcctgggtaaaaccttgtctctacaaaaagaaccaaaaaattagctgggcgtgctgatgcccacctttggtcacagctacccgggaggctgaggtgagaggattgcttgagcccgggaggtggaggttgcagtaagcccagatcatgccactgctctccagcctgggcaacactgcaagactctgtctcaaaaaaaaaaaaaaaagaaagaaagaaaaaaagaggccaggtgtggtggctcacgcccgtaatcccagcactttgggaggctgaggcgggtgggtcacgaggtcaggagatcgagaccatcctggccaacatggtgaaaccccgtctctacaaaaaatacaaaaattagccgggcgtattggcgggcgcctgtagtcccagctactcgggaggctgaggcaggagaatcccttgaacccaggaggcggaggatgcagtgagctgagatcgcaccactgcactccggcctggcaacagagcgagactccgtctcaaaagaaaaaagatgtttagtgttggtgacatcattgacgttagttgcagcctttctggggctgcccagctgtttggagtgagcagctcttactgatgtatgaattctggtttgttcatggacaacagagttctttccttgcttgttccctttgggctggtttgctcttgtgtctaaccgggtggtgtctaagaaaaccagactctgtcttggctgtctcacacagaagcccctgaacgttttcctgcccatcctccctccccagatttctgcctgccttctgggcaccagaagtcttagccagacggatgcagcggattctgtggtgaaacacaaatgacagaggtgctccctgccttctgtgttctggttttccaccaggagccctggcctccttgcagaaacatcgaggtgacatgtagcatgaccgagctcgctggcgcctcttcatcgtgctgccaccgccctgcaggaagaggggccatgcagtcagtcttgcaccactttcaacgtttgcgagggagaggtactgcggttcctcatgtggccaggaccgtgtggtcactctttgggggtgttgacatggccgcgggtgtactcggtcacctctccatgtgtccagaaaagtgctcagtgttgaatccctccacgtctgcctgagtgcactttgggattccattcctgccgcttatggggcgcgctgcggatccctgcatgcacagagctttattgaacgcaaagtcagttgtttgttgtcgtgctctgttgcccctgcttctggcttcattcatgtggtttttgctcaattcttccccggccttaggaaataggccaactcttgtttttttggaaaacatttcacctgggcatatttttctatctataattacggaatttttatgtaatcacataattataaaatataacacaatcagatattaattaccttcatgtgtataatagcatggatattattttctttagtcatctcaaaaaaaaaaaagagaaaaatacaagcagtgtttcaaaactctcttctctttttgaacagagggtggttcccacttcatcaacacctcatcgccgcgaggtgaggctaagatgagcataaccagtgacgaggtgaactttctggtgtatcggtatctccaggagtcaggtaagaggcttggttttctgtcggtaggaaattcatctacagcatcttacaagcagaaggatcaacgcttaattcaaaaccaggctgtagaagaagaagaagaagagctaagaaggttcttagtgctgatggggagaagagaaggttctggagctgtgccatccccgggtggaaagagggaatgtgttctttcttcccttgacacttctgtgcagatgaatcaggcaggaatcaagagcggttgtggtgaatgtggaaaggacggaagcagtgcggggctcttggcctccacctcggcgagggcatgcatgagctggtgtgtgtgtttgaacctcttcgattttgctccagagatttattcagctccccagcctcccctactccccgccccctaaatgggctgctaggcaattttctaaaacttaggaatcgtcgtagcatcttccaacatttttgattaccactgagacattactttatggttagtaagtaaacagccaatcacatgtgttcgttgttgacaagacagactttgagctgagcagctgccctcctccgccagcagggaagtagtgggaagaagccacggagcccagggcttgggttctaacttagaagatatgtaatttaagacctacaaaatgatattggtgaaaaacgtcctgatacccacctacctgttcaacttaaacaaacctctcaggtgcattggaaaccccgcccatgtttgcctccccgccttcctcgatgatgatgaccctggtggacttgctgtttgttatctccacgtgtttattacacacagccgttttcctaagcgacatacggtgcaggtggattcgtttcctagggctgctataatgacgtaccgcaaactggggtggcttaaaaagaaatatgttgtctcctagttcctgaggacagaagtccaagatgaaggtgtaggcgggtcggttccttctgaggggaagtctctcctgtgcccctgcctggctcctggggccttgctgcagtctttgaactccttggctcgtaggcacatcaccctcatctctgtgttcagatttgtccacatttccccacggtaaagacagattggattcggaatttaccctcctccaagacaatctcattttaactattgtttttgaatacagcaataattacatctgcagtgaccctgtttctaaatagtgtcacattctgaggtgcgctgttggtgaacactgcaacctgtgaatttgtggaggagggggcacacttcaactcataacagtcggtttgggattttaagttgggttttaagcttcgtgcccttgatatcagattgtatatattctggaacttgattatttgaaaaggaaaccccagttcctaggccccgtcctcccagagatgcatgtattcgattggagggaaaaccagtctacgatcctctaggcttgagttctctcacagctggcctggtagggtagactgtacgcattggagccacacagaatggctcgagctctgatcctcgaacaagtctgagtgaggcctgttcatttgagcctgggtttccttgcccaggcaaatgtgctcaaatacgtcaggcacgtagcacattgtaagtgcgtgccttccccatccaagcctgggtctctgtcccttgcgctcccagctagtgttattcatggaaagtacacattcttttctgcatatatattagatgcctgtgattggctgttgccagaacatagtataggaagttggtatacaaaacaaaatatgtactgcctcactctggaaatcagggaaatgataaccgctctgctaatacctcaacctcggctcttagaggagcacaggtgatctcctgcctcagagcccatagctttccagaggtgcctgcaaatggaaatccatgtaccaaaccctgcttccctgtcgacttgtggcatggaatttgagattctttccatttagcaacacctctgcacaaggacacgatgaaggccaaagagactcacagctcttgtgtaaacaagtcccaggctggaactgtccggtgtgaaggaccacgtgctccggtaacctggagacagagccatgctgctggctggtccccagggggccacggagcatgagctttgctggcttcttgaaataaacacagaaacccccatccctccccagaaaggtcggcttccttattcagtgtttgtttatgaagcttctgtaaccaggcagctgagagggagagttggagcacaacaatgcatagaccttggcaaatgtcaactttgtgtaacatctgtgagctccattcctgattcatcagtgtcactgaagtataataacacttcttaggcagagttgatattgaagagagagactattacaccttcttcagctcactgtgtgtattgtggaactttttagagcaccctacaaggttgtattcaaaggaagaagggagcaaagaaatacttaatgttgaaatgttcattctggggttattttctatgttcgtctcaagtcctaaagttttggttaggtcaatagtcattgagcccccatcaagaaagcacaccttctcagcctatcgctgtctcccttctaccttaaataaaaaggaaaacatttccctgatcatgcttcctcctcaagcacctgtactcttactcctgcaccccaccaaactcattaaaaacaggttctgcatctcagaagatgattcattcctcagctccctccactctggctttctccactagaagttgtcagtaaattctgggttcccagatccactgatcttactgcaactggcattcctccttccctggtcatccctccttacctgtgtgtggcaggaagcgggtgggggtgggcagtgaggcagggagtaggtgtttccctgcagtgcggcaggacagctgcttccctggaaggtctgctggaacactcaaccccaccttccaggtacagtgacggacaagttttccagagtcaccaagcatgtggcctgagccctgcttctctgccctggacccagcagaccaggttgccgctcctgtccatccattcatctccttcaccagtgcctctcttcctcccctctgccagtatccatggtgtcagttaggatgtattaggctgcaaggaggaatcttcagtggagcactgatggcctcagacagccgggaagcagggtgttgaagaaggatccaagacacatctcttcaaactcggaaaagaacctcaaaaacagatgtgttttgttctctgcccacaacaggcagaagtcaggtcatctggcttttagcaaaccacatatatttccctacctgtgtggattagtggattttcattgttgcccttgttacttgtccaaagcaagggctttgcccatcagaagcactcaatagctgttacccacaggcgacatctcatagcagcagactcatggcagtctgaaagaggaaactggttaaagcaagaatgttaagtagtagggaacttttgcattaccaagctctagtgccaaaatggatttgttggtttttgcatgagttcagcagtctggctttgacgagtgatatggtttggccatatctcatcttgaattgtagctcccgtaattcccacatgtcatggggagggacccagtgggaagtaaatgaatcatgggagcaggttttcccgtgctgttctcgtgaaaagtgaataggtctcacgagacctgatggttgtataaaggggagttcccttgcacaccttctctttcctgcagccatgtaagatgtgactttgttcctcattcaccttctgccatgattgtgaggcctccccagccatgtggaactgtgagtccattaaacctctttcctttgtaaattacccagtctcaggtatgtctgtattagcagcatgataatggactaatacagtgtgtgagtccattggcctctgtcttacgggatccattgcctggtcacttgtgctatctgggcagtttttaagaatcacatggtggccatgtgcctttcccgtgagctcgtgttaccatcccaggaggagagaagcaagggagcgagcccctagaaatgtgcacagcctgcacctgctgtagtgagcagctcccccaaatgctgggggagtcgtgagttgtgtgcccccgcatatttctgaatacagccagggaagtggaagtccattttccacttagtatggaaagagagaaaatttggcaagtgagtccctgtaaacatattatttcctctgggacttcatcccaaaatccaaactataaagaaaacatgttctcccagacccacatttttggcataaattaaataattcacaggaacttgcaaaacggtatgaggaatacagggggacagaaccacagattcaaactgaatttaactgagaaagagctgcctgcaagataatcgggtgatacattcaggggaaagggaggtactatgaaaaattttgttttttgagactcactcatgctgagggtctcactctgttgcccaggctggagtgcagtggcacgatcacggctcactgcagcctctacctcccaagctcaattgatcgtcccacctcagtcgcccaagcagctgggactataggcttgtgccacaagaaattatgcccagctaatttcttattttctgttttattttatttgtagagacagggtctcactgtgttgcccaatctggtctcaaactcctgggttcaagagatcctcccccccggcctcataaagtgctggcattacaggcatgagccactgcgttacctggccaaaaatattttttaaagaagtagaagatactgtctgaagaggaaagaaggaaggaatgcgcggagctggcttgagcatagtcaacacacaggacagttctgtcaccctcaaaattgccttgtatccctttgtactcagctcctcttccacccccaccctgccccggcaaccaccactgctctgtccctagagttttgcccttgcaagaatggcatagagatggcatcacatattgtgtggtcctgagagtgtgacgtctttcactcaaccttatgcatttgagattcatgcatgctgttgtgtgcaccagccattcattcttgaatagctaagtggtgttccattttgaatgctgtttctgcgatttgtttatgcatcctcttgtggagggacatttgcgttctttccaggttttggtgattccaacataaagctacaaaaaagattttcatacaggtcatttgtatgaacgcaggttttcatttctcttgggtaaatatcttggagtggggttgctgggtcgtgtgacaagtgtaggtttcactttaccagaaaccagtgcattcttttccatctaaggcagaggcaggacacgtcgtaaacatgactggttttatagacgtgagttgagtcacagaactcctctgcctgtcgcacaaggcatactggaaagtatgtaaagggacgttagctctggcgtatatatctgcaggacgctcatgaagtgtgattcttcctttgaggatttgcagctagccttctggactaatttcatgaacctgtcagggtcacagtttccatgggccgacatgaatgtagcccaggtcggctgaatgacagagcgtccttgtttgcataccttcccctccttaagcagtgccgttggtctaaccttctgcttaaaaatagaaaactctatacagcctcatcagccctccggtggataagcccaggcatctgggcaaggcaaaggccaggcttccagatagcaggattccgcaggctgggccctgtggcggccacgaaagctctctgtgcatttgcccacatacccatggtatcaaagtcatcgaaaacccagcgaagtatttccctacctggagctttgtgactgacgtccacacaccaccaggaacaggcagacaagttaataaaaaccatgtgatgatggtggtggcgacagtactgaagaaaaagaaacacaagtagaaatggaatttcactaacgttgtgtccggcacagggatgttaccaagttccgtgtccatgacggcagtaattttaaacactgtagctactaaaaggagcttgtcaccataataaatggtaaaaatccacttctcacacacgctgaattcccagagtgaggaacttctggcttagctctaaagatttaaagaccctagaggatggttgaaatctccttattcagtggaacttatgttctgatttgccctgattcgtagctgagaggccaatttattatacatttttcttgcctccattaacgtcaccaaacatgggttattcagagtgagagtatcactagttatcaaaagtgagcatctacactctgggcactcttgttttcctaaagagcccatttctgcacacctgactagctgggtagaagtaggcatgcttcttttatttacataacgtatatatggctctgtgttatatgtcatccttgctcataaggaggatagttgctatggtcccaatgtttctgttcccccgaattcctatgttgaaatcctaacccccaaggggatggtatttgggggtggggcctttaggaggtgatgaagtcatgaggagagctcctttgccccttctaccatgtgggaacacggtgagaaggcaccatctatgaatcgggaagcgggttctcaccagacacccaatctgccacatgttgatcgtggactcccagcctccagaactgtgaaacacacatgttgtttataagccacctactctatgtattttggtagagcagcccgaacagagtaagataatagtgaagtagtacatccacatgcccagactttcagggttgtgaatataacttagtgacatttgtcattcatttcgtgaagcttccatgccaagaaaatcattaataagaaagatttctacccagtgtggaggcccacgcctataatcccagcactttgggaggttgaggtgggtggattgctttgagcccaggagttcaagaccaacctgggcaataaatacaaaaattagccgggtgtggtggttcatgcctgtagtcccaactactcaggaggctgaggcgggaggactgcctgagcctgggaggtcaaggctgcagtgagccataattgtgctattgcactccagagtgggtgacagagtgagaccctgtctgaaaaaaaaagaaagagtcttgctgggtgacacacttcacctgcagtgcttctctctggtggcgatgccattcaggtgagttagcctcagaggagtgcatggaagagtgagtgagacctcagcggcctcctctttccacaacaaacccaagcacagagataaaaggctgtgctgagcgcccaccaacacgcagcgaggttatactgtccaaaaagagtacctggcagatgacccagcaagttcacagcgggtaagctggcgtgggtctcggttagagtgaggtggagcggaggggaaggttccctgttcttcaacactttctacagaaacataagactgagggtgaagtgagatcccctctgaaaaagcaccaggtgtcttgtgggggcctgatgctgagggatgggttgtagctcatgccctgtagaagagaacactgttcaaagccaaccagtctggattcaagaggggtcctgggagcttcagtctgtccgtgaaagaagcacttccctgaggcttccctgtgttccaatgcccttcatatcctaggcctctgaacagggtgctgtcagtcgagtgggattcatcatcctcaagtttttgccggagtggaggccaggctgtgtgctgggctgatctcctcctgttgcatctgtgagctgctgttgtgaggacagtggcttgagagagctgaacagaaagacatgccccctccttccaagactgacctcacactttaggggagcagtacagtgtcctttagaacacctcagcggaagcaacccagatgtccattgacagaggaaattccatcaacagaacgtgtccatccatacagtggaatatcatgactcagctttgaaaaggaaggaaattctgacacaggctccagcacggatgacacttgaagacactatgccaagtgaaattagccagccacaaaaggcaaatactgtaggattccacttagaagggatacctcgaggagtctaatccaaaaagacaggcagtggaagggtggttgctgggggatggggagaagcaggggacgtggagttgctatttaatgggtacagtttccattttgcaaaatgaataacgttctggggatggttgatggtgatggttgcacagtagtgtgaatgcacctaatgccactgaactgtgcacttaaaaatggttaagatggaggccaaggtgggaggatcactggaggccaggagtttaagacaagcttggacaacgtagcaagaccctgtctcaataacaaaaaaaattttcaaaaattagccaggcatgggctcacacctgcagtcccagctattcagaaggctgaggtggggggatcacttgaggctgggaggtgaaggctgcagtgagttatgatcacaccattgcattccagcctggacaaaagagtgagaccctgtctcttaaaaattttttttaaaaatggttagcatgatatattttatgttatatatattttaccacgattttagggggaggtcatggtattataggtgagaagttccatgtgtagattgtttttcagagtttagaaaattagtctcaaagggaagagagaaccacctgtattcacagtaatattaatattactaatattacatgataagggctttttcatagtcccatataagtgtttggggcaaatccctggcacagctagtatcatttgtaagctacattggtgtctgacaaaatccagttatttaaaaaacagaaaacagtggcttatttataatagcaatattctggacatatggccagtgtccatcagtgggcgtagttgaagcaagctgtggcatgcctgtgccgtggagcaccactcagctgtgaaaaggaaggagttgtgggtaggcacagcaagctggaggaacccccagagaaatgtgccgagtagaacaggccacgtcagaagattgcagactgggccaggtgcggtggctcatgcctgtaatcccggcactttaggaagcctaggtgggcagatcacttgagatcaggagtttgagaccagcctggccaatatggtgaaaccccatctctactaaaaatacaaaaaaattagccaggcgtggtggcacatgccagtagtcccagctactctggaggctgaggcaggagaaacgctggaacccaggaggtggaggttgctgtgagccgaaattgcacagctgcactccagcctgggcgacagagcgagattctgtctcaaaaaaaaaaaaaaaaaaaaggaagaagattgcagactatatgattccatttataggacctgcttaaagtgctgaaaatatacaggtggacaccagatcagtggctgctacagatctggagtagggatgggagcacgtgcgtacaaaggaaggttataggagagttcttttgtgttgaatgaagagtttggtaccttgaccagagacacagttccacagatctacacgtaggatcaaactgcatagattatacgtacacaaccagtgaatgcagtgcagaaaggatgacgatagtttgtgttccagtgagcatttccgtcctgcctcctacttagtggtgttgatcctctttgacagtagtgtaagatgcctagatgggaggagacaggatgaaaggtgcacagcacttcactagttttgcagtttcccctgagtccatagtaattgcagaattatttaattgtaaaaaagactataccaaaaatgtaattcaatgtttctattgtctgcaaagctttgtgtgtgtgatagatggtggtccataatgcaaaggcagccaagacatttttattatatttcgcaggtcattagccatattgcaggcctagggctgggtgggggtactctcttgtgtaatggattcgagtggcagccctattaactgagaaatggatggccacacagacactgtggggccgttggaaacagaagaatcagctggaagcaaacagcatttgtcatacggacattgcttgaatgtttgcagactggggactgtcgtttctgggtgggctgcatttttactgggggaaaaagtcggtgcatggcttcttccctgctcatttaccagtgagtcttagaatgcttttacaatatccacttagaaccttcagtgtggaggattctgttagatttatgtgttcagcctgagagaagtgggcagatttgagggtcttaacttctgaagatgttgtgaatggccacaacatataatgcattaactcaacattttcagcccattcattgagatcagggtttcttggccttggcactattgacaatggcggctggattgttcttcatcttggggggactgtcctgaatactataggatgttcagcagcatccctaacatttgcccactctctattacaatggagagagagtgggaagacatttgtcaaatgtcccctggtgggtaaaatcaatgtcagttaagaagcactgattcatatcctttagttgtaggatttttttttccttccaactggtttttcttgggaaatggagttttaatggcattctgatttctttgcccttcatcttgtgttctccttgggcttcattttgattcccttacctgcagaactcaaatagacgttcacggcaagcaaaatgcagtccttgttattattaaaattttgcaggtattttttcccttgaggaaggagaaagtctgccaaaagcattctctggcagataataaaataattgagagtagcagactttccatttgatttttcttttttggcttggctcctggtgagtaagttagttaacccggaaaagggtgttactgaaactgcctttgcaaatattgtaacggaagaaattatgacagtgagagaaatctgacatggctgactccatcttgtctctagcttcacaggctggctgtctttgctcattcctggttaaaatcaacttaattaaaaactgatattcaagctatatatatatatatatatatatatatatatatatatatatatatatataaaaggccttggtgctttttcgcttcttggatcttgtttaagaaaaatttttctttgtttttcttcttagtcagctgaattatttccccagtctgttttcttgccactcttgatgcccacatgagaggacctaaagtaatttctgacagcccgggactccttgggaaaaacacaggaggtgccacataccctgttttgagaaaaacctacgttttcctcatggaaccccaggaattgaaggaggctagatccctctcaaaatctaaggctctgttccgtgttacctgatgtattttgactttgggaggtatcagaaattactttgcaggaagaagagcttttagcctgtgtgtgtaataactaggtaggaaatatactttaagggatggctaatggagttatggaaggatactcagctctttgcacttttggattagagaagcatgctgtcagccacctagaaggtatggaaatatttctaccccacactgagagatgagactcccttgggggatgggctgattggctttggattgccttgcagtggaatgcagggtaaaagcattgcactctcttctcccattgcattcccctctttttggggatccaagatgtcatataaaaatgggacccttaatttgggggatctgtttttgccttccagctatgcctgcttattaggccctagaaactacatgctctcctggctctgtttctataagggctccaccctgaagccagtaatccaatgaagaaacttaaaaattgaaagataaaaaaatcatataactaccggatccccttctgtctgtgtatttatatgtgttgtgtgtgtgatgtttatataaaacatgttaatgttcctattagttgacttttaaagaaaaaaagtgctaaaaaaaaattgtcagaaaaatagaaacattaatgcatttaggtcacgtgactctaatctttgaaaaataaaggcaatttaaaatattattggtaaagtaaaatgtcttcaacatttatacatttggtctaaattaggcaggtcagatactgtttgctagatgctttaagcccataaactgcttctgtgatttttaataattgtttgacttgtctgttttacagccattggattctagataaggcctggggacacgtggaattagccaggtgccctagctaggctgggaagagtcagacattgtctgcagctctgtctttgtcctgggctctataatctaatacatggttaaaattgcttacctatcagatattacaccacaaattaaagctactgagaattaacattgtaatatactggagaaacaattttacttataaggtatacaaggaaaatagaatgtatttttggtaaaatgttataagaaggtatggaaatacggtttttgttaaagggaaggtaatgttgtctagttcaggggattttaaggatcgtcttaacctaaaagagcgataagacaaaactgcaagtttaaacaagcgggaggatcacaaggtcaggagatggagaccatcctggctaacatggtgaaacctcgcctctactaaaaatacaaaaattagctgggcgtggtggcgggcgcctgtagttccagctacttgggaggctgaggcaggagaatggtgtgaacccgggaggaggagcttgcagtgagctgagatcggccactgcactccagcctgggtgacagagcgagactccgttcccccctacccccaaaaagaacaagctataaagggtttgtgaaggattgatcttgtaaaggaagttctgtgtgtatgaggaagttggctaagatttgaaggagattatttcagtttttggtaaattaaacattaaaataaaagcacactgatacagggctcaaatctgggcccatgtgtctgaataatggttttcttaggaaattaatcagctgtttaacagaaaattataaagggttttaaaaggtttttgaaaattttacctgatggtcaaacgaattaagattatatagatttgtttataaggttttattaagaattgggtttaacattaatagtacacaaatgcaaaggtgaaattttgctttttcttttaaacaagattttcgtgtaatattaagggatacaaaaggtttttgtttgcccctttgagtaaatggcagggaaaaggaagaggggaaaggaaagagattcagttggcttcatgctgtcttcattgggtcctgttgtttggaaagctgaggctcctatcaaagtaaagattttttccttcgtaaaatttttgagttatcattttggctaaatgaatgacttaggtatggtgacctgggattctattttgtaatatctaatgttttaaacctttgatatttgacaaacttgccaagatcaaattctaggttatgttttaaaaaaaaattaggacacctaaagtccaaaagagatatatttggcttattcaatatattaaaaccatgcaggaagcattgtcaaatataaaatggtgtttaactttctttgggttatattcatataaatatgttattagtatgtgttacaaacttgtgtaagattcctataattctgatgtttcagtgtatgttatcattaataattataattgttatgttaaattgttgtgtgtcacagagacgaccagaattccttgttgattgcatctttatggctgtcctgagacttgtgtcatccatagacaattattgtcttgtgttgctccttttcagaaggcagttgttatattcagctataggactctgacaggtactcttgaatgcgggtctctgataagtttagaaattgtgccattggaataggaaaaaaaaaaaaaaacttttgggactctcgtggagagctgatgtgttaaacattgctaatccctttgttattcagaatcaagaaaatgttttctttttagctgtttaccacttttagcaattgaataagataaacttgtgcaaaatttactgtgagcaaaatttggagcatgttactttttctctacctgatttctgcagaatttatagaaactatttgagtattctcaacttatggcagtatagttatttgcataagtgcagtaagaatctgttctcttttgtaacagaacagaattagaaacactggttattttaccaaggctttgactggaatggcatgcattcaaatataaacagactgctttaaggaatcaaagttgacttacagagccaacaaaagcccctcaggaaaacgcctcataccttgtgcggtttctgtacagggttcctgacttgtggtaagtaaagaatgtcattttctggcgggcctagggagccccaagttatcttgagaccttgggtggaggaaagagcctattatggcaaataattcttcttgctgcactttatacaaataatcagtccaagcataataagactaagacttattttgcaagtaaatttgtcttactatgatttgtctttaataaaaatggggactagagagagaaaaattatgtttcaaaaaactataaacttcttgagttttcattatcttctgttaacactgaattctttgtgggctacaagtccccaaactaatgctttcaaatttttcttccacttttctaacttggactcagtaaaatgctactaccttgttcctgaggccctgcaagctgaagcttattcctcgtaatataggcgacaaaaacgtttcagattttcactgcctgcctcatctataacgaaagaggcctaacccacctgcattgccacctcctgatatgggaaacagctgtttaattaaacatctagtctcaggactaggaaactgacctaaaaagaatatgggatgatatatgtaaaatgtgttctttcctgtccatcccaatctgtctgtctaacaaccactggcccaaatctctctgctagccgccccatgtctgattggttctcagagatgttcacctgggtccctcagagcttaaggtccagtctacaaaggcttcggaagctaggacttccactctttatcctaggaccttatagctcactgttcacttcaatgctgtgccaaaactacagatgaccatcctaatgcctttgtcatgcaagccctgaaaccccaaccaggcacatgtgagtacatgcagacagctgcaaaggggttccactccttttaccttggggtctgcagctacacccactatgcccactgtcagcaggaagaagttagggcagtcgtctcttctttttccatcttcatagcccacaccttaagaataaggtgttataaaacccaaagggagggattgaaaccacctttgcaaaaattataactgagaacatgttgacagtgagagaaaactgacctggctgactgtcttgcttctagctcacaggttgactgtctttgctcattcctggccaagctaacctgggggaaaaatttagtttatagtttcaatgataatagtccttcccccaaactaaatgttgttgtaaaactaatgaaaggctaccaaattaggatgagaggggcttgaattctaaataatttaccattatgccattatgccataataatttgccattatgccggcagtcaagatttgcatcttccccttgaagatagcatcactgttgtagaacctaagattggcctttgagatgtcttttcaggtgttcgcatttctgacaaccagattgccccacttggacctgcgaacaaccggtcctgtggccccccctactgaggaatgactcagcataagaggacagctacaattccctatgatttcatctccaacccaaccagtcaggatgctccctaccccaccccactgctcaccaaactatctttaaaaaccctaatctctaagccttcggagagacttgatttgagtactaataaaactccagtctcccgtacagccggctctgcatgaattaaactctttattacaattcccctgtcttgataaatcagctctgtctaggcagcaggcaaggggaatccattgggtggttacattactcttaatatttgtgaataattgcatctacaaaaatgattaagtggctttgcccactgtaatcctagcagctgacaaattactctgtagactccactgtgtttcctagggccatggaatgccttcttatgcaagacacgtttccatggattcaggaaatcattttaatggttcagctatcttaatttaaacaaaagttcagggcttattgttcagctgagtctctaaaaatattttttgactgcagcggctcttttacattgctaatgtgtatccatgtttaaaaaaagaatctttatgaaacagtgaaggccagcatttctttgaggtgttggcagtctttgctttaggaataataaaggaaaacattagtttcatcaaataataaaataaggaagacctgaataaaatgtccacattagtagaggatgaaagtaccctgaaactctgcaaaacagtaatgtctcatgctttgatgtgatctcattaagtgagagcagcacattttgctggtatgttgggaccccccaagaccaccctcaggcccagtggtttgctggaagggctcacaggactcagtacctgccacacttacggtttattacagtgaaataatacagatgaaaatcagcaaggggaaaaggcataaggcacgaagtccaggtgaaactaggcacaaccttgcaggtggccacccccagtggagttacagagaagctgttaattctcccagaagaatatatgattggccatgtgcgggagagtggccagccagggaagctcacctgaaccttggcgctcagggtttttatttgggggccattcctgtgggcatgcggcccatgccgaggggttcagaaggaaaataggagaatacaaggctatccacaccacttcaggcccaggccacatggaaatctgggtgaggttctgtatctgtcgttggtgcatttatgcatttgttagatgtcaatgataaaaactaatttctaagaatgtgtaggagtgggtaagtagctggagaacgtgatacccaggcctttcatatagaaaagaatagcacatcaccctggccagctgtgtggcatgaacaattgatcctcctccaccaagtatgtccattctccctttgctaaatacagtggtgtaggtttgcagagcctctgctcacatgggaggttatgaaggggctaattgttcaattaccaaccctctcataactgtgctagttgcaaacaaactgtttgaaaagactgttttgctaaactgttctcttggtgtgattataaccatttacagtagcaaaatgcaggaatccagaagttcttacattccagatgttcataaccattccactctcctggttccagtgcagtttcagttgtacgatcttttctaagtttattgttctaaattaagacttgccattcttatgctcattaatttgttacagggagaaaaagcaattagaatgaaaatcagttgagtatttataaattacagttgtttaagtatacatcttgttcagtgtagtcaaaaattctccattggtattgacacccacaaaaatggtcagattctgttgaagatgcacataagccttaaatttcacttcctactttaaaaattggtgacgatgtgaaaatgtctaagagagtccacatttcctgttttagataagatgaaatagccactcaccaaggtgcctgtcttccgagtttattcaccgttacattcaagacttgcctgctctgaaattctactgtgaccttaaaagtgcccagcattgatatgttttatgccaaattctattccctttcttgctttccagaccgaacagcaagcgagttgtctggactgtcagacacaacactgtccctcttccccgaagtctctgtacatccctttgctggtgcctccttctccgttcacttctcaactactactgtcctcaagatgatgttctttttaccctcccacatctgtgcctgtagtaatatgtcactctcttcctcctgaagtctgagtcccatccccagtctctctgctgatcccccaagtctgagtgtccactcccaatctctccagtgactcctcccctccaagtcacggtgtgtatccccaacttctccattgccatccatactgatattttgaatgacacttcacgagcactctttaatgtaaacccacacttggtaccatcaccatttccctaccacagtctgtccacttcaaagacaagcttcctctatcctgtgattatgtcactctttgccttagtccattcgagctgctatgacaaaataccataaacaacagagatttttttctcacatttctgcaggctgggagtccaacatcaaggtgtgggagattcagtgtctggtggggacccgcttcctggttcatagatggcgccttctccctgtgtcctcacgtggtggaagaggcaagggagctctctggggtctcttgtataaggacactcatcccattcatgagggctccaccctcatcacctcccaaaggccccacctcctaatgccatccccttgggggttagatttcaatatatgaatttagaagggcggagagaagcattcagaattagcactgtttagtagaaaaacatcaggattgtgttcaaacatttttttccatgttatctttcctactgcctccttgtcttcagttccctccccaccacctggcacccagatatcctacccttgtcagtgttacctctatccccccatcactgttttgttgtagtaacaatatctcacatttgtcaagcacttgctgtgtgccaggcatgattctaaatattgacagatgaaactgtttattcctaccaatccctaggaagtagaaacagctccatcctcatttacagatgagaaacccaaggtactgagaaggtcctggcctacccaagtcacttcaaggaggtcatacagctgggattcagaacaccatccatctggctttggaatctttctcattttttcatttattcaacattcattgaaaataatgtaataaaaattatatatgtgtatctatatctacctatagatgcatatgtatatatgtatatatagctatcatgtgctacgtgatgctttcaaatacagttggccctccatatcctcaggttccccatccacaaattcaaccaactgtgactcaaaaataaattgggggctaggtgcggtggctcacgcctgtagtaatcccagcactttgggaggccgaggtgggtggatcacctgaggtcaggagtttgagaccagcctgtccaacatagtgaaaccccatctctactaaaactacaaaattagctgggcatagtggtgcatgcctgtaatcccagttacttgggaggctgaggcaggagaatcacttgaacccgggaggcagaggttgcagtgagctgagatcgtgcacttgcactccagcctgggcaatgagcgaaattctttctcagaaataataataataataaattggaaaaataatacattggaaaaaacaaaaataacaatacaacaattaagataatacatatatttttaatttttaaaagtggcagttttattagagcaagtatgaaaatatgaattaaggttgcaatgagcagcgcagcagagaaggggctgcctgccctcctccccccgcccgatatatatttcatgtgtgggacagggtctcactgcattgcccaggctggaatgcagtggcatgatcttgcctcactgcagcctcagcctcctgggctcaagcagtcctcccacctcagtctccccaagtagctgggaccacaggaatgtgctaccacacccagctaatttttcgtagtttttatagtggcagtgtttcaccatgttgcccagactagtctcgaactcctgggctcaagcgattcacccaccttcgcctccaaaaaagtgctgggattacaagtgtgagtcactgcgcctgacctatttattgttttttaaagacagagtctctctctgttggccaggctggagtgcagtggcacaatcatggctcaccgtagcctcagcctcctgggcacaaatgatcctcccgcctcagccccccccccccccccccccccccagtagctgtgagtgcaggcacgggccaccacactcaactaattatttttattttttgtaaagatggggtctcattttgttgcccagtctggtgttgaacccctggcttcaaatgatccttccacctcgaccttgcaaagtgctgggattacaggcataagccaccacacccagtgccaatcttagttctttgctcgttatctgaattttcaccatatttgcatacacctggagtattttcttaaattgaaacagttgctttttattagatataccaatacctgttagtttacgagtttcatttagttctattgttcgcataacatacatttaaatagctattaaatttcaaacatttgccctcacgctacttaaaattattttgagtaccgtcagaaatgtggaggccacaagagagtacttgaatgcagcagttgtcaccttttctccagcagcttgagaaagggcatagagtgctatctgagctggatttgaaccagaagtttttaggcaaagtaagaagagcacttcaagaaaaataaagagcaaaccccagcatttttgaggagaatgcgccatcttggtgatgcggacctaggacacatgatggcaggaaggaggaaaagatgctggcaagtagggttagtggcacattaacaccagctgagacacgggaacctgtccagttagaagccgttgattcattgttgaaagataaaactggatgtagtgtgagtaaaggatgacctgcctgcttggtgaaaaattagtaaccacagaggtggctgtcaaaaccaaccagcaaccagggaaaatgcttatagtgtgctaggtaaaagagaacagggatacaatattctgtgaccatgatgattatacatagaaattaagacgcacaggccaggcgcggtagctcacgcccagcaagtaatcccagcactttgggaggccgaggcaggtggatcacctgaggtcaggagttcgagaccagcctggctaacatgaaatgaaaccccatttctactaaaaatacaaaaattacctgggcgtggtggcatgcgcctgtaatcccagctattcgagaggctgaggcaggagaatcgcttgaacctgcgaggcggaggttgcagtgagccgagatcatgccattgcactccagcctgggtgacaagaatgcaactctgtctcaaaaaaaaaaaaaaaaagaagaaagtaattaagatacatagagaaaagggactggaagaaatcccccaatgtgagaacaggagttgtgttgattgtttaacaatgtgagttaatttctccatcttccaaattgctttctcttatattcccaaagtcatatcttgacttttgtttgagtgtgatttgcaatggtgctatccgtcgtaaatctctggtttagcattcatgctgtcttccaatttccaaatattgaatccagaattcatgagtgttccaaggtgctggagaccacactgtagggctggaggacatgagcgtctctgcacctagctcttcctagtagctgacttgcagcaggagctgaggcttctcctggcatcacctccactacaattctctgtgagcatttccaggaagcagcaccccctaccctagccgaggcccgtccaaggttgtctcgttgtcctagcccgccattgccctgggaggaagtagccacatgagtttatggcctgagtaatgcttttccctcctggatgctccccacatctagaggatatgaaaatagtcttggcaagggtgcctggtctgcgcttgtcagcggcctgagctgtattcagccaccacccttggggtccaggccagatgttatggcaaaaccgtattttaacgagatccttctggtatttcttttggacgccgtccgaggcagcttcattttacgctaaattccatgttatggtgggtcatctcaaacaggtctgcagcgcataaaaatgttctcactgcactctgttttctgtagcaaaatgttgttggaggttaggatgggagttgaggactgggccttgagggtttttttcatataaacacattaaaatggaaagctgatatgaacacgttcagtgatatagactgcaaaggcaaaaagaattctccccagcatatttttttttctttttaccatggatgtaattggagtttacatatgataagaactgcttcttgggcagaaaatgtaatcctctggtgagactaatccatcattgttgaagtgaagggaactggtagtgaattcgccccacagatgaagataggatttctaattccctcgccttttctgtttactgttcctaactccgtgagagtgtgcgtgtgtgtctgtgttttcttcaccatttgatttttcatcccggctcccacttcctcatccttggcctctctcgcatctttatttttatcacaccctccccacctccaccaccttgtcccagcactgagaggaaagtgggcagctttccaggcagctgcagtcctgctggagaaacctttatgatccaggaaatattgactgaggagaagctgtgctgactccgctatgaataaggaggttggaaaactgtcagcatttgcagaaacaaaaggaagtgctacatatacgttttggtttcataatgactgtattgtaaaaccccttctctttagcctactagattggacaagtgtgttaaccagtggctgtttggtatccattgatcatagagctagaccaacaaccaaagttgtttacctctcataaggtggcttttgcaggcgtgccaaaatcatattatgaaactcccagccacaaattctgacatgtattttcacttcctatccaataagggatatccccacccctttactccccgactactgtagtcataaaggtacactcctagttcctccctctctctttctcagcttctcggtccctgtgtgtgataaggtttcttgttgccctgtgtggcatggtgtggcacgccccagcatactcccttccttgggaactgagtaataaattctttcaatggcattagcctctttgtgttgtcactcagtcacctccataaattaaaacccttcaggttttgttggcactgtaaggtaatttattttctctacataggattttagaattgaaagggaccttgtagatcattgaattccacctgtccatgggtcagaaaagggagctggggaaactgttagggggcagatccaggccttggagcacctggttaaatgtgttctccccataagcctaagaaatggtaccaaattcttatgtcattgcatccaatatggtccttccttctttcttctcttctgtttctttcctttgctctcaagactggtgtatcactttgtctcccaggctgaagtaaagtgtgtttgttatattgcagtggttttttattcgtattattatcatcatattgttttttgttgtttttttctggatatttttgatctgtggttggttgatttggtggacgcagaactatcggatatggagagtcaactgtatataaaatcaggtcagcacacttttcctgtagaggagcagatagtaaatatcctcagctttatgagccatgtggtctctgttgcacctactcaactctcccattgtagtgtgaaaatagccatagacaacacatcaactcatgggtgtggttgtatctcaataaaactttatttacacacactggcagtgagccagacttggtctgtgggcctcagtttgcaagcccatgatctaggcaatgcacagatagcagatggtgtccctcagctttggatagctgtaagtattacaagtatgtgagtctgttaaatacttaataaaaattccagttttaatgttacaaattgatacccttggtatttgttttagctgaagatgcaaaaccaactccacagctgcctgagtattaaattctacttttctctgccaaataagcagtatttctaaaggccagtgattgataacttagcagattttgctgatgaatcaggccaacattagctgagcatagtagtacactgtataactcaaatggtttgtgaagtcatttgtgaggggtgtggtttagcagtgtcataattgcaagaaacgcaatacatgtacttggtttgttttaaatgtttatgttgcctagttagatgagacaaattcttatacagactgtttcctctcttgtgagactattacacgttttattccaaatggacaggactttacatggaagatcctaccatcctttataaaatgtcatcctttgtgtaagcctttcagtttatcatgattatactcttttttttctccctgggaataattttacctcatctggttatgctctgttactgtgtgttatgttatctaaggtctatgaccaattgcatgcagagggtggcttgcttttcaatagcaacaaccaagaaccaagcagaaatgtaaggagagtagagctgggggtagtggcctttcagggtgtcaattccccaaccatggtggggttgatgggacaatattggaaacatttttggttgttacaatgggagtgtgctactggcatctagtgggtagaggccgggggtgctgctcaacatcgtacaatgcatgggactgtgtcccccacagcaaggaatgagccagcctaaaagtcagccatgctgtgcttgagaagccctgctgtcaagagattcatcaggaatacgcctcctaagtaggtggcaagcctagcgtcttcaggaatgtctctaggctagcctactggtgacaccaaggacactaacccatcaccctcacacgatctttcatcgaggtaccaccaagctctttgttctcctgccctttaactacttctgcacctgccgcaggggcagtccttggtgcttcgtttatcattgacattctggtctttgttcctacggatgtcttgttgggcagaagagatgtgttcagagatgcgggaaagctgaggaggcacaaggcaccgaagtctcaccactctggcagactgcatatgaatgtgcccattagccctggagtccaagtgggaggggtgagatgctggcaggtgtggaggcaggcattaccttccgcagcaccctggcacctggttctggcaactgtggcctaagaggaagtggtcaagcagcctctagtacatagtccttgggcattgtcttagttagtatgggctataaccaacaccttagactgggtaatttatatacaaccaaagtgtattgctcacagtcctggaggctgggaagtccaagatcaagacgccagcagatttggtgtctggtgaggtcctgtttcacatggatggctccttctgtgtcttcacatggtggaaggtgcaggggagcttgcttgagcctcttttatagggacactgatcccattcacgagagtggatccctcatgatttaattgcttcctgaaggccccaccccttaataccgtcactttggggatttgtctcccacatacaaatctgggggggacacaaacattcagaacgtagcaggcatcttcctgtcccagaatgaatatcagaactagcaaatatcctagcagccatttcatctgacatccttattgttccaacaaggaaagctgggacagcaacctttccactcactgtggtctcctctccatcaaatgtgttgggggtctggctgctgtcccatctatgtgtctcatcagcacctcaaggtactttttatccctatatcacagaggaggaaatgcaggcccagccaaatgaagcgacatgggccaggcaccagtggcagaacgaggacagaacccagccatcctgcctgctgctgacattttctccatccagccctcctgcttgccttcatgagaccacatggccagaaatcagtaagaaaatcttgcaagcaaatggactgaaaaaccattgctctagaggccatgtagagatccattcagagaaatgcagctagtgaaaatttcagcaaataggaggacttctgttaaccatggcatggaatgcacatctcccaggtctttatgaaggtgcctaatttccagtcatgacctaccctctccaaaagaggacccaagctgatgaaagaccttcgaggtacccctgtagaactttatcctgcacatttgtcattgtgcatctgcacaggatattcctttcggcagacgactttcagctctttgcagaagtctcagacgccacatccttagtccatctttactggttcatctctttgttccaagaagacttaattgaatgtggatactgttgtccacacgatctagaaatgaaatctgtgttggagagcataatcatgtagagagataaagttatacagccaaaacatgtactcaacattaaaaacccagatgagagagaaatcaagggcacactccctccgtgggttagactgagctttgcacaccgttctttgtgagttgcctgagctgcacccacgctggctgctgtccagagctgccagtggtctagctgagcagccaggtggaaatggagtctgtgtccatgcagggaattcaagaattttggttcctgtgcttgtgggtgggtcttggagtgtaaagtaaaaagcggaatctcggagtcacatagtctacggttcacagtttagttcagcgtcatatcacatgatccttgggcgggttacctgatgtctccaatgtttgtccttatgtgtgaaacaaaaacagtaccaactccaaacagctgctacaaagactgaggtagtggacagagtgcccaggtttggttgaagatggtaatgtggtcagaatcggctctgtttcacagagcatgtgactgcaagtaccagttctgtggcccagtgctgcttgcgggaatgaatgagtcagagtggatgaatgaaatgtcccaggagcacgagactttccttccacaattgctccatcagccatgaggtttgcttgtcaggtgccgtcatcagcacataatgctgcattctggtgcattcagtagatgtttctagatactgtttcatggtggctaagagtggtttctggcacccaggcttagatctcagccccacccctacaaactgagcaacaggaggctgtcagttaccctcaaaagatctcagagactgattgatcaaggggaaagcggcagtgacagaatgatgctgagaagcttgaagccatttagtaggagccacgtgagtggcccccatcagccgtgagagtcatgatgtctatgagagaggaatcactgtggcccagagtagataaggaagattccatgtagtggatcgtcaagccaagaatgcagtgaggtcccgctttatccattgactggggtttttctcttccacactttgccaaagacctcaatgataaaagcttgcaggtaaaactctgtatagcattggcagagaatagagtcgttggtgaacccaagggtgggttgcttcattttggtaggagtgggtaggagaaaaggaaggtggatagagagaaagcaagttagaaggaaaaggtaaggttgttgtaaacagccttggcttatatcctccaaaaacacaggggcggaggaacccttggggataggggaacctggaagggcgtcctttggaacctaatgtaggcagttatagttctgtaaagaaatatgcaaggctctgtgcaattgattgtaaaattaatagcagctaccctattactctgttagataaatctcaactacacatttgatatgttctttacaacctggcggtggggacagaacagagggtggattgaggaggagggagagtagacagagaaaagtgaagtgtaagaaagcagcaaggagagcacagcgcagagctcgtctcctggaggaacattcccatctggtgagcgttttgtttattgcaaggtcagtttgcatttggataaggcgaggcagaagggcactgatacggaagcagagggaagccggctgccactgcccctcattggctgaatgaaaggcggcggaagaggagcacctgtccagcaaggctgacagtcctgcctcctgggataagcagattctcagcctgcagagtggtctaaccagggaggtagagtggctgctttccgaactccctgcttcctgctcatttgcctcatgcatggaagttgtaaacagtgtgagagttgaaagccacaccatgggaatgccttggtgtccaccccacctgttgccaggaaccgagcactgggggtccatgttcctcacacgagatccccccatgatgtccacctcccaaggatttcaagctcctgtgcaccctcaggccgcctctgcaccaagcaaagtgacccagccctgccaggcggggttgcctgttttaggaaactccctgcagcagcctaggcttgctggcagtgggatgccacctccctctctctccttgatgaagggctgtcgcagcttcctcatcacccccagacctccacatagatgccctgcatcattgccttctttccttgaagcaggcgccatccacaagagcaaggcatggctttctgtgtattcggtcctgacccccttcccaacagcttcattcaagagccttcatccaaagctgatctgaaaacacctttaaattgccaagcatcattgatagcagcttcctagagcggcagtgaaagagatgcactgggggaggagaggaaaagagccagcatcaattagcaaagagaaaattcccagtgttttgagaaaatgactcagtgccacaccagtcagtccaggacggcctcttctccgtcttcagttgttgagttgtgatacacttgccccgcgtgccaggaggactcagggtcagcgtttgctgttccctcatcttgggctgaagaaaggtgccctgtgtgctttcagggggtgacacagagaggcttcagcatgagcttctgcacagtcttacgaaccacggagttttggtggggagcctggagccaaatttgagtaacagaaatgtccaaccggggcatgcagggcaaactattgtctgttctgctttgttcttaataacactgaaacggttctaccatttaagtcccttgtttcatcacataccaatcctggtcttcctgggtctgaagtccctccctctctccctgccctttcccaccttactgaacccaaatcagaagcatccctgggcattctgcagccgtgtctgtccctgcaaattaagtgtgtttgaagtctgcgggccaccttcagatctcaatggctgcacctccctccttcaattcgggtctcactcaacctcagctttcccctcttgccacaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggtacgtagctgctgggcccggcccccaaacagcagagccctgggaagctgcaggagcttggaacacattggaagctaacatgcatttccctcaggcatttgggattaattccgcggcagggtgcagtggctcatgcctgtaatcccaggactttgggaggccgaggcaggaagtctacttgaccccaggagtttgagaccagcctggacaacatggtgtaacagcatttctacaaaaaacaattttttaattagcccagtgtggtggtacgcacctgtagccccagctctcgggaggctgaggtgagaggatcagatcacttaagcctgagaggttgaggctgcagtaagctataattgcaccagtacactccagcctgggcaatgcagtgagactccatctctaaaattaaaaaaaaaaaaaaaaaaggaagaagaagaaagtaagttgggttcttttccactttgtgttaataccggttgtgtggacacacagcagcaagcttccagtgcccctcccacatggctctgtgtttttgacttaaatgtagaatcactggctgttagttgatgtaaacacttacaccgccacatctgaaaaagatacggcagatcttcagctgctctgggcttcggagtggacgtttgccttgcacttaatgcagacttgctgtctcttcttgatttctggagcaggttggttagagaggggccccacacatggtcaggtggaatctgtatttcagcagaacccggcagagggcatcaccagaggctgcgtcagggcagagaggtgatggctctggtgttaatgaggatctcaagggatgccttcattaccgggctcgttgtagagcagatggggtaggaggatggaaaaataaatgcacattaaaactgtgcacttggcttggaacccctcccactttttacattggtccacagtgaggagttgtgccaattttataccaattttggttttaaaccacacacctcaccctctcttgtcccctcctattctggtctcatgattctgcagtgaagatccccttgacttctggggaataatgggatccacaacctttcttgccgccttcacctgagtccctattttatttttagagactgagtctcacactgttgcccaggctagggtgcagtggcacagtcatggcttactgcagcctcgacctcctgggctcaagtgatcctcctgtctcagcctcccaaagcactgggaccacagacagtccctgttactgatttctcagtcccctgcagcttcctccctctgcttctctttctcctactctgacccaggcgcgtgattctactgaacttttccatactgtaccgtcatccatcccacctggcagtcacattcttccaggattccctctgtcccgtctttctgggaactggtcttgcccttacaaacctttctccttcacagcatgttacactgctttaaaaaactcttttagaaaatcacaaagtaataatatcctgttctctttttcttttcttttctttttttttttttttttttttttaagacagggtctctctctgtcacccaggtgggagtacagtggtacaatcatagctcactacagcctcaacctcctggctcaaaagatcctcctgcctcagcctcctgagcagctggaacttataggtacacaccaccacgtccagataatttttttattttttgtagagatgaggtctcgctggtcttgaactcctgggctcaagcgatcctcccgcgatcctcccgccttggcctcccaaagtgctgggagtacaggcgtgagccactgtacccagtccctgttttctttcttgcacttctgcctgccatttttcgcaaagctgtggctttcgaaactccggtgttttttcctctcttgtgctcctttttccctggcaaaccccttcacactgtgtgcccgggatcttccactgactccttctggccctgtctagtttcctcactgcaaaacacacacgtgtgtatctaagaggacatgtctccaaggtccagccagccatcagatctcaaggcgcctgtgactctgtttttctctgctcattgccttctacctctcatctgttgagaagccttcatagttgccttccctcggcactccagattccagcactctaggggctaatgaaagactgtcccatttgtcacaatggtttctaatcattaaaaagtgagacgccaggggcggtagcacacatctgtaatcgcagcactttgggaagccaaggcaggagggttgcctgaggccagaagttctagaccagcctggccaatataatgagaccctatctctacataaaataaaaaaaattagccaggtgcagtggcacatgctcgtaaccccagctactcggaggctaaggcaggaagatcagtttggtccaggagtttgaggctgcagtgagccatgactgtgcccctgcactccagcctggatgacagagcgagaccccgtctctaaggaaaaaagagagacagtgtgcccgcggagtttaaatgaggacatgttgttactactttggacagttaccgcgttttgtcatgggcttgttcatttgggtgtgaacatatgaaggaggaagggggtgtgggagcgtcttgacccatcggtcaccattgtccactccatggccagaatcaagggccaagagtgcctgaggaggtgatgcagctagttctttacataggttgtattgttttctttattttgaatattgtcttgtaatcagaaatcatctggagtgatgtttcatttagttattcttcagctgaaacctgagcctttcagttcttcctcacttctgaagtaattcaggttcagagcatataaacatgtgtttgcacatccagatacaaccccaaggcttactgaggttcacctgattcgaatatctggcgtgtttcacaaggaaagaacctcctgctgtatttttaaacgtgtgtggaaagttttccatggtaaacggaaatcagagaatcaaagaatggtcaaaaaaacatgaatcaaaacaaaatgatgtcaattgtgtcatggctatggttagtctaaccctgaacccaaggagtcatttcaagtagcagcaagtgcctattttattaaatcccctggacagatggacttggaatccaggcctaaatgctgtgtgcatctcatttgggctctgcttctgaagcgttaccctcccatataatggatggtcatttgcagagattttgcacagtcgcgatagcacgtgggcaggtcttctccaccgcagcactcagtatttggggctgcgtgtttctctgtggtggggccatcctgggcactgttggatgttgagcagcgtccctgggctccacccaccagatgccaggagcacctctcctcccttagttgtaacagccaaaaaagtctccagacgttgcctaatgccccccaaggagtcacagtcaccccccgcccccgccacgttgagaattgtgccatcagggatagcactttctgtcaagaataaatggcctttttgtcctcaatgccccaattgggtttgacactcagaacaaccatcacacttagttcttaccaacagtttgtcgtgtccccttccctgcccaccgtgggatcccttcaccccaggctccaggtccatgccgcttcccccgtggccccctggttgctgggagccagctgtttacgccccacttccctgcgcttctcctgcccagagagcagaggccattcccagagccctcacccccgtgagctgacagctgtaccttggcttgcttccccaggatggcacagtgttcgacggc

SEQ ID NO: 2958 - DNA, 252950 bp, human
gcatcagtctgcacaagcccagggagcccaggagcaacgaagggcaggctcaagggaaggccccaccatgtccttctggggggccttgaatggcaactgatacataataagacacaatctattctgctgattcacaattatggagactgtgtaagtgtgtatttttttattgatgtcctctaatgatggtgtagcaacagtcgttttgcatcattgacgttttacagcaatattttgcagggtaattttgaggtccgccgttttggtggaggaccggcctcttaaaaactcacctccggccgggcacggtggctcacgcctgtaatcccagcactttgggaggccgaggccggcggattgcctgaggtcaggagttcagaccagtctggccaatatggtgaaaccccgtctctactaaaaatacaaaaaaaattagctgggcgtggtggcatgcgcctgtaatcccagctactcgggaggctgaggcaggggaattgcttgaaccagggtggtggaggttgcaatgagccgacagcgcgccactgcactccagcttgggcgacagagcgagactcctcagaaaaacaaaaacaaaaacaaaaaaacaaaaacctcaccttaggtccccctccccctacaaccagaacaacaaatggtctagagttcgaggaagagcaagtgaggttatagtttagattgctgagtgtaccgggctcttagcacgaagctcattatatagtaaaggaaggggcaagaatatttgaaaaatattcaacgaggctgaccccagaggtgctggggagggggagtggagatctgtttaactgaattaaggctgcgagtggttgggagtagcctacgtggaggggaggaaggagcgctggggacttaggtacaccggggccaggccgtgtaagccattgcaacataaagcactttgcaagggccagagggctgatgcctggggggttggggtgggagtgatgaggcccgagtgcccaggtccccccaacctcctcagcccccacacccgagttcctggcgcctatgcctgtgtgtctgagtttgtccctaagcatttctggctcttcttgggaggtgttttgcaaaggtcgaggctccgccggaacccccactttttgagctggggtaaagactactggggtgtcttctaagacgccgattttgagggagattcaccatcgggcaggtggcagggggttctgttggggcagccgggtggcttcctttttggggtgggggagggtaacactttagcagtgatcgaggttcccctgccccctagaaactgagggggtggccgaggttcccgtcccctcgaggcagtcgtggaaaggctgggtttgggatgtgatgggggtagccctggggtcctctcagtcccacggaggccacggggaagggaccgggaccagagcaactagggagaggcccgggttcccctcacccaccctaggcgtgggggagcggggcgggcttggtagggacgctggtcccccgaccgtgggacaggggctgggttgggacgcgggtccccactaggagccgcgggggaggggcagggccggagtccctaccctcgtaggggaggggctggttcgggacgcggctcccccggggcgcaggggcggggccgggtggtacgccgggtcccctcccacggccgtgagggaggggccggcggcgggggcggacccctggcggtcctcctggctggggtccgcgcgctcgcggcagctccccgtggaggtcactgtccgtgccagtccctcccgctgtcccgccctctcccgctgccgccgccgccgccgccgcgcccgcctcagcgcccccactccgcgcttgggagcgaggagccgccagcgcccccgccccgccgccgccgcagcgccctcaggccgccattcgccaccgaaactttccagcgcccgcgctctctccgggactcggcggcggcggggcgggggcggcccgggggcggcgcgcggctgctccggggcgccgggccctcttcggccgccgcacggccgggactcggaggctgccggctggagggaggttcggagcgcggccgggcgcgcggcgccgccacaagttgcgctgctcgcgacgaggtgagtgcgcagggctcggcgggccgggcgcggggtccgcaaacttctgcggggaggcgggtcccgcgctgaccctccagggtccggccggcggctcggggcgcccgaacgctccacccgcccctggaactcctgtaggtgcaggtcgccaactgtccccgcggcgctcggactggggtgcggcgcgctcccaggagcctgaacaataccccgaggtggccgctccccgaagtgccggcgcgccttgcggggagagacggaggtcggcggggggctcctttgttttggggagggggaagtggccggtaagtttagggaagcgctcggcttttcctccggtgcccctttgtctgccgattcaggggcttgctgggcaaacctgcgccaccgcgggctccggggaccggggtggagggcggtggcgggatttccccgctgttggggagaagagccccattcatacccgggacgcgggccggccctcccggacccgggtggaagcgcagcctcgcggagtggggcaagcggcgggcgaggtggcgcgggccccgtgtctgctcagtttctgacgcgcagaaactgtcaaggaagtcgggagccccagtcctccgcccatctccccggcctgagcgcacggctgggctgggggcacccttggcccgtcgagggtctgcagagcgccgcccggggagagcgcagacctgttgctgctcctgggctctgacggggcgggtggggtgggtctcgcagatcctgggccccggccttgctatccagggggaccttccctaacgatgggaccggtgctcggagtggagtatggggagtgcgccttcgggagtcggcgctggccggatatgtgacaactgtgggtcgctggaggcccgcctgcgctgggatagggcctggacttcacgtgcgtcgcctgtgttccgtcagaccggggccggggctcgctccctgcaaggcctcgtgttcccccagccagctgcgttggacgttccacaaaggtagggactgacgtttattctcgagtcagtgatgttctggagcaaaacctaaaaagaaacaaaaacctaccctctattgtatttgcaactgtttctgctttgcattgtcatgtgtggtttgacctgccttttggatgttttcctctcctgaaacatcgcccagtccctggtttaacctggaaggcgagggggaaggaaggcaacctccctgctaaggttccaggcagtggctttggtgttggaagtggcacttgacgattttatgaaaagtttacaagtccttcctagaaaagatgtaattaggaaaaataaaatacagaagaacgttgagtatgacgcgtttattttaaagggtagtcctgtctcaaatgtgctgcacatttttgtggaaagccaccaagctgggtaactaatgcaaacaacaaaagttgttcatcactggatcaccggcccttaaggcgattccagcccttagtagaacacacacctgtagggcaaatatggagatttgtggtgtagtgctgccaccctcgctccccaactctcaggcattttgcccctttacctcagagaacttctctctgtcagtggttttaaagaggaaacagtttgcaaaaataactttattgtagacatacttagaagtgaatgtttcaatttctggagttttcccatcaattatatcagtaccactggttctgtacaacatcatcttagttagaagattttttttcaccttttaaggtgacgaacagaggcgggaaaatggtccctgcagagggaggccatctccagcaggtcccgagggtcaggaattcagattatccgatctactcctgctggataggagcacacctccgctagaacctgggtccggccccctcccagttttctgcagggcgtccagattccggtgctctgccccgcagcagtgccctgtgggcctcctggcttagctgatcagcacagcttctctgcccagcgaggcaggaccatcctcccactgctttcctgatgccttggatttgctttttttcctcccttaggaaaagcaaaaaaacctaatatgctacatccgagaagttgttaatctttcactaccacatgcattgaaaaatcagttccacccaggaagcaacactaaaggcatattgtaaacacttttttttttttagttggaaagataaacttttttcccccataactatttttagttagccggagactggactcgagtttttacctccggtcttgccccctccactcccgccctcactttctgtggggctcgaccacatggaccatgctggccagactggcaaacatgaaacccaccagaaccaaaagaaaagctggatatgggaaggggccgaagaagtccacatgtttctaaagggcaaagagcctaggctgaggagagacgtttcagatctccaggggagaaagacagccgttaaggagtccgccgggctgctgcctgcctggccagcgggagcctgacttcagatgcctgcgcctcccaagctggccccctcccacacagccatcgccatccagtatttagggagaatccaccgcatgcctgaaggttgcagaagtgaattggaaaccgttacaaatggaattggaacaaatttaaagttaagatggaagagagaatatgttgagttttcagaggaagtcgggtactgcttccttttcttgtctaggtttgttcttgtccgatgggatcagagagatttgagatggggcatgataggcggcgggttcaggagaaagggaagctttagaaatgaaggtagaaaagatgcttgcttattggaacagtattttcaacgttgagctctggaatgttgcagccaactaatggttctcatttgggacagttttgtcccccacttttgaagggagcatttgccaatgtctggagacatttcccttcctgcaactgttaaattagcaaacaggttgagccagctgggtgtggacctgcattttcctcgtggaggccctcttccaagtgtcagtaggaaaagggctcccagagtgtggtcctgctgcgggaccttggcccccacgtccaagtgagccccagaggtgccccaagccctgcctggtcatggggaatctgggctcccgctgaacttgggcgctggggacagctatgagggaaacctggtttgcagctagcttgccgtgcactgactggagctttgggcaaatcagtgaacttctctaacattaattttctcattgagagaggaggtgggtaggagtatatatatatatatgtaattatatatataggggtcgggtagagggagagagagatttcccaggctccttgtattaaaggagatagagttattatatttctcatttagtttttatttatttgtttattttgagacagtgcaattattatagctagctgcagcctcaaccttctgggcttaagcaattctcctgcctcagcctcctaagtagctgggagtaccaaatgcgcactaccatacctggcaatttttttatttttatttttagtagacacaggctctcactgtgttgcccaggctgctctcaaactcctgggctccagtgatccttcctccttgacctccccaagtgttgagattacaggtgtgagccactttactcagtcgaccgacatagaattattataatgcttggagcctaacatgccttttttgtttgtttgtttgttttttctgagacgaagtctctctcacagcccaggctggagtgcagtggtgcgatctcggctcactctgcctcccgggttcaagcgattctcctgcctcggcctcctgagtagctgggattacaggcatgctccaccacacccggctgatttttgtatttttagtagaggtggggtttcaccatgttggccaggctgggctcgaacttctgacctcaggcgaccctcccgcctcggcctcccaaagtgctgggcttatgggcatgagccatcgcgcccggctagcctaacatgcttatagtttcctgttttctgaagttgggaattgggtctggaaaggtatcaccatcagtcacgatggtgtctagtagtttgctttgtttttttccttatcttttccctcttacattttagggctgtatctatataattttattatttaaattaccatatggtaagtttgtctctttgggtgcattatgagtcttgacacatgcatagattggtgtgaccaccatcatcatcaggagagagaacaatctcctcagcccagagatgttcatggctctgtctcccacagttcctccacagtcaccccccccagccccgaatctggggcacccagccatctgctctgctctggaagtcttggggatcccatctgaatgtaacacatggtggaatgccttaggtgaatccatccgctcttccagtaccacctttgcctcctctctctgatgacacatgaacttcatgcctttgtgtgctttggccaaccgcttttcttagaacagcacattttgcactgtagatgttatcacaagcaaggaaaaaacagctttgctccttaatgtaagaaaccacagtggaaaaacatcaggtgtgttgttgaggctgctaaagctttgctcctttttaaaattttttaaaaatttttctggatacgtaggtgtatatatttatggggtgcattagatattttgatatagtcgtgcagtgtataatcacatcatggagaatgggggtatccattccctcaagcacttattctttgtgttacaaacaatccaattatactcttttagttatttgctcttttttcttttattttgagacggagtctcactatgtcgcccagggtagagtgcggtggcgcgatctccgcccgcaagttcaagcgattctcctcctcagcctccggagaagctgggactagaggcatgtgccaccacacctggctaatttttttgtatttttagtagagatgggtttcaccatgttggtcaagctggtctcaaactcctgacctcaggtgatccacctgcttagcctcccaaagtgctgggattacaggcgtaagccagcacgctcggcctatttatttcctctttgttctatgccagttagttcttgatgcctcattgtttcagatgggacattttctaatgtcgtgtttttgtttttgtttttttgagacagaatttcattggtgtttcccaggttggagtgcagtggcatgatctctcctcactgcaacctccgcttcccgggatcaagcaattctcctgcctcagcctcccgagtagctgggattacaggcatgcaccaccatgcccggctaattttgtatttttagtagagatggcatttcaccatgttggtcaggctggtctcgaactcctgacttcagatgatccactcgcctcggcctcccaaactactggaattacaggtgtgagcaaccatgcccgacctctgatgtccttttagaggatgttaccctcacctttattgcacagtcctaccaaaaggtacttcatatgtgaaatgtatcagaaggttatagtcatggctttagtttaaaaacaggatacatgttcattaaggacctttgccgttttcccaatgggttaatcacgtaaatataaaataggctaaaaatatcaagttgtttttgcctttgttgtagaaataaaaaaatgaattcctacatctgtgtttctatggagctgctaacctgtgttttactctgggccatatgtcgctttctgtgatctcatgacgtggcatgttttctaatataatccttgtcctggcattttggtgacttttgtcctgcctgaggtggtctacctggttgtgtgaagtcacagaacctgtgcatgtcctaccgtgtagagttaaagggctggatgagtggcctcaagccttttcctccctcccaggtgtgaagatttggtttggaagatggaccctgcttcaaggtctgggaggccatgtttttttcagactggttaaggatgacggttttatgttaactaaacattgggatcaagtgacagttgtttatgtccggtgcctagagtatcagttttcccatgattaaaataagcgatattttggtaaacattgataagttagttgcgcattttagttcagaaacccacagcgagtcagaaggcgctttgtgctgctgggcgcctctgagtgattccggggagtgcggcagttctccagccccaggagaccctgtgaaagaagcacaaacaatgctcacggcaaaactcacagtgtttattcttgacctgggtgtctgccttgaattcttgtcatttttcctatcgtggtggatgtagccggaatgctttaaagaaaacatgagagttttttctgcctgtttcccttgagcctggaaccgattatgaccccagatagcctgcacagggctctttcctttctggaacacctgcccaggctagaatatgggagtagggaggaggtgaggctctctcctgcccggtaaccttcccggccagctctccaagacgctgaaaccttccttcgggtctgttgaaactgcatccccagcaccatcatgtcggagcaagaagagaagggcatgtgtcccctttaggcttgactctttccaattagggacctgcctgttgttaggatttagagtccatgtgaatgtgcagtattgttcagtgctgcgagcatttttgcttgtctgaatttcctgatagaagggaatttggacaaaaagaagcttattgtacatggtgccattttattccttaaatcaataataacaaatactttatttatgtatttttagagatggggtcttgctctgttgccctgatcatagctcactgcagccttggctttctgggctcaagtgatccttctgcctcagcctcccaagtagctgggccgacaggcacaagtcagcatgtccagctttttttttttctttctttttttttttttttttaattttcaatttttttctagagattgggtcttgctgtgttgcctaggctggtcttgagcacctggactcaagcaatcttcctgcatcggcctcccaaagtgctgcgattacagttgtgagctactgttcctggccaacatatactttaatatggcaagaccatataaaataattttaagaggccaggtgtggtggctcatgccccccagcactttgggaggctgaggggggcagatcacgaggtcaggagatcgagaccattctagctaacacggtgaaaccccgtctctactaaaaatacaaaaaattagccaggcatggtggtgggcgcctatagtcccagctccttgggaggctgagacaggagaatggcgtgaaccatggaggtggagcttgcagtgagccaagattgcgccactgcactccagcctgggtgacagagcaagactccgtctcaaaaaaaaaaacaataattttaagaactggaggaaaattcagcaggactgagtcgtgatttcagtttctggtgcactgtgggtaattgggtaattgtcagcctggatgcttgtgctcctttagttgtcactgttaccttgtcatctatgtgaagatgagaaatgaagttgagtggagaactgtcgccaaagtctgccatgtaaaaatcggtagtgccaatgtgcaaaggtaattcccaggtgctataaaagtccaggtggcttcacagtttcagattgtatttcccgaaagcgtagagaattgatatccctgaataggaaattgacgtccctgccatttggttcatttggggaacagaataaacttgtgtccttgccttcagttcttttttcaacagaatcttatcaagcatttgaatcgtacacaactgtaatgccagctccatgttgataaaaactcaagaattcaaaattataaacttgaaaacagcaattgccaacttctgacagtagcaggagagtctggaggacctgttcagaggaagtcgggtactgtttccttttcttgtctaggtttgttcttgtccgatgggatcagagagattgagatggggcatgataggcggtgggttcaggagaaagggaagctttagaaatgaaggtagaaaagatgctttcttattggaacagtgttttcaacgttgagctctggaatgttgcagccaactaatggttctcatttgggacagttctgtcccccacctttgaagggggtttggtttaattcccaatttgattatgaagaaaataccagattcagcttgcattttcaagacacagtggttctatgtcaacttcagccatttccagggatctgtcttaggatacttcaaaaagcctaacctttgagatgcactcagctcataagttcgtgaaaataagaatgaataatcttccctgtccagtacatgacagaaattattgtagaccagatgagagcaaggagagatacttgttgatattacatgtcacgggatgctctgttaaattttatgggactctgagtgtaattcctttaagccagtagtctctaaatttgggggaaggacaggggacagaaatgacttgtttcagattttaattcccaaaagggtcttagtgagtttcatgccctctggcaggtgcacagcaagatttattgggatgcaggaagaaattatgaaaatgtccattaagaaaatctctaatacttgtaaaaaatatatttcttgtccatgaaatgcatgttacttgagtattttatatatttaataaattacatgagttaggagcaccttctgaaaacttttttgctgaaaaggatatatgatgaaagaaacatttatgatgtaggtccccaaaggctggaagagggggtgataccaacgtccctgcctgcaggtaggacacagttgtactcccctttcctctgacttcagctactaaggtatgtgtgcgtttgcacgcacatgtatgtgcgttaagtaactttgagatccaccagcttaaggactggacatcgttccagaggtacaggtattagtgatttgacttagggaagaaagaatatgcaataacagggaaccatgcacatactggatctattgtattttgcgtgttgtttttaaagctgaaaaaatgcgcttgtttcggaactagatgacagtacctgtttgcaggtccacaaggaaaccttggaacaatgctatgctttttaagcgttttatgactgcattgttttcataatcactgaattctgtttataaatcagctgatttcattgacggatgccctcagggctctggagaattaggcgttttgctgcagaaatggttcagaatttcaaagacatcaacgtgagattgtactggaattgagttgtgataaaagtcctagggtgctttaaatctttaaatctggttatttgtttgtttgttttttgaggcagagtctcactctgtcgcctaggctagagtgtagtggcgtgatctcagctcactgcaacctccgcctcctgggttcaagcaattctcctgcctcagcctcccgagttgctgggattacaggcgcctgccactgcacccggctaatttttgtatttttagtagagacggggttttgccatgttggccaggctggtctcgaactcctgacctcaggtgatccgcccaccttggtctcccaaagtggtgggattaccggcgtgagccactgtgacctgctgtttttgtttttgagacatatttcatctatcatggttattaagtgttttgtttttttgcatttctcattggtgttttttgtttgtttgtttgtttttttgagatggagtctggctctgtcgcccaggctggagtgctcagctcactgcaacgtctgcctcccaagtttaagcaattctcctgcctcagcatcccgagtagctgggattacaggtgcccaccaccaccacgcctggctaattgttttatttttagtagagatgtggtttcaccatgttggccaggctggtttcgaactcctgacctcaagtgatctgcctgcctcggcctcccaaagtgctggaattacaggcgtgaaccaccacgcctggcctcattaggttttttttttttttctgagttgctgctacactactggtgttacagagtgaataaacataaaaattatattcacaactcagaccacattgtgggctgtggaggtgagaaataggaatcatctctaaatttaaggtcttctggctgagctcatttgcttagaatggctgaaggtttggttttcatgagatgaaatgccaacctcaagtggttctgggtttccagaccagtttttagtttgtttaacttgagagaattgatatgtcagctttagtttttgtgtgtaatttttggtgtttgcatctgttttcttctttgtgaatattgaattcgcaacataactttgttatatgaaatgatgctcatacacttgcgcagtgcattagaaagcctgccaggagcagtacttgtagatttccgtgtaccagcaggatgcctaatgccgaccatgattaatgctcatcagaatctatgtagacctccatttgtcctttgataagctgaaatatttgtgtctactttttaaaaaacctgttgcttctctttatggtaatactcagaaggcactcactgtgaagagaggagaaacaggaagtagaattttttactatctagattgatgcacctatctcccctctccagagaccaatgcatttaggccccagtaagaaatttagttgtaatgaaccataaagcagatgcagagtatatttgggaatataccttatctgactccacagcccaacccctttaagaggaaagagatggcacaatatattttgctttaagccttagactggtcttgacttcatattggaaccactgaattgcttcagctgtgaactggaatcctctcctgtctttgttgttgagtgatgacactcttaattaatcatttgcttatttgccatccaaatcaccctatataatctttcagaagtgtatctcagagaatgaccctaagtcggctgacctctgaagcctgtaccagaattgactttatttcttaagcgcacacttcctgtgctttcaaggggcagctgtctaggtttagtttctgggagtttgaggcacagaggtatgtaggggaatgggaaggccaaatggtaaaagcccctgggacgtggaatctgtgagtacactaaccttgaaagagattatgaaaacaaactttagagcattgttgaagcaccatctacataatttatatcaatgaagacagtaacttattaggaagacaggattattaaaattaaccattttcatctttctacaaaaataaaaatcaaatcaattttagttcagataattgtatgtgaagctttataagtgaaaatttgaagttagcaaaattatataaccttagttaattatattagtgtactcaaactaaatatagaataagattagctcatggaaacattgcatttttatctcagtcagtactgctcatatccacccagtagttagtttctagttacgttttgtaattttttgaatatcctggacatggttttagaaaagttagttgaaacaagatattgtatgctttcattatttcccagttcatctttaagcataataaaaacacagagtaagttgtcctttttgaattttctttcctttctaatatgtgtctggcacaacagaggaccaagcccagggatcattaatcccatttttctgcatggcgtttgctgtgagagaagtttgggctggattcgtagtttgctatctaagagtaaatgttcaaccttctctaatttcctgttttgtttgcttttccattcagtgttctatatttggacaacaaatatatttttctgtatgggtttctggtggcccagatgttcattggagtggaaattctttctgtccacaccactgagttgggcagttactggtgtttggctttctctatctcttggagttgacttagatacattgtgtattcaggttgggcactcatcccctttgcaagctctattactttgttccatttggctttgccataaatgtttgcccttggcttgccaagacgtcagctttaagagatatgtcatttaacttagaactcttgagtctgacttaaaattaagtcagttttcttaaacattgttattgaggtataaatgacatgccacaaaagtcacctctttgaggtgtaccattcagggatttttggtaaatttactgggttgtgtagagatcaccatgatgcagttttagaacattttcaattcccaataagatcgctcctactcggttctcacccatttctgctcccacctccagccacgggccaccatgaatatccttcgtgtctctatagattccccttttgtggatattttagagttgtgcttccaagaatgagtatctctgtgcttggtcgaacttcccggatggtgagacctgatttagtgactttgccttccgccccttcatccccaggagaggaaggtggggaaaggggaaagacggcaagtatagtagtataacaggcatcgtgcctcagtttcctcatctgtaaaatcaggataaccatggactagtttcaggctctaaatgtgaaactctgtaggaagtaattagctgggaatctggcatagaggaggagctcattgtttgcgtgttaacagtgggaaatagttaaggaggtgggaaaagagctacctgtagaaaggtggcctaagtccctggagagctgagcacaggaccccagggcacacacccccttatgcttcccctgtctttcatcttgaaagcacctgcctgtgaacctcaggcttggagggaatctggatgttttcccaggatctacctctgctctatggtcctcaatccaaggtagttttgaaaccgcctttgcaaaaattatatcaatgagaaaattataacagtatgttaagctaacccatcccccatcttgcctttcccttaatattcttgggctattgggccaggtgaactttggaggacttttaggctacggtttaaatgataataggccttgtcccaaactcaaaacttgccccaaactgtaacactaatgggaggccatcaggatgggggaggagaggagcctgattgctgctaaggcaaagacatgaaccattgccagattgtcaaatacgcagattcccagttactcccgcagataacatcactgttgtagaacctaagattggccttttgagatatcttttcaggtttttaaaattttcttttctctgaactacctttggggagattctagatcttttaaaaattccttaccaactctttggagatacctcctgcgttcatggttaatccatccccttagttaaggcttattgattgcacataggaagttccctttagtaaaaggttcaaaagctagaaatgtcctggctgaaatccggtaaaaagagattttaaaatgatttttcttttgagagctctgtagttagaaatcgacttaattaaagctgatatgtgtacagatactgttttaaagcccctgttctccctctgaaagcttctgtcaatggacttctgtcttgattcttcattcctgtctttctgtgtattcttctctgttatgtagtgtttatataaaacagctctaaataattggcgtaggccaggcgcagtggctcatgcctataatcctagcactttgggaggccagggcgaggtcaggagttcgagaccagcctgaccaacatggtgaaaccccatctctactaaaaatacaaaaattagccgggtgtggtagcacacgcctgtaatcccagctactcaggaggctgaggcaagagaatcgcttgaacctgggaggcggaggttgcagtgagctgagatcacgccactgcactccagtctgggcaactgagtgagactctgtctcaaaaataaaataaaataaaattggcttaaagaaaaataagcacttaaacattgtcagaaaaatggaaactttaatggcttttacatcacatgactctgatctttcaaaaataaggacagtttaaagattatttgtaaagtaaaataaaaatgtcttcaaagttaacacactttgtctaaattaggcaggtcagatactctttgctggatgttttaaggtcataaactgcttctgtgacttttaataattgtttgacttgtctgtcttacagccattagattctaggtaaggtctggggacacatggagttagccggctcccctggctaggctgggaagaatcatgggttctgtagttttatacatggttaaaattgcttatttaccaggtttttcaccaaaaataaaagttgctgaaagttaagattgtaacacgtataattgagactactggagaaacagttttacatgcaaggcgtagaaggaaagtagaatgtgtgtgtgtgtgtgtgtgtgtgtgtttgagatggagttttgctcttgttgcccaggctggagtgcaatggcatgatctcggctcaccgcaacctccgcctcccgggttcaagcgattcttctgcttcagcctccccccggcgtagctgagattaaggacatgcgccaccacctccggctaattttgtatttttagtagagacagggtttctccatgttggtcaagctggtctcgaactcctgacctcaggtgatctacccgcctcggcctcccaaagtgctgggattataggcgtgagccactgcacctggcgggaaagtagaatgtgtcttgtgggaggctataagaaagcatgggaatatggtttttgtaaaagggaatataattttgtctggttcggaggattttaaggatcatcttaaaagagtaatgggacaaaactgaaagtttaagcaagttgaaaaaggtttgtaaagggttcatcttgtaaaggaagttctgtgggtatgagcaagttggctaagacttgaaggggattatttagtttttctgtaggttgaatattttttgtttgacttttgaatgaatgacagaaaaacgaggagagaggagcctcatactgtctttattttgtcctgtttggaaagttgagtttcccctctatcagtgagtgaagatttttgccttttaaaaattcttgagttattatggctaaataaatgacttctagtgacttgggattttattttgtaatatcaagggtctaaacatttgatatttgacaaaactttccaaagtcaaaatctaaattaagccacccccccccccgcccttattttaatctggttaaccttccagatattaaatactgtaaagtccaaaagagacatatttggcttatttgatatattaaaactataacagtaagcattgtcaggtatgcaatagtgtttggctttctttggactgtatttgtatgaatgtgttgttagtatgtgtttcagaattgtataagatttcctgtaattctgatatgttttagtatatgttatcagtaataattatgattgttaagttattgtatgccacagagatgatcagaccttaactgtggctgttctgaaacttttgtcatccacaattgttttactttggttattttcagggtggttttataatcagctataggactgtgacagttttctgataactttggagattgtgacattaaaatagacgaaaaagcttccaaggctcccattaagagctaatgtattcatggatatcgagcagaacaggagttaattacatggactgaagtaatggaagaccgaaataaactttttctggcttttcgtttgaaacattgctcattcttttgtttttcagagtccagaaaaccttttttttcttttgagctatttatagcttttaacaattggataaagtatgctcttgtgaacaaaatctgaagcacatttctctctctacctgatttctctagaatttgaaaactgtttgcaagtatacttaatttatgatgttatagttgtttgttaaatacaaatctgttttcttttgtagcaggacacaattggagacactggttattttaccaaagctttgattggaatggcatactttcagattgctttaaggaatcaaagttgacttacagagccaataaaagccccttgggtaagctggcctcataccttgtctacacagtccctggacaggttcctaagtaaagaatgtcactttctgacaggtccaggagctccaagttatcttgagcccttgaggtgaggaattcacccaattaatacaagtatttgcaggcacagataaatccgtggctgggctaaatgctttgaagtctaatgtgagatttcttagggaataaagttgcagcaaagccaattttaaaaaggagcatatatggcaaataattgttctagctgaccttatgcaaacactcgggccaggtatagtaagaataaaacttattttgcacataaattagtcctaatgtgatttgtctttagtaaaaatagggactggagagagaaattatgtttcagaaaaaaactatagaacacctgttgttagaatctagtcttgttcactatttttgaatttttattattttctgtcatttggactgaatcgtgaattctttctggactacaagtcccaaactaatgctttcaaatttttctttcatttctaacttggcctcaataaaattgctactacctctttcctgaggtcctataagctgaagcttattatgagagaaaaacatgtcagattgccaccaccttcctcgtctataactaaagatgttttgagtctaatgtctggataaattgtgcccagtgttaatctttgttttttttccgtgtctatggaaatgcctcttacagaagcttagcccatctgcagtgccacctcctgatatgggaaacagctgtttaactgatctagtcttaggacttggacactgactaaaaagatatgggacaatatatttaaattcactctttcctgtttatcccagtctctctttctaacaacatatagtctactgttgacttaagtgttgtactagaactgtgagtaagaacattaacatctttgtcatacacccgtgagtacatgcaggtagctgcacggtggtgagctcactcctattcccctgggaccaacccctgcaactatgccccctgtcagcaggaagaagccagagtgatggtcaccctttttctatctctatagccagcaccttaagaataaggtgtatgaaagccaaagggggtattgaaaccacctttgcaaaagttatatcagtgagagaatgatgacagtgaaagagatctgagctaatccaccccccatcttgcctttctcttaattattcatttcccttaattattgcatttcccttagttattccatctcccatgtggtgtggctggccttgtgtctgttaaactctttctctactaaaatgcccatggtctttatgcagccggcaggaagaacccctcaggcggttacagttttgctcccaggggacagttttggttgttataaatgaggaaggtgtgctcttggcatctagcaggtagaggccagggctggcctcctgaagtgcagaggaaggtcccctcctctttcaagagagttatccagccccaaaaggtcagcattgcagaaattaagaaaccctgacttagaagctttgcacctcgtggtagctgtaaatgaggtatttacatcctccatgaagacgtaaggaagttgaaggaataaaaatctcatggggctttgaaagcaatgcaagcatcttttagttttcatacattccatggaagtagggatttttttctaaagcaaaaagaccaacaagactttggagctcagtttagaagaaaaaagtgactttcaaaccctttagaagtattcatttacaaatgaacaatgaaatgactgtgtagatggagaaaccctgagcgccccttggctttgatctggtggtcacgttcatccgtgtctgttccctgaagaaccagtgcccacatttgcctgccttctttacctaactccccccaacaagagctgaccctcctcccatcttctcgcctggttggtctttttcctccctccccctgaagcctgcctgcctctgctttccaccctccgacaagccctgatctgtgctctgaacaaactcctatgcgggtctctttgaagtctttttgcctgcccctaagtgcatccctcccacccccacccaggtgatactgaatctatgtgaatttgtggagttctcccttccttcccctctggcagaatcaccaggattcagtctagagtacaacattatagatgttttctagcacttttcagctgtccatacgctaatatgtagtcttgggtctttatccgaatggagtcctattatatttgtttcacaccatctgctttccttatttttgtatctttactgaggtatattgaagtacagtaagctagacttgtatgaagtgtgcagttttaatctgttttttcttttttatttctttgtttgtttacatacattttttagagacaaggtctcactatgttgcccaggctggtctcaatctcctgggctcaagcaatcttcctgcctcagcctcctgagtagttgggactataggcgcatgccaccacacccggttaattttttattttttgtagagatgagggctccctatgttgcccaggctggtctcaaactcctgggctcaagtgatcctcctgccttggccttccaaagtgctaggattactacgggtgtgagccaccgtgcctggctcgttttttcatacacacacacacacacacccatatttgtgaaaccagcaccacagtcaaagaatatttccatcactctccaaagtttacttgtgcttttttgtaatgtctctccccctccctctacccctttcccaggcagccattggtgggcagtctgtgactattgcattttctagcaatttatattactgaaatcatatggtatgtactcattattttgcctggcgtctctccctcagcatcatgattttggggcttcatgttgttgcacatgtcactaactcattcctctattgctgcgtaggattccttcctgtatggatgcactatggtttgtgtatccattcaccagttgttgaatgtttgggttgtttgttttttattgtgacaattatgaataatgctgctgtaaatgtttacatggctgtacagtggttctcaaacttcatcatgcatcggaaccacctgcagagcttgttaaaacacagagcatccaggcacggtggctcatgcctggaattccagcaccttggaaggctgaggcaggaggatagcttgaaccgagaagttcgagaccagcctgggcaatgtagagagaccctggcactaaaaaaaaaaaaaaaaaaaaaaaaattagccaggtattgtgtgcacttgtagtcccagcttctcgagaggctgcagtgggacaatcacttgagtccaggagtttgaggctgcagtgagctgtgattgtgccactgcactccagcctgggtgatagagcacaagaccctgttgcataaatactccccccaaaaccccagaaaaaccaacacacagagtggcaggccccatccccagagtttgtgattcattgaattaggggctgggttaagactctgcctttctaatgggctctcagctgatgctggtgccaatggttcaaggaccacatagacttcgagggctgctgccttaaaggaagtctttgtaaattatgatagttaatcgtttgttagttgttccaggtatttctcttctagaccattccttgccatgtaatgttgcttatggtttgaagcatcaagctcgcatttttgtgtagtcgaacatgtcagtcttttctttgggcttctgggcatggcttccttccagcaaggggcagataccaagaataacttggagtaggtgaggcaggttttgatgttagcaaaactcaaaccatgacactcccccaaatgggagtctgccctcattgggcctaattgtgccctctgctgcagatgctgggatggccttctgatgggatggccgggctgtgttgtcagcacccgcccacatgagacgagtttgtagctgtgcctggtgccaagagctctgaggtgctactatgccccctggaacctttgggcaaagcatagctagtcatcaggcttgcctttcacaggcaaaccaaatccatcctttcttcatccccctgccctgccaaaatcaaccagtctcaaatcaattcacgaaagggggccaatttgcctttcgggtgtctgatctaacaagccttggagcagctaggaagctaccagaagatgtgtatgatcaatgtatttgttatttattttattttatttttttaagtttggggaaaggtaatacttttggtcaaccatctgaagggactccctcctctaggccagggcactccatagttaacctgaaaaactggttcagggcatgacaggaagggggtttgaacatgcttcattatgccctcctcccttttggaattcatgaacagccgacagcatttaacacagaccttaagtctgataagaaacagttacaatctattttctctgaagcctgctacctggaggcatcatctgcgtgataaaacctaggtctctacaaccccttatggtacctggacatttttttctattgataatagcttttttttttttattattgagacaagtgctgttgcccaggttggagtgtgatggcatgatcacagctcactgtagccttgacctcctgggctcaagcgatcctcccacctccgcctctctagcagctaggactacaggtgtgtgccaccacacctggttaatttttgtattttttgtaaagacggtgttttgccatgttgcctaggctggtctcgagctcctggactcaagcaatctgcctgccttggcctctcagagtacagcgattataagcatgagctaccaggccttgccgataataactctttcaaccagttgccaatcagaagaattttatcccagaacacacaccccccccccacgcccccgccgcctcaagtcttcccacctttctggaccaaaccaatctatatcttaaatgtattttgatatctcatgtctccctaaaatgtataaaaccaagctatgccccaaccgccttgggtacatgttctcaggatctcctgagggccatgtcacgggccatggtcactcatattcagctcagaataaatctcttcaaatgttttgcagtttgacttttttcattgacagagagcagctttaaattactgtggactctttgttgcaaaagcatcttcttgaatttgataataaagccctactcttccagtttgtccctgagtgcattctgcaggtacctccggtcaccgcttcttatctttgctgttgacctcagttcattcctttcagattcttcactcaggagaagtcgtggaacagattcctggaggattccaggctctgtaaggaggcttatctccttaggatggttaaattttggatttgcagtgacttgtaatcattggctaatatcctagtttcttcttctcttttttaatgacaactttactgagcatacacacaactcattcctctaaagtgtgtaattcaggaatttcctagtatttttacaaagttgcacaaccatcaccactgtctaatttttgaacattttcatcactcccaaaggagaccctgtacctgttaagacatcactgccccttccccttctccccagcccccctggcaaccctgaatctggtttctgcctctatggatttatctattctggacatttcatagatacagaatcatgtgatgtgtgaccttttgcgcctggattcttacttcatatttctgagtttcatccatgttgtagtatgtgttgttctagtttcttgtaaatgttctgtcaaaaccccaggtgattaaggaaggtggaacaatgttctgagataagtcagccagagacacaggctgctcctccctccaattacatttaaaatggaaaatcgttcacaaatggaacattgttcataaaattgtttatagttcagcttctattctagcatgaacggtaattttctctttcgcatttgctgtagttcctccaaatttctcccactttcctatacctaaaggtcaacgtagaaaacaattttcgtcagctagagctgggcctgcaggtctctcttgtgttgcatcttttgggtggagtcagaaggtcctttcttggtgtaagagttaggaagcttgcatttcccaaaggggttgtgtggtgttccttccagagctgaggttgtgggattccaagcagcaagacttaggctgttttctacggcgtccccaaagtcacaaccctgactgatgcaggaacagaatcataaggttgtttacttttctgaatttatcaaaccttttgtctgtgtttgaccaaaattacttttcccgggttgggttggagaatatggagggtgattttctgaaaccattcatgggacatgattttctggggcatctgtacctgcaatgaagggcttactgataagactgaaggccattgtactttactggttggtgttataattgatcatattcatttcttgtcctactgtgacaagtgactgcacatttactggcttaaacaaaaactattatcttacggttctgaaggccagaagtctgaaatgggtctcactgtgctaaaatcaaggtttagcagagccacaactttcctggaagctctaggggagaattggcttccttgccttttccagctcctggagactggccgcattcctgagcttgtggccccttcctccatctgcagaggagcagcgtagcacctctctgactgtccttccataggcatatctctctgagaccatagctgggaaaggctgtccacttttccgggctcctgtgattacattgggcccatccggaagatccagaataatccccacatctcaagagacttaatttaatcacatttgtaaagtcccttttaccatataaggaaacatattctcaggtcccagggattcaggcatgagcatctttgggggccattattctgcctactacattgtcagtcttcaaggacagacttacttcctttgtttctgtctcttaatttgctcctctgaagcctgcaagattcataggcttatgtaacgtttgtgttttgtctctcgaataattgagaaatctggtactgttgagccatttggtttgtattgctcactcactgagtcgattgattggttggttgattgagtgattaatagagacagtctcattttgttgcccaggctggtctcaaactcctggtctcaagcgatcctccctccttggcctcccaaagtgctgggattgcaggtttgagccaccatgcttgccctcagtattgattccctctgaatgagccaggatttgctttccattttggagagcccctagattgctgaacagctcagagacacacttgtgtattgaggtcctctttcctgccactcttggttttggactttatcagggactctgccagagctacttttctggacttggagtctcagagtctgtgtcagctgtgggtaaggaatgagaccaccatgaagcaagcagaggtagcgggtggggcctggcttccaggactttgcagatgctgtgtgtggatttctggggcctgaatcaagagcccctgggtttgtggcttcacagaatggtggaggaagactggtggagttaagggacagaagactcaacaataattagcttgttaatcagcattttggctcaaaaatagtttgggagtatactggtcagctttctgccatgctaatgttgcataacaaacagcccccaaattcagaggcttaaatcgtttctttcttgctcactagtcatggttagctgtgtctctcctgggcttatatgggaataggaaggcctggtcaggttctgggctaggcttagggttgaaatgatgtgtctcctcatcaggggaccctggggcatgttgtttgtgcctctcccatcaggtataggaagccaagataaatcatgcaggcacatttaaagtctctgtttgtcactacccctaacatcccattgaccaaaacaagtcccatggtgaggtccagcctccacgggttggggagggctattctagtctgaaagccctgaaaagtcacatggcaaagggagcagccatagacttccactatgggaggatggaagagttagcattgcagtgcctctgccatgtttgtgggtggaagggaaggtgatccctgtggaagagactgtggatacatccagtcataccctagaaaatcagctctataggtggatttttgaagcactgtgtgcttgttatctttttattattactttatttttgagacaggatctcactgtcacccaaactcgagtgcaatggtgagatcatggctcactggtgcttctttcttctgggctcaagtctcctcccgcctcagcctcccaagtagctgggaatacaggtgcacactcaccacattcagctactttttaaacattttttttgtagagacagagtctcatcatgttgtccagactagtcttgaactcctgggctcaagcagtcctcccacctcggcctcccaaagtgcagggattacaggtgtgagccactgcacctagccagggtgcttgttaaacctgcagcttccttgattccatcttagagccctgttctcacctgaggagaggggattgtgccccttggggaacatttgacaatgtcgggaaacacttttgcgtttcacagctgggtgggggttgctcctggcatcttgtgggcagaccccaggggttccactaagcactgtaatgtgcacaggacagcccccctcaaagaattatctggcccaacaaatgtcagttctgctgaggccaagaaaccctgcacaaacaggcaattttaggtgattttcatgcactttatagtttgagaaccatgtcttgcaagactgttccaactgggaaggggaattggtgattctttccatataagtagacacggacacatctaggaaggaaggtttgatatctcgcagatagttgtgtggagaggcgaattcaaacccaagggtcttagttagatctattacttctgtaattaaaaaatatgttctgctcatattgtattaattctttgttgtattaagtatttactcttgctgtttattagtagcttaataaatggaccgtttatttggtgtgggaagaaatctatgttttattagatttctattatgagcttattttttttctaagtggccttttgccagctgtttcttctgtcctgttattcctgctcaccagcaagattataaattcttaaaaaatttgtttttaattttttttttgagaggggatctcactctatcacccaggctggagtgcagtggctcaatcatagctcattgcagccttgaacttctgggctaaagcaatcctcctgcctcagcctcttgagtagcttgggactataggtgcatgccaccatgctctgctagtttttaaattgtttttgtagagatggggtctcactgttgttgcgcaggctggtcttgaactctagggctcaagcaatcctcctgcctaggccttccaaagtattgggattacaggtgtgtgccactgcaccaccgcatcaccgcacttggccagtatatttatatatatatatatatatatatatatatatattttttttttttttttctttgagacagagtctcactgtgtcatgcaggctggagtgtagtggcatgatctcggctcactgcagcctcgacctcccaggctcaagtgattttcccgcctcagccacccgagtagctgagactacaggtgcataccaccacacccagctagtggccagtaagttcttaatagcagtgatcacgctttatattttgtttctactctgcacagtactcagcatacgataatgatcagtcagttgctaatggtatcaattgcaatgtgagttgcgctctgtggttaaagactcatttatgaggtatccgtggaccagccttttatactttgctataaatcctgtttctaggcttttggggctgaatggttggcatattgatgctcggtttctgtgtggcaattaggagaaaaggtccttgtcactggcaagctgacagcctcctttcttctcctaccctcaagttgttttggtgattgaaatgtttcagatattaaaaaaaaatcaagaattgcttgctgataggacaacagaagtacagttcagggagttaaagcttctccattccccacctcaattgtacacagcaagcatggacagatttccttgtagaaagcatgcaagcagcatttctatggaggatgctgtgtcacctgaaatttgctatgctcagatcagccaagtattgcctctgggggctaccagcaagttatagaaataactttgttatgaaatacttctttaagggggtgttagtattgattcactgaagtggttctccttgtgtacatggagtagttgtgagacgaaggtttcttttcttcctggctccccatgtgggaaggacgcttagtggtttgtgggatgcagggagaggaacagagtccatccttcagttgctctttttactaatttattaacttgcctctcatccccttggctgttaagacactaagctggtgtgtctgacaagcagatgacctaaaaattcacgcgtagtaaaagggaagatgaaaatagaagtatatgaactaaattaggaggaggacttggcttcattaaaaaaatgagaaagccatgttgtgctttttttaactgccacttttccaagtgcaggactaacagtttcagatgtcattatgctaccagtcttggtaatttctaatcatgttttgtctaaagaatatttacattaaaatgagccagcctctttaaagtcacattttagtagtgagaaaaccaatgtccgtttttggaaagggagcccttacctcagctggtgtgagcgttttgtggaggtctgcggtgtttgtgacttgtgccagaggccttgagctagaggcaacataagaaggaatcaaacttccctttctgttcggtatgcctctgtaccaagacgttttgttgattgattcatggcacggtgatacagggtgcatggtatcagatgcagggagtggaatattgttgagattggggctagagggtgtgtgtgtgtgtgtgtgtgtgtgtgtgtgtgtgtgtgtgtgtgtgtgtgtgtgtgtgtaggggaggaaggaatggaaggatgaaaccatttgggaatgtgctggaagacatgcttttgaggacaagcaatgcgattttggcattggctgggtttctgagccagtgatgaatgtagtgcattgctatgtgactgggagtgtgatagagagatattccgctggttatttccctccacctgcttcttatcagtgccatagggcagagtctcaattccacttgccagaatgctttctaggaactctttatgctcaatggaggtgatgttttcccacttgctatgctgtgccttagggaacaggaactggtattatcacataagcaatctctaagtcccttggaagattgtctcattcatcaagagggagaggattctgattttcctgcctggctcctccaggaagtctaacttcttgcaggggacctgttctctcggcccacttgtacagcatgtataaaaggaaatgaagacttttggggatttgttgattcacttgtttggaaattggggttatgtaagcccaatttgagttccaggactcatctatgattgcctggattaaatcaaaggacacccatgtaggctggacgtgatggctcatgcctataacccaagcactttgggaagctgaggcgggcggattgcttggacccgtgagttggagaccagcctgggcaagatggtgacattccatctctactaaaaatacagaaaattagccaggcgtggtggtatgttcctggtcccagctacttgggaggctggggtgggaggatcacctgaacctgggaagtcgaggctgcagtgagctgatatcctgagatcatgccactgcacttcagcctgggcaactggagtgagatcttgtctcaaaaacaaaacaaaacaaaaaaaaccaaaaaacaacctgcgtaattgtagatttttgttgttgtttgatatactgtctcttttcctggaaagaaccctctcgtgggaacagaaatgttgaatttagtcctgatgctgtccctaaccaccccgtgacactggtcccaggaaaatataggaattgtctctctttttctgtcatctcagagcttgagacaaatgttctctgaggttgttttagcaccacactgtgattcatcttcgagactgttcacagcccttgatctgaattgatggagctgtgggggatcataccgccactgccagtgctgagagctgcatgtggtgcggtccagtggctacagcgttgtctttgggatcttcacttggcaccacagcggatttgtataattattatgttgactggaacttagagtgactcaactgccttgaacaggaaccaagaaagagaggaaccaaattccagaagagaatttgccagaacattccagcatattccatactctagggttgtcttatagggtctgagggtacttcttggttatctactcatgtgcgtctgacataattaaaggccgacttagaccctatcagagaaaatcaagttcagacacttagtctaaatggaagtaaggaaaacgattacctttatctcattatcttagttctctttggaagatatataagcttgaaccatggtgacaggtgttgcctttaaacatggtgacaggtgttttcctttaaagtccttggcaaatcaactcatagacttcttcaacttcaaaaaaaaagtttttttaaaaaatattttaaaaatatttaacttgaggatcttcattgaaaattggtcatctttcgtgaatttgcttaagtaggctttgatctctttttaaaggattccttcctgcctgatacatttggtccttttagaattcgggctagaacaattctccatgaaggtggacgtgttaaaatctatttggttcattgttaggatcactcacattacaagagaaatttcggtcttgagtttttgtttttgcttatttgctttcttggaaatgtttccacatcaggtcttagaggagttgtaaaacaggaaggaggagttgacatgctgtttcataaccaatgcttgcttctcgccttggatactaacattttttccatccatttcccacataaaacatggagacaaacaccagagctgctcctgagaggtgctgagtcataggaattgaagggggctgttgggccctcgtgtgtgggatgggctcaagagctatcagtctacagagggaaaggttcatctctgtccctcattgcctgcagtttctctttggccctggctttttccgttcacagctgccctcgacgttcattttaatcaaatttcacctgcataaaagggctatgggcagagagtcttctctgtgatggagcgcagctatcctacaagtatgtagccctgatttagtagagaagaggcaggaattgtcgagggcggaggagcaggagaaatggtgcacaagggagaggggataatgacaggtcattcagggatgtctacggaatgtgaaaatgcagcaagatgggtttcggtttctttttttttaggtccgacagagattcctgggatagctgcatcttcatgttgtacacgcatacacttgattcccattattcactggagctatgttctgtaaagtcgctgagactttatagaaagcatcaccccagggaaaatacacagtgaggcttctgcgaacctctggtcacaatgttgttgtcaagcagtcagtgcataactttgttgtatgtatttctattgtgtgtttctgttggttcctttacattgcactcacgccaacagcactgtgactcacgcctggccgaacctcatctaacgcacgtattttccccataagacgcatcccagccttgtgcttcaggacatgagacagcactgcagcatctgggggccattttaagcagcaaagtcacccagaaactacaacatttcaaaaaactggcactgtgaatagactgcgaaaaggacacttgtttacggagtgagagccttgttcaccctcagctgggaacatgtgcatttggtgacacagccacacgctgcatgtttgagaatgaccatgaaagcgctgcaggtactgattttggagctacaaataaatgttagccaataggcaaattcacagacacggaatccgtaaataacaaggcttggctgtgtgtgtatacatagtgtagtgttgatagtgtgtatacacaatacacattgatattttgggagagattttgaagaagtcaccatgaaagccagtgtgtccgtttggccctctggaaagcgtgcggtgaggaggagtcagggtacaagtgtttaaattggggacatggcctgaggagatgaaagagaggtggggactgagtagggaaagctccacaccacaatgcataactgataaggttttggccaacaagccagagaaccctagagcaaagagtgccccttgcttacagccagagggccttgctcagtgaatatagggggctaggagtggggaggcatctccaaaggagcatcgtggatttgcaactctgtctttctggaaaggatatgagagtcttgccctctcccccagggctgacacagttgtaaaccaaacttttgacttcagttgtacatatcaattattttgcacccacattagattgaaccaaatgacactggctcttttaaattaaaagtggtcaaatgctggcagcctcttagggttcaattcaatggaatcttttaaaggtgcaataatgctgtttgaaatgaggagaacgcctgtgttttgtttgctgagagaaatccactatctctcatccagaagatgattagacccataatggaagccagtcagtggcatgaggaatcatggagatgattctcacctggttgattggatcagacgttcctagcccgaatgagggtggaaagggaaccaagagatgaagtggattgttgggtttatgagaggacggtggttgtctgtctatagttaaggttgtttaaactcatgaccatgagaatgagctttttctggataactctttccttttccttctgatttttgagagtgctgaaaactcaagtcctgtatttaaaaattccatcgttgaaaacatgtttcaaggacagatgacacacttatgattatagcatctgaagtgatgggaatattaaataacctttggttggacatgtaaccatcagggctccacttggtcttaaaaccaaacacacacagttcttgtcgttaaagatatccatggcctggcacagtggctcacgcctgtaatcctaacactttggaaagccgaggcgaggggttaacttgagcccaggggtttgagaccagcctgggcaacatggtgaaaccttgtctctacaaaaaatacaaaaattagctgggtgtggtgttgtgtgcctgtagtcccagctactagggaggctgaggcaggaaaatcacctgaacccaggaggtggaggttgcagtcaggcaccatcctgcgattgcactccagcctgggagacacagccagactccatctcaaaaaaaaaaaaaaaaaaaaaaagacttacacagagaaagcctgaagcccacaagagcaattagcaaaaggaaccctgacataacaaatacggtggtgtcattagcaaccaggtagttaagctcaggggttgctatgtgtcataaacttgaaagctacattggccacgagtaacacaaatgtaggtgctaatcacagatagttggtgggcatttcaaactttctcttcatatctatggatacccaaaacagtgtgcttccatttagaaggcttccattgggaggctgagacaggaggattgcttgagtccaggagatcgagattagcgtgttcctccctccctccctccctccctccctccctccctctctctctccctccctctctccgtctcttcctccctccctctcgtttctttcttttttcttttctttctctctctctctgtctccctctctctccctctccctccctccctcccctccttcctcctcctctctttcttttgaggtggggtctcgctaagtttcccaggctggtctggaactcctgggctcaagtgatcctcctgccccagcctcccaaagtgctgggattacaagcatgcatgagccactatgccaggcctattttccctttcctgctatttcctcccagctaacgcgcttttaaaatttgatacaaattaatttttctttttttgtcttttgttcaaataatgatttgatttctgttctctgtctgggtcgcttcaataacatggatacctacacatagttttatcagtaaaggtcattgacataatcagtgtgttgtgagaacaaagataggccctcatttaagctgctccattactcattttataagtcagagaaggaaggggacagcgtcctctgttttcagatggctattgaagtgagtcagagtgacggtgagcagcatgcattgaattctagctggaaagagggtttttaggcctgcgtttgagcttgccctgaatgaataaggctggaaacctataggccctggagaacattaatgaggaatctgctttccctgacagctccttgataaacgaaatgatggatgtgcagcgtgcagccctgagcaaaggcctggcagctctgtggctgagccctagagggctgagctgggccagggctcccagtagtttgttcaggagcactgagagccacagcaggtgctgatccagctcttgccttcttcgcgagtatctgacaagtctgcagagaccgcaggagcctggctactccttgagttcactgtcttggagcaagcctgtgggggaatcacatgcccccccactctagtgcccattggggacatggaggagggagtttccctatttgcagttaggttttgcgtgctgtccgcgagcttggtttcccctttgggttgcacagtgctgagatctgagcccaaggcagttgggacattaatgatgagacagaggaggctttgctgtgttccacatctatcaggctgctttgcccagggagacgccccccttgcttggggtcttgggcttgggtaggggttctggaatgtctcccctccagcaggctctgcctccttggcttccttgattcagagagcagtgcagtggctttgttgaggagcagcccctgtggaggcgctcatgggtgacaggctgtggctgaatagtggacagccctggtcactgacattaacatggtgcaatagagccttcttatgtgttccttggttcccactgccctttcatggtcgggtgtcctgattgtctgtggctagactatgccaacgtgatcagtgtccttcccagaacccctgaaagagggtcatagattgagatgtctgtcaccacccctgtccattgcagagtcacatacatgctagagaccagctcgcccttgatgcgacctgaggacctcgcccgctagtcattacagggaggggaaagacaataaaaagatgaaagagagtgctgtccctggtaatggaagttactcatcattgtaccagtgggcagccacatagggataggtcggaagagaaaggggaaagagtgaataaaaaacgctgatgtttgtgaggccgagagaggaacagaactattactgctggtcaagggggccatccacttaaaatgttcacatcctgtttcagccacaagctggccaagatcatcacataaagggacaaacgttggccccagaaagaacgcatggtcatcttgagtcaaggctgtctcatttgatgtcagaattcttaagagctgctctggctaggtgcagtggctcatgcctgtaatcccagcactttgggaggctgaggcgggtggatcacctgaggtcaggagttcgagaccagcttggccaacatggtgaaaccctgtctctactaaaaatacaaaaattagccggacgtggtggcaggcacctataaccccagctacttgggaagctgaggcaggagactctcatttgaacctgggaggtggaggttgcagtgagctgagatcaggccattgcactccagcctgggcaacaagagcaaaatcctgtctccaaaaaaaaaaaagaactgctcttggctgggtgtggtggctcacacctgtgatcccagtgctttgggaggctgagacgggaggattgcttgagcccaggagttcgagattagcatgggcaacataacaagaccccatctctttaaaaaattagccaggcatggtggtgtatgcctgtggtcccagcaacatgggaggctgaagcaggaggatcacttgagctcaggagttggaggctgcagcgagccatgatggcaccactgcactacagcctggacagcaaaggaagaccctgtctcaaaaaaaaaaaaaaaaaaaagcaagaaaaaaaaagcatccaggtgtggtggctcacacctataattccagcactttgggaggccgaggcaggcagatcacctgaggtcaggagttcaagcccagcctggccaacatggtgaaaccccgtctctactaaaaatacaaaatattagctggatgtggtggcgggttcctgtaatcccagctactcgggaggctgaggcaggagcatcgctcaaacccaggaggtggaggttgcaatgagccgagactgcgccattgcactctagcctgagcaacaagagcaagactccgtctcaaacaaacaaaaaaaactactctccaaacagaacctgcacctacccaattgtggtgggtgcccctcctggggctcctgcagtagcggtggtgtgggaattgagaatcttgcaagtgctatgagggagctgagacactgagtgtggcagggccatgtgcccagagcatgcacaacccatcctaacgtctgccggggaaggtgggggatttctgtgcattgcttttcaaccagaaaggtaatttttgttccccaggggacactcggcaatgtctggagacagttttggttgtgacactgggttaaggagtgctactgtcatctaatggatggagagcagggatactgctgaacatcccacagtgcacagggcggcctcacaacaaccaagaccacctggcctcaaatgtcagtagggctaacatccagaagctctgcgagtctgtgggaagccctggatgccccaatcctctttcattttcttctcaccacgtaggacagtttagctggacagtacacaggactcattcaaggggtcatgagaggagacctcatagcataagggtcaagtacaaggactttgcagtcagactgacgtgggtttcagtccctacccatcctagtggtgtgaccgagagcaagttgggcatagtgacatctgtcttgattgactttggagtttgacaggcagtacatgcaaagttctctattcccatgtcactcagagtgagtgtgcaaaacatactattgttggcatccatcgtcataagagtcactgtgaacatgggtgagcttagcaccttgtggcacggggctgtggtgagggactcagacagctttatgattgagtttgggcctcagcgagatggcaaagctatgcttctcttgctccttggaccatggtgacctgtgaggacccctgggggctgccttctccactgttgcagttcagggagctaaggccaaaggctactgcagtggtggactctggggtccccctggtgacaaggaagggactttgagctttggaatgccctgggctgagtcttgccacctgcaggtttgtgaacctcatcatgccttgtttttagcacaacaaaatgggataatagtgactttattattgatatactattatgctgttttcaggtatgtgacactgctgctattttactgtttcttccagatttccgtgagggtggaagaaaatcataccatatcagatgcctcgcagagcaccaggcccaccgtgaaaggtacagcaaattttacttccctcttcttgcctcgttggaaattctttcctgtgagatttcctcccctccgccctccgcgccttctgccatagcctatagcctcctctgggagttcttggataattttgttgccttatacctttgcaatttccagtatggtagccatgcgccacatgtggctgtggagtgcttgaaatgtggccagtctagattgagatgccttgtagaagtataaaatacacactggatttcaaagacttagttcaaaaagaaagaaagcaaggtatcttattgataatgtaatacagtttacatgttgaaatgatcacttggatacgtggagtaaaatagaatgtattattaaatgtaacttcacctgttttcttttgacatttttttgtggacccagaaaattgatagacaggtggatttccttcacacttacacacttgtcttgctcaagaccagccctgcttcctcactggctgctcagtcaaatgcctcctccagtttaagctgtccatcacggggccacccattatgtgtccatctcatcttctctgctcagtgcctgtgcaggcagctggtgttcctgctcctcccgcccagctttgcttatgatgctagtcttgagtgcaggctgctgagcttctcacctttcttcccatacatgtagaacctctcctccagaaacatggggtacttaccagctggcaaggagcagagctggggttcacattcatttctgtcttgctccaaatccatgtccctaatagattactgtctccaattgctttgtggatgtaaacacatagtaagttcctagagagcagggaccatttttatttctttcatctctgctgttcaagacctttctaaagcttttttgaaagaattaagatttctagtctcttgcccttccactttctgctatgtgaagacacagtgttcctgccctctgccctctggatgctacagcaacaaggtgccatgttggaaggaagcagagaacatccctcaccaaataatcaatcctgctggtgccttaattgtgaacttctcagcctgcagaactcacgaaggtcatcaccatgtaggctgattgatcttggacttccaagcctccagaactcaaatcagtgaatttaaaaacattttatggagggcggggccaagatggccaactagaagccacggtgttgggaggctgctatcagaaaagaccataataagcgtgtgaatccttcatcagcaaccaaggtatctgggttctctcatcaaaattgactagaaggctggcgtgacccacagagagaaggaagaacagtgtggtgtggcggcccacctgagagtcacatgggaaagggaaccccctcactccagataaggcaggaggtgagtgagcacgctacccagccggggaaactgcttttccacagaactgtgaaacccacggattggaagatctcactcgtgaacccacgccaccagggcctcgtgtcccagccccagaacacacagattcttacagcctctcagctggaatccgcttaagcttaccaaactcctcggggaggggtgaccagtaccagctgcagctgcctgctgtctaagccctttgaactcctgcagggaggggcagcagccagcactggcaactgcctaacatgctaagctccctggacagggggaagggtggcacccatttctgtagctacaggctacgcttttcccctgctagagccagggaggctggacagcttggtcccaagacttgtccccacagcccaacacactggctgtggcagtctgcggctagagtgcctcttcaggcccaatcccaacccatcctttcttagttggggtgtgtgtggggcggggcgcttccctgctggatctccagtaactccagccagaggctaagggacagaatttggatctcctgggcctcagcccataggggaggggtggccgcagtctctgctgaccagcagatttagcttttcctcctggtagttccaaggaatctggacagcccagatgagtgggtttcccccaagcaaaacacaccctctccaccaagggacagagtgctccattaaacgggtcctgctccctgtgtcacccaactgggtgagacccttcaacagggcttgtcagataccctctgcaggagtgatcctactggcatcaggttggtgccccttgaggtcagaggtcccagaagaaggagtaggcacccatctttgctgctctccagcatccttaatgacatctccaggcatgggagcgaatcagatgaataaggcctgaaggtgaaccaccagcaaactgcagcagccctacagaagagggactggactactgaaagaaaaacaagcagaaagtgacaacaacagcatcaacaacaacaatcaaataaaaggtccccacaaaaatctcatccaagggtagcagcctcaaagactgaaactagacaaactcatgaagatgagaaagaatgaaaaaatgctgaaaacccaaaaggccagagtacctcttctcctccaaatgattacaacatctctccatcaagggcacagaactggacggaggatcagatggatgaattgacagaagtaggcttcagaagatgggttataaaaaactacaatgagctaaaggagcatgttctaacctaattcaaagaagctaagaaccttgataaaaggttagaggaattgctaactagaataaccagtttagagaggaacataagcaacctgatggagctgaaaaacacagcacgagaactttgtgaagcacacacaagtatcgtgaagcataaacaagtatcaacagctgaatcgaccaagtaggagaaaggatatcagagtttgaagaccaccttactgaaataagacatgcagacaagaatagagaaaaaagaatgaacaaagcctaccagaaatatgggacctcataaaaagactgaacctacgattgagtggagtaccagaaggaggtggggagaatggaaacaagctggaaaacacacttcagggtattatccaggagaacttccccagactaccaagacaggccaacctgcaaattcaggaaatactgggaacaccattaagatactctatgagacgatcaaccccaagacacataatcatcagattttccaaggtcgaaatgaaggataaaactaagggcagccagagagaaaggctaggtcacctacaaagggaagcccatcagactgacaatggacttctcagcagaaactctacaagccagaagagattgggggccaatattcaacattcttaaagaaaagaattttcaacccagaattttatatctagccaaactaagctttctataaaatcctttccagacaagcaaatgctgagggattttgttaccactaggcctgccctgcaatgtctcctgaaagaagcactaaatatggtaaggaaaaactggtactagccactgcaaaaacacatgaaaatataaagaccaatgacactacaaagaaactgcatcaactaatgtacaaaataaccaaatagcatcatgatgacaggatcaaattcacacataacaatattaaccttaaatgtaaatgggctaaatgccccaattaaaagacacagactagcaaattggataaggagtcaagactcattggtgtgctgtattcaggagacccatcttacatgcagagacacacacaggctcaaaataaagggatggaggaaaatttaccaagcaaatggaaagcaaagaaaaaaagcaggagttgcaatcctagtctctgacaaaacagactttaaaccagcaaaaataaaaacagacaaagaagggcattacataatggtaaagggaacaattcaacaagaagaactaactattctaaatgtatatatatgcacccaatacaggagcacccagattcataaaataagttcttagagacctgcaaagagacttagactcccacacaataatagggggagactttaacaccccactgtcagtattaggtcagtgagacagaaaattaacaaggatattcaggactcgaactcagatctggatcaagtggacttagtagaagtctacagaactctctaccccaaatcaacagaatatacattcttctcagtgccacatggcacttattctaaaatcaaccacacaattggaagtaaaacactcctcagcaaatggaaaagaactgaaatcatgacagacagtctctcagaccacagtgcaatcacattagaactcaggattaagaaactcattcaaaaccacataatttcgtggaaattgaacaacttgctcctggatgactcctgggtaaataatgacattaaggcagaaatctagtatttctttgaaaccaatgagaacaaagagataatgtaccagaatttctgggacacagctaaagcagtgttaatagggaaattttgcactaaatgcccacatcagaaagctaaaaagatctcaaatcagcaccctaacatcacaattaaaagagctagagaggcaagagcaaactaatccaaaagctggcggaaggtaagaaataactaatatcagagaagaatcgaaggcgatagagacgcaaaaaagccctccaaaaaatcattgaatccaggagctggttttttgaaaaaattaacaaaatagatagactgctagctagactaatagagaagaatcaaatagacaataaaaaatgataaaggggatattaccactgaccctacagaaatacaaactactatcagagaatactataaacacctctatgcaaataaattagaaaatctagaagaaatgaataaattcctgcacgcatacaccctaccaagactaaaccaggaagaagttgaatctctgaatagaccaataagctctgaaattgaggcagtaattaatagcctagcaaccaaaaaaagcccaggaccaaatggattcacagctgaattctaccagaaatacagaggagctggtaccactccttcagaaattattccaaacatttgaaaaggaaggactcctccctaactcattttatgaagccagcatcatcccaatacccaaacctggaagagacacagccaatatcatactaaatgggcaaaagctggaagcattccctttgaaaactggtacaaaacaaggatgccctctctcaccactcctattcaacatagtattggaagttctggccagggcagtcaggcaagagaaagaaagaaagggtattcaaataggaagagaggaagtcaagttgtctctgtttgcagatgatgtgattttgtatttagaaaaccctatcatctcagcccaaaaacttcttgaactgacaagcagcttcagtgaagtctcaggatacaaaatcaatgtgcaaaaatcacaagcattcctttacaccaacagtaggcaggcagagagacaaatcatgagtgaactcccatagacaattgccacaaagagaataaaatacctaggaatacaagtaacaagggatgtgaaggacctcttcaaggataactacaaatcactgctcaaggaaataagagaggacacaaacaaatggaaaaacattccatgctcatggataggaagaatcagtatcatgaaaagggccatattgcccaaagtactttatacattcaatgttgttcctgtcaaactaccattgacattcttcacagaattaggaaaacctattttaaatttcatatggaatcaaagaagatcccacgtagccaagacaatcctaagcaaaaagaacaaagctggaggcatcatgctacctgacttcaaactatactacaaggttacattaacaaaaacagcatggtatgggtaccaaaacagacatatagaccagtggaccagaacagagacctcagaaataacaccatacatctgtaaccatctgatcttcgacaaatctgccgaaaacaagcaatggggaaaggatctccttattcagtaaatggtgctgggaaaactggctagccatatgctgaaaactgaaactggaccccttccttacaccttatacaaaaattaattcaagatagattaaagacttaaatgtaaaacccaaaaccataaaaaccctagaagataacctaagcaataccattcatgacataggcatgggctaagagttcatgactaaaacaccaaaagcaattgcaacaaaagccaaaattgacaaatgggatctaattcaactaaagagcttctgctcagtaaaagaaactatgatcagagtgaacaggcaacctacagagtgggagaaaacttctgcaatctacccatctgacaaaggtctaatatccagaatttgcaaggaacttaaacatatttacaagaaaaaaacaaccccatcaaaaagtgggcaaaggatatgaacagacacttctcaaaagaagacatttacacagccaacaagcatggtaaaaagctcaacatcactgatcatcagagaaatgcaaatcaaaacctcaatgagataccatctcatgccagtcagatggcgattattgaaaggtcagaaaacaatagttgctggcaaggctgtggggaaataggaatgcttttacactgttggtgggaatgtaaattagttcaaccattgtggaagacagtatggcgattcctcaaggatctagaaccagaaataccatttgacccagtaatcccatttctggatatatacccaaagtaatgtaaatcattctgctataaagatgcatgcacgtgtatgtttcttatagcactatttacaatagcaaagacatggaaccaacccaaatggccatcagtgatagactggataaagaaaatgtggcacatatacatcatggaatactatgcagccataaaaaggaatgagatcatgtcctttgcagggacatggatgaagctggaagccatcatcctcagcaaactagcacagaaacaaaaccaaacaccgcatattctcactcataagggggagttgaacattgagaacacatagacacagagaggggaacaacacacaccagggcctgttggggagtggggatgagaggagggaactatgagggtcagtagggatggtgctactaattaggtagtagggtgctgcagcaaaccaccatgacacacatacacctgtataactaacctgcacgttctgcgcatgtatcctgttttttttgttttttttttgtttttttagaaaaagccgggtgcggtggctcacacctgtaatcccagcactttgggaggccaaggcggacggatcacaaggtcaggagatcgaaatcatcctggctaacatggtgaaacaccgtctctactaaaaaaaaatacaaaaaattagccgggcgtggtggcgggcacctgtagtcccagctactcgggaggctgaggcaggagaatggcatgaacccgggaggtggaggttgcagtgagctgaggcgacaaagcgagactctgtctcaaaaaaaaaaaaaaaaaaaagatttctagtacattgcctaaaagaacccttggatgaagtcagacacatgggtagtatgagaccccagatagcatcattttgtatgtacagaatcgcttttttttttttttttttttgagtcaggttctcactctgtcacccaggctggagtgttagttatgtggtcatggctcactggagccttgatctcgtgggctcaagtgatcctcttgcctcaacctcccaagtagctgggattacaggcacacgccaccatgcctggctaatttttgtattttttgtagagatggggttttaccatgttgcccaggctggtctcgaactcctgggctcacgcgatcagcccacctcggcctttcaaaatgctaggtttacaggtatgagccactgtgcctggtctagaattgcttttagtggatgattttttgctgtcactgttaatggcgtgcattttctgagttatcagagatggccctgcatgctgcgagtctgtgttgactgtactgttggctgtgtgtgtggagggcaggaaagtgccgtccttgctgtaacttgtgttattaatgatatggacactgtgagttgcttctagagagctacacctcacttctgtgtcagcaaatgaaggcccaggaactgacagcgttccctctagctttaattgcggtataatcaccacaccctaacattctcctgttttacctttggcaacatctagagtttggttgtcacagctgatggggtgggggtgctatggcattgggtgggtagaggccaaggatgctgctgggcatcctacactgcccaggacagccccccacaaattatccagccctaaatgtctacagtgccacaggtaagaaatcctggaccgtagggtagacagatttgactggagtggagaaattgtatcctggggtaagtgggatttggattgcagttagtgcagagcttgtgtgtgtggaacgccttggacactggactaatccaagaagttgggtggggaggaggggggctttttctttaggtcctggaaaccattaaaaacctttgaacaggtgctttagaaagacaaaactggcatctgtctgaaggatggattacaacaggcaccagcagactgtggcccacggggccgtgtccagacttggcacacaaccatgcccattcattcatgggttgtctctggctgctgtgatggttaactttatgtgtcatcttggctaggccatagtattcagatatttggtcaggtacttaggaatgttgttgtgaaggtattttttagatgaaataaacacatcagtagactttgagtaaggcagatgacttccataatgtgggtggacctcatccaatcagttgaaggccttaagaaaaagactgaggtccgccaaagaggagggaattctaccagtatcctgcctttggatttgagactgtgacatctgcgctttcctgggtctctggcctgctctggaaagtttgggcttgccggcctccacaattgtgtgaaccagttccttagaatctgtccatctgtccgtccatccatccatccatccatccacgcacgcacacataaacaaaccctattggcactgtttctctggacagccctgactaacatcactgctttcttgccacagcagccaagttgaatacgtgcttgtaagtacagggattgtgtggcccacaaagtagaaaatatttactctctggccctttacagaaaaaaggccaagcattggatttggtaagtgaagtccttccatgaaactgagaagtgctgagtcagtactcaatgggagttaaaacagagaaactgtaaaagccaagagggctcaggatggtgataatcacggtctttcattcttttctcctgtgcacatttgacccgctggcatgcaggagatttaatctctctaatccagaatgtgttttagggaatggcttgcctggcttgtgggttgaaatgttctctcctcagatgtggctcctgcaatatcagctcacctgatgacaagaagtggaagccatgtaaccacctgagacgcaagttaattagggtttatcagaaagacaacctgaacccctgtgggatgtgctgtgggtgaagaaaagataccagtattctgtgattccaaataggagattttaaaaattctacccctggaggatgggttggcatttgtcttccaaacataggttaaatacgttttatttctgtctgttttgtacacattttaatcattttccagctcacaattacagttggtacttctcaattctcagtgaattgtgtagtggaattgtttgcaacatcatactttggaaatgacgttggcaattaaagttttggtccaagtttaataatgaagactatttgaaaggccaaaaccgatggatgcttttgagatgaaatagtcatttgggaagaaaatgagggcaggttgtctacttcttaacatttatctgtttttttttcttttttgagagggtcttgctctgttgcctgggttggcgtgcggtggcgcgatctcaggtcactgcagcctcaacctctggggctcaagtgattctcccacctcagcctcccaagtagttgggattacagacacatgccaccactcccagctagttttatttttttgtagagatggggtctccctatgttgcccaggcttgtctttaactcctggtctcaagtgatcctcctgcctcagcctcccaaagtgttgggattacagacatgagccaccttggattacaggcatgagtcaccacgcctggccttaacattgatcttgatgacactgaaatcgttgatgtgtgccaagggggttcctttttctaaatggaagctcactgttttgggtatccatgaattcatcatagatatgaagagaaagtttgaaatgcccaccagctgtctgtggtagcacctacatttgtgttactcatgaccaatgcagctttcaagtttatgacacgtggcaccccctgagcttaactacctggttgctaatgtctttggacatcactgtatttgttatgtcagggttccttttgctaattgctcttgtgggctttcagactttctctatgtacgtttttttgttttttggtttttttttgggagatggagtctctgttgcccaggctggagtgcagtggcgtgatccactgcaacctccacctcccgggttcaagtgtttctcctgcctcagcatccctagtagctgggactacaggcatgcgccaccacgcctggctaattttttgtagttttggtagagatggggtttcaccacgttggccaggctggtcttgaactcctgacctcaggtgatcctcccgcctcagcctcccaaagtgctgggattacaggcatgagccaccgcacccggccagtgtaagtcttttgaaacacagacacctagtgcctttcccgtgagtctttcagggaaagattgagttccgtgtcaggttggagttgctgatcaagcgactgactatacggcttcctagccccctttatttgaaaaaccagcgtggtcttcacttttcccttgagcctacaaccacagggtgcctgttcatgtatttccaggaccttatgcggctcctttgctctgcttattccgagaaccaagccttgggactgtgcattttgaatacaaatgaaggcacccggaggaagcccccagagtctcggcacagttgaggaaacaaacaaagcatgctacacgtgcaggaagatccctctttaattcctatgatgacctctctgcttttttattttttaagttaaaaggagtcaatgctttgggttttgttagactggacaaggtagcaagtcatattaaactaacccaggttgttgcttgagttttcactgaacttagactctactgacgagtatagtcaagcagaaattcccctcacgaggtggcctgatggtgtactccagtgggggggtgcagaagatttggagggatctgcttcccgactggggcaggttaacctctttctgccttagttacctctttgcatgtcctaagagcacctgcttatcagatccttaggaggattcactgaattcgtccacttggaatccacatggaaggctgcctggcatgtaggaggtacccagtaaattttagactcctgttatttttgccagttggattcaacagatgtttgttccctggactagtgtttctcacctgggggtgatctgcacctaggggacatttgacaaagtctggagacattttgggttgtcacagcttggggagggagtgttactggcatccagtgaatagtaaccaggtgtattagttttctgtcgctgtaaaggaatacctgagactgggtaatttagaggtttatttggcacatagttctacaggctgtacaggcatggtgccggcatctgcttggtttcttgggaggcctcagagcttttgctcatagcagaaggcaaagggagagcaggtgtctcacatggcaagagagggagcaagagacagagggaaggctaggctcttttaaacaaccagctcttgcatgaactgagggaactcactcagtaccagggggagggcaccaagccatggttcctccatgaaccaaacacctcccaccaggccccacctccagcagtgaggattaccccactacatttcactgtgagatttggaaagggaagacatccaaactatgtcaccaaagatgctgctaagcatcctaccgtgcacagagcagcccccataacagggttacctggcaccagagtgtcagtagtgttgaagttaggctacactgtagttcacttgcttattgtgtgtaggaagaccggaggccagttacctggcaataacaacaacaacatcaaaaccccctcaaacccaaaacaaaaaaaccccacatgacactgtgagtgttttttttttaatttgcaggagattgagtcttaatccagttgaagacctttatttccttgctagttacagagaggtttttcctggttcgttgcctgtgtttgttgcagttagtttttattgacctttctagggttcatgtgtgtcccttgggtttgccatgttttgttctccaaagccccaggagggttccccagtaacagagactgtgttagatttttaacattttcttttactttttgttttaaatgatttcttttgattaattacacactcacactgcgttgcaaacatagtgctgtcagatcccagtactgtgtcctttaccggctttccccaaggggagtggcttctcacaggatcatagagcaggaaaacccaggaaatccacgttggtgcaacacagttacctagccttggagcccttacttggatttcaccctttttgcgtgtactcatttgtgagttgcatgttaaagatgagagtcagtaatatatttccaaatgtcaacagaacataaattgagcagaagagtttataatgagatggaggattgagcagaagagctcatagcgagccagggcgaacaacctggcgaggagctccttgactttcttggaggccgaggtgggagcgttggtgacaacccccgggaaggcagatgttatcaggagttaaaatgtgatgtgtgtaccgctcatgtgtgtatggggtgtgctccttttgtttttgatgctgaaatgagacaaatcatttcccttttaagctccaggcagactgatggaggggggaaaaataacacccaacttactgcaacctgaaatcctttgccttggatccacttcctaagttcctatagtccttattttataaactgataaaacaacttttctctctcaagtgatgatcatcttgtgttttacactaattaagcccatatacacctccctttggaattccttcttctgatctgcttggcctgtttgccagttagtcgccttactaggagaatcaaaatgtaaactcataatagacaggaacccaacatcatcagcacaggatgtggcagaatgatttttctttcccacctcttgctgagaaggcaatgagattggaaatggcaaacaccccagagttctgtaactctgagtgtggaagaggaggtggcagcccttgacctcagtagcggagccagatcatcgaacatccccgtccaggaatctggacatgcactggtcaagaattcagcacaatttcctttggtctggggattgggaagctctttttgtgagtgaggcatggagtgaaattgcagaagcctgcgtgacttgtagaaaccgaagccaggctcgtttactgccttgcacaagggagatatgataagacagaatttatttgtgagtgtcgtcgatgccaaggagcctgtccaacatttatagaggcttttgggctaaacgaaaaagggtttgatctgtctgtggagacagaaagtagatgagtggttgcctaggactggggctttaggcgggtaagaggttgtcactgctaaagggtacagggttaatggaaattcttgaaattgtgctgatggtggctgcacaactctgcaggtactaaaagttgttgagttgtactcgaaatgggtccactgtatggcatgtgttttatatctcaataaacctgtcaaaaaagggtgcaggaccactgtttttgtacatgtcctcaaaatacttcctgtaatctagtgtggtcacagctggttcatgtgcacggacatagtgtcagtgtcattgtggagatagcagtttcagattcactggttccagaaaatgtgtccctgcctgttatctccgtgttgccacaattaagaaccaagggtccataacaagcagtgaaaccatggttcatatcagaggaagtggggtggtgtcatctcttttgtatttttctcttttctctcccccactgcctttgcccacttccttctccaaaataaaacaaaagagagaaagcaagagataagtggctgagctgaatgtggtccagccctttagaagaggggagtacacatactggagggaagataagcgaaaatacagcctttctcaagggccagcacagacggagataaagagagagccacaggcacactggccaagcatcagctcctcaagcatccatctcactattcagggtggggaaatacttgatacctcaagtcctctttatcatcgcagatgaaaactgacataggtgatttcctttcggagcatttagggagaatgcaagggaaattgacaacacacttggtgcaattgggtaaccagtctttgtgttgccctccaatgactcttgcttggaaatgattggaagcccatcgttttaagtcattggaacgactgtccccttcataaagcatgatgtagcaaaatgaaaagcatacttctggttaaaagtgtttttcaaaaaaagcttaccacattgaggaggtcatttcatatttcctgatattcagcaattttgctgtgagctttgtagagttgttctggtgcttagttcaaataagaaaggaattactgaaattgcacattaagttaaaaaaaaaatcagggttttgggtcctgagacttgttacctaaacatctgtcttgctattttgttacagcacaaagtaggaattgtaaaacatcttcgttataaactgagtactatacagtctctgggagagcagaagaaacgtggtaggaaggaaccacccagggtgggtaatgacagagtagagatagtcagatagggccggagacaaggccaggaaaggcgagaggaagagcctgcaggaacgagtttcttgcacgtttgagagctggacctgccaagagggtaaggccaacatctgtgtgtgttctttgaggaaatccgagtagcctgccctgcctttgaccctctgctctttgaactgtggattccttcccatacacctgtgcattctcagtgccgtggtcagatccccaaacagacaccaaaccccgacctccgaggcccaggcaggagcataacccagccccaaggggagataaagacagaaagaatcagtattatagcagggacctttttcaggaatctgccttctgcagggcagtgccctaggtgcattcaagccagcatagcaaatccacatcactagaaagactctttccgttttataacttgggaaactaaggccaaggcagtgacaaatgccaggtccccaaactctgaactgcagatctgcaagctgaatggtggcaggtgggccagtgggattttaaagccgtgtgcttttcagggcaccctggtgcttctccaaatgccggaagggtttccttgaaaattcatagcactactcagtcaggattctgcaggacagtgccctggggagtgcatgagtggatggttctgtgggtagaagccacgagctgaagatagttttacatgtttaaagagtaaagagactgggagcggcggctcatgcctgtaatcccaacactttgggaggctgaagtgggaggattacttgagcccaaggagttcaagaccagcctaggcaacatagcaagaccttgtctctaaaaataaataaaataaaataaaagccaggcatggtggcagtgctcctgtagccccagctatgcgggaggattgtttgagcccaggagttcgaggctgcagtgagccatgttcatgccaatgcactccagcctgggcaacagagccagatcctctctcaaaaaaaaaaaaaaaaaagaaaagaaaaaaacagtaccttgttgatacatggaaatgatgtgacattcagataaagttttactggagctccgccatgcccattcatggacatattttctatggttgctttttcacaacaaggggtgttgcaaccatggcaacagacactgtctgtcttgcgaagcctaagatatttgctctctggtcctctgcagaactagcgtgtagttctgagtgcttgaaggcacgtaccatcttggtggtgtgacttggactttcacctctcctgatcccttcttcatttccaccctactctcatcttgccttgcttgcagaagcctggtattttcataattcgagagtcacttacttcatgtgaagtcttgtcccagttaaagtgccaatagtcctgggagaggtaatacattaaaccttatcagttatttatacctcaggattggaagggattgttgctggctttgtcctataacagctgcgaccagaggacagagcctaagggctgttgcatgaaatgagggaggtgtgggtcacctctgtgcagggcatgagaagagaggaggctgggtcatctgaaagatgacctttgttcatggcctttttctgtatcctcctcagtcacccagaaattgggattgttggtgacaatcttttgggaattggtgttagcttcggagagccacttagcctgaagaccctccttactccgttatcatagaaccagagtggtagccacacaggcagactgtccatgctgacgtgtaaggcagggccttacacctcctacccatgtaggaggtggtggagctgggattttacatggacagccttctgctcccctggtgcttagctacattctagtgccttctgtgcaatgccagcttaacatacatatgaagtgtgctgacccaatctcctgcctttgcgttcactattttagatggttgtgtcaccttgagcctggactagggagataacacgtgaaggagatgccgcgtggtttctgtcttgtccatggtacgtggaacacattcccctcagtaacattatggttgagacatggaatgccacaatgtacagttgccaccatatggtatacttcatatatatacacatatatatttatttagtttattttaatttttttagagacagagtcttgctctggtgcctaggctggagtacagtggtgcagtcgtagctcactgcagcctcgatctcctgggctcagtgatcctcccactgcattgtcccaaagcgcttggattataggtgtaagccactgggcccggcctacttgtatatttttcattgcaaatgtacatttcagttacgttgtgggctttaaaaagcctttctaggctagttgggaatttgaccctattttttacagcatagtttctaggagaaaaacatttctgaggaagtaacaaaagaagacttgggctgtatcccatttttaatttagagagcactgtcatttgaaaatttcttctctcaacatgttttctttttgagacatgaagtaggcaggcaggatcttttttacagtggcgctggtgtctttgggaagcggcttccttggtttgcctttgctcattttctttcttgacttctccaggcattcagctgcaggcatgtacctctgctgctgggagagtggcaaggagagggggttggaggaacggggataaaaattagctagaattcaaaaacggcagtgacagcccagatgatttttcatgctaacctactttaaaagctgccagaataattgtggagtgggaaatctctcatttctcctgtcctactctgacaagatctaaaaataactttgaggagatgggcatgtggccctttgatctccttggcctggagtatttcttggtaggagcagagcttacaagaaggtgttcttcaatgagtgttctggcagtcggagttgtgggtggggctgattactgtaatcttccttcgtcattgaacgatttcatctgcccctggtttccattacttgctgctctaaatattcctctccccgcaccttccttttatgtagccacaaactggaatatgtgcatggaaaacccaaaggaggcaaatcccacttacactgcagaactttggtgctggatttagcggctatttaccaagcacctcctcttccagaataagtagcacagatctttgaccgccccccgccccccaccgagggactgtggtctagttggaagacacaaggcagaggtgtaaaaagggaactctggagataggaattggaaatggggctgagagctgaagagatggcctggggctagagaccagggagatgggaggagggggagttccttggaagagtgtgcccctaagagatcctgaagagtgagcagagattgatgagaggcgagaggagacctagagttatcagggctgcagaggtgtccttggcacatagaggccatagtatccacgttggcttccagggtaggggcagtgcatctgcggctggctgaagatggaataaatgggatagtggctaaaaagatgggggtattgggggaacacctctccttggagtggtcctccttgcagataaggggagacgtagaacagcacttgacagggaagctggtgtgggggaaggatttttttacactaggggagacttgtggttgagttaaacaggttctagaggccaggcatggtggctcatgtctgtaatcccagcactttgggaggccaagttaggaggattgctcgagcccaggagttggagaccagcctgggtagcagcagcatagagagaccctgtttttacaaaaaatacaaaaattagctggacatagtagcatgcacctgtaatcccagctgctcgggaggctgaggtgggaggataacttgaccccaggagttggaggatgcagtgagctgcagttgtgccactgcgcaccggcctgggtgacagagggagaccttgtttctaaggggaacaaaaaaagaagttaaagagataagataaagaatggggggaggggacgtattttttgcaggagggaaattttgagggtttttagccttggaaaaggagcagaacagatgggaaggtcgtaaacgtggaacctttggaagcagaaaggaagatgatttctcttaaaaagttttgcctagagatgactaatgtgaaggtcttggtgttttaagggagcagggaaagccagaggtggtgggtccggtagatgcaggaactgacccaggctttcagattgtacactggggagcagagagtgcgtgcttgggggtggggaggctgctggccagggctgaccttcctcccatgacccctgcgtagaatcagagtagcctcatttagtgtacttgagtcaaggccttctgtttaagagcttatttgaactcattacagtcatcgcttggtatccttgggggattggttccaggacctcctgcggatacccaaatgattgcacactcaaatcctgtagtcctctcagcaaaacctgctgataggaaaagtcagccctctgtgtctatgggttttgcatccccagatactgtattttccatctgaatttggttgtgaatgcagaacctgcccataaggagggccaattgtatttattgaaaaaaatccgtgttgttcaagggtcagttatagtttgaactacaaaaagcaagcaaccaaacaaaacccccaaaaaccaaagctttaattggttaagtcagagcagactaaaaaggactacatgcccagtggaactttctgtgtagtctagtagccatatctggctatgaagcacctgaaatgtggctcatgcaacagaggaattgaattttaaattttattccttttaaatatttatttttgtctttcttcgtttcttttttttttttttttttccctgagatggggtctcgctttgtcacccaggctgaagtgcagggtcgcgatcactgctcactgcagccttgacctcttgggctcaagcgatcctcccacttcagcctcccaagtagctggggccacaggcatgagctactttgcccggctaattttttaacttttgtagagatgggggtctcgccatgttgcccaggctggtctcaaactcttggtctcaagcaatgcttccacctcggcctcccaaagtgctaggattacaggtgttgagccacaatgcccagcctaaatatgtatttcagtagctccatatggggaggtgtcttggacagagcaggttagcccgtgagactctctggtccttgagtgagagggaaggatgagggcttgcagatgatcccagtgggctggttctggaagcgaaacctgcaggccccatggcttggggaaggctgaccatagcaggtgggaggagctctctgaaggccgaggctgagcactggtggagaacagggcccgtgctcacgtatcccacaccccagaacttggtgtgctggattccagccttgtgtgtttctcattatgactatgtaaatgccaggagggttgggactgtgtgatttttcttcttgcttggatgctcgagagttcttcattaattagtgaaggaaagctggctctaaggagaagcagttgaagtggagttcattgcccccacttctctgcagcaggaatgccttgtccctcctgcctcggttgaactcactttctcaggctcccacctttgaatggaggcccttgtcaggctctccatccccagcgactctgttgacatttccccatgggaaaggaaaagaccatctgaaagtttccatctgtgtgcaaggttttctgaacatgttgacaacatgggtttaattttgtgaggtcagcaagagttcttgtggtttgggatttagtaaaaactgtaggctttgtatgggaagaaaatctctctcacctctgtcttctattcttcattctctacacagactctccacttgtctttagcactaaaaacacaaactaagcattatgttttaaaaaaaacccaaaccccaagtccagtagctgattgccctgctttagcttttctccctcgttgtcattcttcaaagaaagactccactcctttcagctgtcaccctttcaccctgatcaccgcatgcagtctggcctctgccccgcttgaaagaagcactcttcccagggcacccgggaactcggaactgtgaacccccagagtctgcccagcccctctgtccctgccttttgagcaacagcgactggtgccacaacctggggtgcccctttccctgggcagcattacccacactgggccaccgtgggccaagtcacccacactgggccaggtcacccacactggaccatatgaggccacgccactcacactgggtcatgtcacccaccccaggccacactgggccatgtcacccacacttggcagggtcctgtctttctccactctggtgtctcctttatcttgatgctcaagactctctcaaaacaccagtggttcagcacagtgtggggacagagacttcagcgaggcgcccccagccccacccttgacgggaaataagcgcaaactccttgtgcctgagactcaaagggtcgtgtgcctttattggcccccttgccttacaccagtgttcttaacctttctgtgtgtgtgcgtggctctctgtagtcatcgagtgaagccgcagaggtctcagaatcacattctaaaataaaagtagaatcataaaggaagcgattaaaagtgcaattgtcaaaatatcaaaaacatgatttgttgaatagtgcttttttcttttctttttattggtaaaatacatgtaatataaaatttagtcattttaaccttttttttttttttttttttttttttagacagagtctcactctgttgcccaggctggagtgcagtggcacgatcttcactcactgcaacctccacctcccaggttcaagcaattctcctgcctcagcctcctgagtagctgggattacaggcacacgccaccacacccagctaatttttgtatttttagtagagacagggtttcaccatgttggccaggctggtctcaaactcctgacctcaggtgatccacccaccttggcctcccgaagtgctgggattacaggcgtgagccagtgtgcccggcctattttaaccatttttaagtgtacagttcagtaacagcaagtacattcatactctgcacagccaacctccagaactccttttgtctcgtagtcctgaaactccatacataactacccactcatttccccattcccagccccagcacccacccaactttctgtttctgtgtgcttcacagctctgggacctcagatacgtggaatcctacactatgtgtctttttgtgactggcttatttcactcagcgtactgtcctccaggttcgtccacatggtagcatgtgtcagaatgtctttcctttttaaggctgagtgctgttccattgtatggataggtcactttattcctgtaactgtagatggatacctgggttgcttccaccttttgactgttgtgaataatgctgctacaaacttgcctgcacaaatatttccttaagatcctgctttcagttctttgatgtgtgctttctaaaccttttttattttttccttttgttttgagacagggtttcactctgtcccccaggctggagtgcagtggcacgatcgtgactcagtgtagccttgatctcctgggctcaagcgatcctcctgcctcagtctatcaagtagcttggactacaggcacatgccaccatgcccagctaatttttgtatttttggtggagatgaggtcttggtatgttgctcaggttggtcttgaactcctgggctccagcaatcacctgtccttggagggagttggcaatggaagtgggttggctgttggagcccattagaatattccagagggatgatggttccttggaccagggtgtggtcaaggagctggagagatgggagtcagttacagacaagacagtgggatttattgggattcttgatttctctcagtggtgagaaatttcgtctttccacacaccttccatggaaacccggaacaccatgggtcccccgtaggcagtcttaagaggatagctgtttttgttctccttccaaattcccattagacttgaggtcagagtcacactttacttgttttgaatatttaaagtagtatacctaatagctcaatagactgtatgcttttatttttattttttgagcctgccttcctaggtatttggacaaatttctccataagagaagtgaacacgtaactctaacttgtaatagcaaataccgcgggaacactgggagccacatattaagatgttattagaccttccctggagtatccaaatggtctataattgcttaataaggagaagtttttgctgagatttacatgatagagatttgctttttaaaaagaaattatccagatttgaatggaaaaattgcatagtctcctgagtgttgttttgcctttgactttgtactgtttaagaactgattatgagcaggaggaaataactcacttcagctgtaatataaatgtgcattggtatttaagcatatgtgacacataaaacaataccaacttggccagaatttaaatgtttatgtaaattacatttttggacaggcactttcctctattttgcagagaaaataattttttcccaaagagattttgtgtttaaaaaaaaaacccctaatactactattaggagtgttagatgccttcgatgtggttttctttcctctttttgcctgaaaggcttgagtgctgaagcatctagcgctattcttgtgtccgggaacgttcctgcctcatttttgtttctagtcttgtttctttctgtgtcagaaataagactaatgcgtgcagctgcacctatagttcaagatgaaggggtctgtgtgagagagagaacgtctgtgcatgtgtgtatgtgtgtgagtgtgtgtgtgagagagaggagagacgggcgggggaggggagagagagagaaaagagagagagagaaaaaaaaacacagcctctttgtaatacctggttgactcagtgaagtctggctctctgagctttactgaattcctccttacttattttggggccggaggtggagatgagttcaaaagtagataaaatttgcctgttacctaaatgagcagaatagattgcgcataatcttttctagatgaagcctgtgtttttggcattctgctctcaagtcctctgagctgatctgagagtgaactggagtgttaagttgagagagatgttgatgactctggtgtggtcttttcctttcggagaagtggaggtgaaacgacttgcccggggtccctgggaagcagagcttgtgccaagatgtaatttttcggttctaagccctgtggtttttcttctgcagcaaggtgggtaccctttttctgtaagggaccagagagtatggattttaggattttggggccagtcttggcaactattcacctctgcaactcagccacattgtgagaaggcagccctgcacattgcataaacaaacaaatgtggctgtattccaataaaactccatttatggccactgacttttgaatttcatagaatattctgtaagcatgtgtcagcagcttcccctgtgcaggtccatgctcagaggtagtcgcgttggggaaagttgctttctgccctcctggagttgatagacttgtggggaggcagatactggaaagcagccacagacacaccaaaggggggagtcagtcccctgtcatgggaattgtgatggggagcgccctcccctgtgcatttagaaaggccccgccacacggaaccactgggaagctgaggcttggagattgcgtgggatttgagatgagccaggcgtgggcagggagatcgcacaggggaaaggaggatcgccgtggatcacacaggacaaaggaggtcctgacctgtccacccccaaagccctttgcttccctagcccacgttggtgtagggtgggccgagagggggcgcagtgtgaggagtgactgtagctgcagctcagcagcgtctcaggagaagccagctgtctctactcaccacgggagtttatttccagtgtgggagagggactcttgagagagaaggacaagatgcccgtttgccctacagattcctttgaggaaaattcctataggggtctcgtctctgttgtatttattgtagtacgacctttttttaagtgattcaccataatctctctaggccgtatttaggcactgaccctaaatgtgcgttaaaaaaaaaggtttgggatattttggtttatttatttgtgtgtatgtatatagttgttaaattggtgtccttggggtgggggttgatcggtggaaccttatcttctctgctttcttgctccaccccatattttggtttgtttttgttagaggtcggcaaaccttttgttgtcaatggccagataataaatattttgtggtttttaaaccctgtagtctctgggtgttatatggcaaaagcagccattgacaacatgtgagtgactgagtgtgtttatttatgggcactgaggtgctgggatcccatattcacactgttccgccaccatcaccgccattcataactcccaaactttttctttttcttggtggaggagtggagcagggtcttgctctgttgctcaggctggagtgcatcacggctccctacagccttaacgatcctcccatgtcagcctcccgagtagctgggaccacaggtgcgcatcaccacgccaggctgattttttaacttttctgtagagacgtggtctccttaggttgcccaggctggcatcaaactcctggcctcaagcattccacccactcctgcctcccaaagtgttgggattacaggtgggagccaccgtgcccagcctcagaaatttttcattatcccaacccgaaacctggtccccatgaaacagtaactccccattctcccttcccccgcagcccctggcacccaccgttctattttctgtgtctgtggatttgactagtctgaggtgcctcatgtcagtggagtcatgctctgtttgtccttttgtgtctggcttttttcacttagcataatgtccttgaggttctcccatgttgtagcctgtgtcaggacatttgcagctcagttcatttccgaggaattgtcctatatgcagggggtcttaggaacacaggtaacttcacttcccatttgaagagcgaggagttctcccgaggccctgaacaggaatagagactgtgaggcattggcgtttggaaggaagtgtctctgaaatagaaacgactgtcagatgaagagggacagttcagtatggtacccgggcctgcctttccagacgtccccagcctctttgcctagttcccactctgggcccctgggcaggtgacccgcagctgcacatgggtttcctgggaagccacagtgctgaggatcttgggagagaggctcaggatcagagtctggggagtgcaggagcttgcggggggagggggtggggtcagtgggggcggggggtgctgctttggggattgggaggagtggactggggcggggtcacagagtctttagctgaacccatgggtgctctgggtctcggcttgtcctgactcaagtcaaggggcccaggcctttgtaaaggtccacattgcccattcactggggcctggctttgggtgagggtggcagctggagatggggggaagccctgaacgggaatcttggccacacactgctatatccgcgacaccaaattctatcccacctgttgttggctgttctggaaaccagcactgaaaaatacggagtggaaaagttttctgattttttttttcctgctttgtttgggttttttggaaaacaatttcaaaattagcatatggcttgttaaaattaaatcacaaaggaagtgcctatggtaacgttttgatcaggctctaggtctgtgtgaaccacggcccatatttgaaaatccagctttattgggacatagccatgcccattgctttctgtgtcctctgtggctgctttagtgtgccaccagggcagacttgggtgggttgcagcagagatggcatggccctcaaggtccaagatgtttactctcttgccggtcctctgttatctctggtctttgtggttgccacagttttcttggatccaggagttaaaggcagtcctgagggatgatggcctcatctccgcagttgcctggaatgctgaatttcagacgtgctaaaggaggggttgcagacattgtgtggaatgcattcagaccccagatgtgggtgcaggaaggcaggcatggcacagccaggtagagactggtttccaggcccaagcagccttcagcagctgtgcgccttgtttctgatgttgtttgggagtaagaataatgtagacatggggggtcatgaggctcagggtaaaaacttcaaggaaacctccatggcatggttgggcgcagtgactcatgcctgtaaccccagcactgtggaatgccaaggtggaaggatcgcttgaggccaagagttggagaccagcctgggcaacataaggagaccctgtctctaccaaaaaaaaaaaaaaaaaatgaccaggtatggtggcgcacacctgtggtcccagctactcaggaggctgaggcgggagcctgggaggttgaggctgcagtgagctgtgattgcaccatggcactccagcctggaccacagagcaagaccctgtctcaaagaaagaaagagagagatagaaagagagaaagaaacctccatggcagatgcatggaggaatgggttaatatctagaaatacgctgagtggtggagtaaagaaaacccacaatagaatacctgatgaatgtggggaaagcacttctgagctcctctagttttagaagacctaaaaagacgatttaaaaaaacaaacaggagagccctgttattgttgatgtcttccaaaacgaacgtgcatttataagccaggtggcattttaatgtcacgagggggtccattctcccatctgtctcctttgcttttgttagagtcagtagcttctaggtctgcttgacattggagaggatactgaatgcagaaaattttgtttaattataatgatttgattttttccttctgtattcaagtttgcctgcttctaatgaattggcagaaatgaagagcttgctcagattttgccaggaccatttaaaagcaattaaaatcaatttagttattaaatttgaaattattgtctggctaaatgatagtttaaaattcaatttatactggcacttactttttaatgaacagaccacatcacacatttttatgttctcaaattatctgtggctttaaagctgtaaaaaaaggtgctcttttaaaaaagccctgcatgtttcctttttcctctctacttccgctaaaatatttacatgtttcttttaaaataaggtgagaaaatccccttgacttctcaattttaagaaactatacttatcttttcatcacaaatgttcatttatctgtgttgaagtcaacccaagaaatcttaaaatataacggaaagaaaatgtttctggattttttcccgagaatacatatacttttaaatggcacgttttacccattgactttaattcctccctccctccattacatttttagatgtgttcaatgaaacgtagtcctccccctttaaaaaaatggaccgagcatcacgtgtgaggctgcaaagaggctccctgccaaagcatcttatctgccgctggtaaagccccgcccctccgtcagcagctaacccttgagcgggatgtgtgcttgtgccgggtgcattgcattaagagaatgcaactgaatagagaaggatcaggaccttttgtgcagaggtggggagtgttaaaaagggggaggcctgggtgggagggtggagttagtgggagatgggtatgcttagtgcttaaattccctgcattccctaacacgaatttaagaaactcacacagtaaatgagtcagggagagggagagacagggagagagggaggggagagggagagttcctttcattcatgacaggatgaactttgcatgcttcagaacaatttacatttttccttatttctaggtacttttttgaactaagaacctggagggtgtgtgtgtgtgtgtgtgtgtgtgtgtgtgtgtgtgtgtgtgtgtgttggtgtgtgttggtggtggggtttttttgccttatatttcataaatatttcttggttgattaaatgtcaataatcgctcatttctggtttgtaaagctgttacctgatccttgaataccacgaatattttgtacattctaaataattgagagaaaataacaacgacaacaaaaagacacaaataaaaagcatctccgcttatttaagaagagtagatctgtgcggggcgctgtggctcatgtctgtaataccagcactttgggaggccgaggcgggaggatcccttgagtccaggagttcgagaccagcctgggcaacataatgagaggctcttttttttttctttttgagacacggtctcattctgtcgcccagactggagtacagtggcactatctcagctcaccgcaacctccacctcctgggttcaagtgattctcctgcctcagtccccctagtagctgggattatgggcgcgcaccactaccacccggctaatttttgtatttttagtagaggtggggtttcgccatgttggccaggctggtctcgaattcctgaccttaaatgatccacaccctccttggcctcccaaagtgctgggattacaggtgtgagccaccacactggggcgcaagagcacgtcttttaaaatcagtgctgtctgtggggtgggaggggaggagaagtagatctggccatgctgaaaggttcgtgcagtggcctcctgagctgcgcacatgcttctggagctttgggtggacatttagtctgcatgtggatctctgtccaagcctgcactgggagcccctgccccaggaagcgaaggctgcatttcttttatgtcaattaacagatttctgccccaccctggacatctgagcgttaactgatttgtaagggaggggtgagggagggtaaaattacaattctatatcttaacattgggggtgaagcatttttaccctagaggaattctatccaaacacattaaacactcttaataagggacaaagggttgggacgtagcggttagggggcaagcccatgagcctcactccttgtgctctctctccaggaattggagagggaatccttttgcttagcattcccacgcctcccacgggcctggcactgggcccgcgggcttgccttagtctcctgggctgccctaacgcagcaccacgtgccgggcggctgtaacagcagcccgtaattctcccacagtcctggaggttctaagtcccagatcgaggggtcagcagggttggttcctccctaggcctctctcctgggcttgtagatactgtcttctccctgggtcctaacaaggtcatccctctgtgtgtgtctgtgtcccctcatctctagtcctgttggattagggcccgtcctaatgacctcattttaccttagttacctcttgaatggccctaactccaaatgaacagtcacattctgaggtcctggggcttaaggcttcagcatatgagttgggagtagggatgtaatatgcctaatgtccagaacaggaaaatccatagaggcagaaagtgggttcctgcttgccagggctggggacgggcagtgtggggtgactgctagccagcacagggtttcttctggaagtgatgaaagtgttctggaattagacagcggttgcaaaattctgaatgtattaaaaaccactgaattgtacattttgaaagagtgaatttcatggtatgtgaattatatctcagtaaagttgttataaacaaaaactgtgagggtaagaggtaaaaggaagggagttgaaagcagcatcaggtgtgaacagcccataattcagcccatagacgagcgcgaactcctagcacagctgtctgttgaagatgtgcgtgaatgcttgctttccgcacccttcggcctgcttttctctactctccaatttcatcatacattctcttccttcctccccctccccactttttcaaaacgtttcttctagtccttacttgtggctacacaaaattccataaacataatgctgcagttcaaagaagtgttctgatggtagggagataacttaggaaaatattttacctttggggaagttttggtttccttctgagtgaaaaccctccatgaaagagaaacttaaatgcagttttcaaatgctcctgagacattcccagccttttctttgtggagaagtgaaggcaggacaatttccaaggcaaagagggacctatcgcagacagcagaccccaagtaaagaaaggcacagtgatggtgggtattcgtgcagtgttttgaaaatgtggaggtcagggatgctagcttaccaggccagcatgatcaagttacgagaaatggagaccaggacactacctctgctgggtgtgctgctccgggctccttcgaaaggggaagcagctggtggacttccttgggctgtggttaaatggggctcccataggtgccatgaaggctctgcagagccagggatgcttgcaccctggagagaccttgctccaggagctcaggagctggtaggggtggtgacagtgaagcaccggcttgccgtgcccagtgcttgggcagtgctgagctccgagggaggaacccagaaccatgcgggagcaagggagggaggcaggcgaggagaagggttgcccaggagcctgcaggtcgggtcggtgttgtatcaaattgtcttttcctgctttgctgtctgatcccactaaagactagccagagagatgtggaggtgaaaaatggtggacagccatttttctccctttcactgtgtctacaatgtctgtttcatatcaacagcaacatctgtgcaggcatcctaatgagtataaataatgtcttcagaaaactgggtttgtgaggctcctgtcatctgaatttctttcatcatttaagtgatgattttttactcattgacatacagttgttatttagtggccacgtattattcgtatagggttctttatgtgctttctgtgtacatttgttttcgtgctcatcgtatttcagtgtggcttatatataataagatgcacctgttcttagctattgtggacttttttttaaaaaaaggtttatagagatatgattcacataccaaacacccatttaagtgcctaattcaacagttcttaataccctaatttaaaaaaaaaatacagtgttgagtattttccttttctcgtttttcactaaagtagactcaggattggggttatctgtcagtcccttggtttgattcttggctgccagtgtttactggggacggatgttggtacctcccttaataggatattgttacagcattttacaaattctggttaaaaaaagtcccacatgagatctcccctcttcccccctctctgagtgtaggcattgtcagctgcagttgtccagcatctccaggactcttttcatttgcgggatggaaacaatgtaccctctgaacaactcctccctgtttctcctccctccagctcctggcaaccactattccactccctgcttctttgaatttcacaacttgaggtagcttgtgtaagtggaattattttaaaagctggttcatgttaaagtgcttagaacagagcttggtgagcatccggtcaacagtaagtacttttattattctttttatattactctttttttttaaagaggccagacacatgggcttctgtcttttcacagcttgggatctgtgcagacccaggcttccagaagccatcccacttgaattcttactcccttttcccctaaaaagaagctctgaaatcctaattgtcaagaaggctttgcctgctgtgcatgcctgagtaatgttatttttgtcattatttgagagacagagaggaagcttccagtcccctgtaaggaaacgaaatcatcgtgcacagatgtggttctgtttatagagggaaggaaatggaggtgaagagtgtgtgtggcttgcagccaggcttgcgagtgtgcagaggaataaacttttttgcctccagagttttaactggaaatgtgtctgaattctacctcctgggcacactggcctgaggtctcccctgcatacctgatcgtgaaagtcttcgggtgtgtttgtaaacacgcagcccccctgatgtgagagtcagcacaaacttctaaagatgcgatgatgaattctatcagagaagtctttctggttttgtgaaaataaccttgcactctttaattatatccaaatgatcaaatctggctctgatgtcttgtcaaaattaatgttaaaggacagtgccctttatattttacttgtctgggtataaacatcctagtctttaaagttgagtctgtaggactacctctctacttgattactctgaaaagagtgtatagagtgagtttttaaaatggaattagtgtgcatacgaggaacagagtgacatttaacaaatccttcaatagatagtgctggtatgaggattggtgaaactagaggtagggaatgagcatttttggttctgtatcatattcccaagacattttcaaatgattcaccctttgccatcagaatggtttgaaatcgatcagcctgaatccactaatgtgggctgcggcacatgaattttaacactagaagcacacggttgtgctgtgtttcaaatgaactctggccatttgaagtgagcaggcataggcagtcttctgtcctgtgataacctcagtacatatcctttctgttttttaaagtaccttacaagctgctgcattacagtcgttattattgggccattacaaaaagctgtccaattttaagtgtcttggataattcttgtttgccccagcatcagaattgagcatttttttttttttttagatggagtcttgctctgtcaccaggctggaatgcagtggcgtgatctcggctcactgcaacctccacctcccgggttcaagcgattcttctgcgtcagcctccggagtagctgggactacaggcatgcaccacgatgcccagctaatttttgtattttttagtagagatgaggtttcaccatgtgggccagcatggtctcgatctcttgaccttgtgatctgcctgccttggcctccgaaagtgctgggattacaggagtgagccattgtgcctggccaaaattgagcacttttatcatgtagtattcatgtcttactggcaatgccctgtaaagttaaataagttacatttgtcttgcacaggtaataattatgaggtaatttccacagaatccaagggcctcattgactttgctataaaatcaaaacagtgaattctgataagactagacgcatgttactcttaaattgggctgtctcctggccactgttgtgcctttaacctcagcagaaggggagctgggctgcagagtgaaattacccggaggtcaaatattgctaatttgacttttatcatagagacattttctcctctcgcaccaaggcagtggctttaatccctctttcagtggtgagacaggtgcaaagcgtttacaaaaggctttctcttgttttgaatgcgccaagaaagatttccaggccgttaagttaccaatccttctttttaagtcttgaagcaattactgtaaggtcaatccactaatttcctttcagagttaccaaagacctctcatgtaatcatttggtacttgttgccatgtagccagtatcactgagtgcttttactgtgagcaaagcacaatgcatcgggcagggagggatccaaagggatcttggtttttacctttgagccatctgtggtcttgagtgatctacgtgcattagcaattaaaaggtcctgatattcttgtttgggcatattgaaaaatgtgctcttacagataggtttcctctctctactgccccccgccccccaattttttttattgtggtaaaatacataaaacagaatttaccatcataaccatttctaagtacactgttcaacagcattaaatattcattacattgtgcaatcctcaccacgatccatctgcagaactttttcatcataccaaacagaaaactgccccattaaacacaaactccctattcttccctccccacagccccagcaaccaacgttctactttctctctctatgattttgacactctagggaccttttatatgtgggatcatatggtatttgtccttttgcgtctggcttagcacaagtttcatccatgtcatagcatgcgtcagaatttccttcctttttaaggctgtataatattccagtgtatggatggactacactctgtttatccactcatctgtcagaggacacatgggtggctttcaccttttggctgttgtggataatgctgctatgagcattggcatatgtttacttctcattgatttaagtttacatagtcatgtgtggctagtggctgctgtattagacaggacaaccctaggcctgatagccctgaggacctagtttgggtgggaagacaggggtgacctgcagcgagttgtcggctgggggccttggtgagagccagatctgggttgtgaggccactcgaggcagggggaatggtgtggcgggaagtgaggcccaaaatgagaatttcagagttgaaagctttggaagtaacatgatgctctatgactgtgaccagactcaactgcaccaatgtgcatctgagatcaggtcattggcgttgaaatcgtgaaatgctcactgcttgggacgtttgcactgtgcttgatgtctggaggttccgttaatgttaaaatagcaattatgggactggagattaggtttaatgtctgggttttttccactgtcttcaaaagcccgggtcttagtagtaaccatgctgctccccattttagtaatttcagcctggtttatgttgctcaatagcagaaaagcggttcagatttcctttggatatcatggaccatatgtttgcccaggtatcctttcttattgggaactatcaaatagttaacacagatttctccaagggcaccgactgggaaattagtttaccaaagataaatttggtaaaaggaaagtttttatgtgcgctatccttaaactaagacacatctgtcgaaatattaggacgtgcccagtctcccatcctctgctgaaactttagactgtacgtccttcagatatcttctctttggtgctttgtttgggaacagattagcctcatacttcctcgcttgtaaaactgctatcccatctcttgctcaatgcttttcttgtaccgaagggtgagggggaggttccagctctgttttctgtatcagtttcctgggtgatgtttgtttgagggtgccttgtgtccagagccccagaaggtgtttccgttctctgatgagcctgaagtctgcatgcttcgcctttggtagggaaaggcagctggggaaaggttgcatggcccagtgccagggtgccagagtgcgtgtgcacctgctggggagaagcccgctggggcccctcctctcagcacaagatgaggcctcagggcagtgcagcagatggagggcttagctgtccttgccagcaaaagctgctgggaacgtggcactcagataacaggacggttgagaagcggtgagttagggttactctgatggggagatactgagaggaggggatgacaatcttgatttctgttccctttgtgaatcttttggtggccaaaatgaggaaaaggatacattgtgtttgaggacaacaaggaacatctaggcacattgcatacttgattaaatgcacaaagagcttcttgtgacctttatcacaagagtgtggttctatgaaggtcgtaggtacaatagaaattgtgttggtctgagagttactcagattagggtgcattgtgtcaccaccattttgcatagctgtggcaccttgtcaagttaaccttttcctgcttgcttttcctaatcagaagaatgaagttgaccgtatgtactctataaggtggttgtgtgaggtcaatgagattacataggcaaaatcttggtgcaggggcacttggtaaaggttagtttctgttataaatttggggtattctgtgatgattcctactcccctcttctcctcatggctaagttctacttattctttgacgtggctccgatatcactttcctcaggaagcccggtttcccacccagatggctttgggctactcatcagtgttctgtaaaatgctgagaatattgtttatagcacttctgggttgttttgtgatagtcttttgagatatctgtctcctcaccaaactgttctttgtgtcatgggcaggcccacgtcatcctcgtctttgtagtcctgcacctggcacagagcctggcacatagctcagtcaaacaggtgaagactgggttattacatcttcccactccacccccttcattatcaagtcgtggtcagggcatgccccaccaaatgcaaaccctactaggcagtacagctgagacttggaactagactaacccagtgactcagaaatgtgccacaggacttatttggctctagatggggtcttaaaagacattcatagttgcaggcagaacagaatatccagaacaggtgcagaataacctgtgtgtacacagtaggtggtagttataatgcaggaagaatttggcacaagaagtgttacagtttaaaatgaagtcatgggccctatccacactggggacagagataatagtaactaatcatcatcactgtcatcactagcccattgtcagaggtagcactgaacacttatgcgttagccaggatttgggttctagagggtttagtgtactagttgggttaccaagacaaagatgcaggcatggggtgcaagttaacaaaggttatacactaggtggcaactgactcacaggagcctggttattgcagcggttgtggccagagccatacaagtgttctgatgcccctcaactgtgttgaaatttgtttgaggccaaccaagtcagctggcgagggggaaggcaagccagagagaaattgtgaaccagaaaggccccacctctggcagtggctcttccattggagatgaagtcttcttgccctgtttttctctttaaaaaagtgagccatttcacaagggaagttaaattaaaaactgtgcttgttagcgcggagctgggacaaccgagggaagtgatgccaaaggcaattgttggtctttccttcaaatatgtgctgacttaggaagagcaaaatgttttatattaacaattaacaaaagactaagtctttcatcacaaacaagtctaaattcagtggttaggtcagtattatattttcctatagttttaaataagatgcttatgtattcactagtgctttggatgttctttggaaaaatctccaatttagtgacaagccccaggaaatattactcttagttggtccagcatcctatattgtttgtgaaatccctcttttattgtcttttaaaggttgtaaaatgctttttctgtcaataatcagagaaggatgccgcattcatattaccccagtttccaactcaacctctcctttccaattgaaaacaaaagtcagaattcactttttgttgtggggcattaagtagtaagcaaagagatttcactcgccagggaaaagaaggagcctgcaaatcagacaatatcaaaacataaccaaaccatataaaaacacaaaaatgttgcttggcagaatttaactataattaattgtactaatttaatattgtagacacaaatgatcataaagccatatggtacaatccttttgttcatgaatttcttattcatcaaatgttaggtacgtgatgtgggaaagccagtatgttgggcttcgtgctaccagggctagagttgaccagttcagctttgtttctccagtgaccaaaaaaaaaaaaaggtatctgccttgcacatgaaaacactggatggttagattggatttagccaacaacaaactgcaaaaatcggttctggctaactgaagctcacagggtttattagagttgttggagcccatgggaactgatggagggcaaggaggcttgtcgtgcaggagcagcaggaaccaaggaagctttgcagagatgagaaacaaaaaacagggaacacagcaacatttgctgtgtcaggaacgactgccactggtggcctggacaccatcacagccgcagaagatacttaagacacatttctgttctagtgttggtagttcaagattcaaagtatgtgtgaaagtgagtgtgtgtgcataggcagagtagctaattggttgagttggggtccatgtgcccacctccaggttggaccaggggacaagccatgcagcgttttggtcacccctcacttggcagtattcccaccaggaatgaccctcgctaggatttgaggggcctggagtcactacttactaattttcttaaagttgacaacgatcacaaacttcatggtctgggaaaatgtgaattaattgcctgatccaccttcatatcttttttcttttcttttttctttttttttttttttaacaaaaatctgtatattcatagattgtctcttcctctgctagtggttttgcagtagcattttcaggtgaggaaacaacaacagagtttagggtccagctctgtcattgccattgttgtagcgatttacaagttgttactgctagtatgaacttttgcctagttaaattttggaaacttgcctgtaattgcatttgatggatgataaaaattgataaatgacttgataagtgataaaaattctacggaagaattttccatggactggcttctggctttgatcctttccaactgtgcttctcctaccctcaggccgcccctatcatgctgtgcttgtctggccccactcaccctgtcctgacactggatgatttatttccaaatgaattgctcctggaagccattccaacaccattacaaccggcggcaacacagctgtcttggatactcctggaccatatagatagatgtaaccacagcattccggtagctcccacttccccagcattttcttttagaatgggggcatcagagttgaaggaggtaactgtgggtagtgtgtcttgtctttggaaattttcatcatgacctgagcttgtgaacactctgccttggccccgcctcgcactttggaagagactggagcaggagcgggcagcgttgccttcgcagcatggtaacttctctcagcgctgtttgtaaagcagaatgggagaggaaactccccagagggaaactgggaccctgttaggtagggctagcaagaggtggttaaaacgtaagcatccgctgcaccagactgtattctccacgactgtatattttttgttgttcataagagccccgaattgcaatgagtacgattttccctggacgctgcagtgtatggagaagctgtcacttgtcacatgacagctcagtcattcgatccctgggtgctgcagagagggaagaattggcctcgcagtggggagtgagtgccagcccgtggcctgtcccctgccacgtgtcaccatactgaacgtttgtgtgtgctctgtgtgttttcaaaacaccttcatgtcacctgccccggactcctccctgtgagcaaggcagggtgggcgttaccatccctctggaccaacaaggacagaacagcttgagacgcacagggtggcttccccatggctgcggaggcatagaaagtgagggcacgggacgtgaatccgtgtgctgggattctggccgcctgtgcctgccgatcaccctcagtgcctccctggatttgattttgtggctcttctgggtgtgcgtgtgagtgtgttgtgggtaagtctgttgtctaggggaaggaacgggaaatcatccggccaggaatctctgtggggtggtcggcttgagttggccatatccaagctctgcgtgtgtctcacttttcagagtagcaggaaggccgggtgactttgaaatcagatgggtattttcctgattcgaagagacttggcttcttcccccgcccctccttctccctcctcccccctcctccctcttgctggctcacaaactcaatggggcatcccagcccacccatgggaggccaggagaaagaggaggcagagctgtcagagtgtggcccttcgtcttgggggtgtgcaagtgaccgctcctgccccttgatggctctcctgtttcgggtataagggatgttgtccaaaccatgtgtgggactctctgttgacagttgtttttaaattgcctgtttaattgagcttctctaaagtcttctttgtgccaagtatcgggacaggtgatagaaatagaaaattcgacacaaatcgaaaattccagtatcaaaaatgacagcgatgtacccttgccccttaacgcagccaagaaacaggggtgaagggctactctccacatatggagcaggccaccacccttgagtgacagtagccgaacacagaacattctctgcagatgtcactgaggcttaaactcattatgttttaaagggataatctgctattcttaagaaaacaaaaaacaatcacaaatctccctgccctccccacccctgcccccacttagatcctggtagggtctggcagggggagttttgcaaggagttggggcaaattactccagcagatacttccaccccgtatcccaagaaatgtgtgtaaatgctgttatgaattaatttaaaggtattccaaactcctactaattattatgtgtttgctcaagtcaagatcaggagaagtacaggcattgctatcccatggggcctgtgaaactctggtgaggtgtcctagtggaagagcttggggccccatggtgtctggaaagcgggctccactggagattctggctgttttcagcttgatgcacacggggtcccctggagaatgccaggcctgcctgagtgtgcagaggtgagggatcctcacactgcccagcatgtacgtggctgggagactccagagagacatgcaaaagtgctgttaactagacggcgtggtacaaatgcaaagtgagtgggtttttttttttccttaaacgacagtgaacattcatttcaatatttattttgcttattttaatattttactcaatgtttatttatttttatgtttttgagacagagtttcactcttgttgcccaggctgaagtgcaatggtgcgatctctgctcactgcaacctacgcctcccgagttcaagcgattctcctgcctctgcctcccgagtagctgggattataggcatgcaccaccacgcccagctaatttttttgtaattttttgtacagacagggtttctccgtgttggtcaggctggtcttgaacccttgacctcaggtgatccacctgccttgacctcccaaagtgctggaattacaggcgtgagccactgcacccagcctcaatatttatttcaatacagaaacggacttaattgggtattttgttgaaggcaaatagtagcaaagtgggactggtgtgaggcagtggaataacttagtgaaatccaaggtttatgtagttattttccccccacttttttttttttttttttttttttgaaatggagtctcactctcttgcccaggctgcaatgcagtggcatgagatcagctcactgcaacctctgcctcctgggttcaagcaattctcctgcctcagcctcctgagtagctgggattacaggtacccgccaccacgcccagctaatttttgtatttttagtagagatggggtttcgccatgctggccaggctggtccccccatttttatggtttgaaaattttcaaaccctggctgggtgtggtggctcatgcctataatcccagcactttgcggggctgaggcagaaggatcatttgaagccaggagttcgagaccagtctggacaaatagcaaaatcccatctctgcaaaaaataaaaaaatgaaaaattagccaggtgtggtggtgcacatctgtagtcctactgcttgagaggctgaggtgggaggattgcttgagcccaggagttcaaggcttgtgagccttgattgcgccactgcactccatcctgggtgacaaagcaaaactccatctcaagaaaaaaaaaaaaattcaaaccctcagaaaagcttaaagaatagattcatggatcgttaaacatttttaccaaatgtatgttttctctcattactctaaggttgctccctttcccccctcactctcctcttctccttcccttcactccatggatgtgtaggacattctcctacaaaaccatagtacttacattcttgaggttgtcacacctcataattaaacatatgatggttttattaagtatgctgtcacatgtaaatttctccagttgtttgatccaagttgtactcatggatagtgtattgtattttacgtctctttagtcttctgtattgtagaggagtcccccaaccttcttctatgacataggagtttggggatttgtctgtttcccgatgtgattagagtgatgttgaacagttttggcaggaacgctgcacagctgatgattatatttcccattgcatcccctcaggaactcagaatctccttctccatccttggtgaaggtgtattcaccagatggctccctgttgaagctcccttctctctgttaccaatgagtaatctgtgctatgatacagtgagatggtgtgattattctgttcctcacagtggttttcctttggtggttttagcatccactgattaccataaattaattagtccagctttggcaaactatggcttgccgtggtgactcacgcctgtaataccaacactttgggaggccgaggcgggcggatcacaaggtcaggagatcgagacccatcctggctaacacagtgaaaccccatttctactaaaagtacaaaaaattagctgggcgtggtggcgggcgcctgtagtcccagctactggggaggctaaggcaggacagtagcctgaacccgggaggcggagcttgcagggagtcgagattgcaccactgcactccagcctgggtgacagagcaagactccgtctcagaaaaaacaaacaaacaaaaaaacccccaaaaaactccaccaagtctgtttacttatgtgttgtctgttaacagttgcttttgcactacaacagcagaattgagttgggacagagaccagatagccaaaaatattttctatttagctgaatcttgatctagtacatttttggtcaaaaaatgatgcatttctaattcttctattcatttttcatttagtagttggcattcttaaagaagagctttctgttttgacctttaaaaatcactatggattcatttattcttaatttttttttttttttttttttttttttttttttgagacggagtctcgctctgtcgcccaggctggagtgcagtggcgcgatctcggctcactgcaagctccgcctcctgggttcacaccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgggccaccgcgcccggccttattcttaatttttaaaagtgtgttatacgttgttgtcattacattattcttttagatacacaatgttgccctaaatttgcccagtgggaacccctccaggctgggcactgtgttcttctgtcacgcccccttcaggatggggcctgggttcttttgttatgctcctctaaggccctttaatctatgtcgtttcatttttttgttgttgtttttattttgagacagggtctcactctatcacctaggctggagtgcaatggcgcgatctcgactcactgcaacctccacctcctgggttcaagccattctcctgcctcagcctcccaagtagctgggactacagatgtgtgctaccacgcccagctaatttttgtatttttggtagagacagggtttcaccatgttggccaggctggtctcaaactcttgacctcaagttctccacccgccttggcctcccaaagtgctgggattactagcatgaaccactgcgcctagcctcgtatctgtgtcctttctttctgggaccggaagaggtttcaggttcccagtggaaattccctgcccctcaccttgaatcagcctttggccaaagagccttggagaatgatatttaatatttaaaaaccaggaactgagaactgagtgtgctcattgctatggggatatcattgctcctgggctccttgggtgcagagacccagggaaatagatgtttctgtgtatgctttcacactgtccctccctctcaagcccaactccacaggatgcttcctcaccttcctcttgccatctagtatcacgcttctgtagtgagaatctgctgcctacagcaacaacatattgacacatccattctcttctataggacacaaaaaaaggtttcagaaatttttacgttggtgctgccaccaccaccgctaccaaagcaatgaaataaagttcaagattccttgagattctcttgtcgttaggatgtatctcactgtgggtgtacagacaatatacaaaagttacttaatttttctccgatgtttatagtaccaatttgataatgtaagttaaattattcatctttattgaattttaagatatgcatattttatcctctttgagttaagtatttttcaaatatagaaaacgtttacgtggtccaaagtcaaaactctgttaataggtttgctcagagttctcagctcccatccttatcccaccaccccatttttactcacctcttcagttcattgccattactttttgccttatcttttttgtgtgtttctttttgcatctacttagtgcttttaagccccccatttaaaggcctaatgctaagtcttacatgtaaaccagcaaaaatgtcacctttttaagtagacttttgtgaccaaaaccttattatcaaagcgtgaaagttgagaccgtctagggagttttcatcatggtggttagacagtgtgtggaattgaaatgtacagcgtttgtacatgcaggtccgttattgagagaactgatccaaaaccgtgacgactgccaataaaatgtactttaccaaatatctgctcaaaatgcccatgtctccttaatgtcaatacccaacacatgggtacatccagttttagtctcaaatgttttaagatttattaagcttggtttgcaggagtttagtgttcttggaattagaaggatttctctagtgatgtggtgagaagagataaacctgggaccttttgtgttttcttgatacgcacatttatgttgtgtgcaacacaggaattgtcaggaacctgcaatgcaatctttcttgatttataatcttgcaaaatgtggaataaaaagtaaagtgcaaagtttaagtggtaagtgttacaattcatgtgaacaatatgatgctttttctcatgcttacttgaagacagcagctggcccttgagttcagtctcagtgcaaacagcctccaaagaaagtgcattgcactaaggaagcccttttcatctcacaaagggcaaagtctggattgcccccctttctctgttgtctttgcctgttgctccctggaccccagccagtctccccaggcctggagctgggtcagctaggtctgtggccaggaggtgggggtccacgtccactgtgctcctcagcggcaggttctgcaaactgcagcccgtggggcagactccacctccagcctgagtgaggccatccagctaagaatggctttgacatttttaaatggccagggtgaaaaaactaaaagaggattttgtcatgacacatgaaaatgatataaaatgaaagtgtcaactgtcatacattttgatttttgtcagtttcagagaaatttattttctctttttattaaatgtcactacataatatacttgattttgcctttctgctcactgaagctaaaatatttactctctggccctttccggaaagagtccgccgaccccctctctgtggaatgagagcttccaaaaagatgcagaagaccgtgcatcccaagcggttgtaaaagccacttactttcgtaggtttaatgactcaaaagaaagggcgcttgttccctcccttccttcctgggcaggcccctttttggaatggagtttcgttatacagaaagttgttctcgctgtacagaattctgcgatgccttcacttgatggctgtttcttcggggataggagggctgggggtcaggatctgatctcacacgaatggttcagagtctggacttagtagctcagagcagttcactgatttgggatctctggaagaaaagggtactgagtcactggcaccttctgctcagctcctgacagcagtgtaaaggatgctttcgtgacacccagccttcagcccaggaggatggtggcagatcagacagctctggaaatgcagggcacaatgcgcagagggttgcaccacaacagcagtcactcggtgcccgcctggagcactgctctcatttccagagtccctgtatttctgatcttggctgctttaaaaaggaggtgtgggcctgggatcccagaagtattcctctgtgattctgtaccacagctttaccttaattgggggtgtagggggtggggagaaagaggaagacagatgaaagcagggaaatccttcttggagtcatagttaaaaggataaaataagagctttagtgtagcctccgtttccagcaatccattttattctttgtccacaaactgaatgaaaataagcagtcattcaaaaatgatatttacgtaacctacaaaaatctcaatcaaccaaggaaaaggtggaatggggcttaatacaatacagggctgtctccggagttccctcccttgatttcaggcttttggtgtaaagctcccgaaagaaagcaactttgatttttattagactcttcaaaatcatctcggtagaatattgaccttttttgtgtgtggaaaaatgacttctacgaattctcttgtaggagtgtacattttggtcattttttggaatgtaggaaaaaaaatgtggggtaccctttattgcattttcaagaccttccaaagaagataattctgattgtaactcattataatctgggaaagtagattgttctggtttcaaggactgcgtgtgctttaaataatcacaggctgctctcagacttgggaacttttggtagaatacagcagtgattctcaaccagggcagttgtgttccttgggggacatttggcagcgtctggagacatttttggttgtcacgttttggggaaatgggtggtgctcctggcatctaatgggtagaggcccaggatgctgccaaacatcctacagtgtgcaggacagcccccccccaaccaagaatgatttagccccagatgttcatagcgccagaggtggaggaactgcctcgggggatgtgtaggagctttactttatgggttttttaatggaaaatatatgtatagacacgtacatatatatacgtgtacatacacatgtagatgactctgctcagcgcacccatgaagtatgcagtgcacctgtcccctgggatctggttatacgatgggtgtccagcctgtgcccaggggatcagtttcctttgtgctgctgcagtaccttgtcagcatggagagggggaggtcagttatgaggaggcccttttggggtagagtggaggaatggtgccgcctggtcaaggcctcgcatggggtagtgttctttgtacagttctaggtgaggcggcgaacacgttctcatgcattcttcatggtggtggtgatgctgatgttaagaccaacgggcctctgttgttctgctcaaggttccaagtagagtaggttttctattttcaaaatgtagttcacggtgtcccaatttttagtgcagcgtatttcaacaaaatgtccttttacacatataaatggcttatgttgcaaggtccccctcagcttcctggtgtggaatcagtgatggataaaggcagagaggctctcaggctgacatatactccctatgaagaggggggaagaactgtgttggcccatgggtgtttggggaaacacttgtattccaaggtatttgtggagaagatatgggatgtttttccatgttgggcttcggatatgaagtttaaggaaggagaatggagtcctggtgcacacctctcataagcacacgcacgctggccactctgctggctccagagtcatccagagcatcgagcatagtttctcccccggagaccctccaatctgatcagatagggaggctgtgagtctggtgacccccactgcagggggcagagctagtgcaggtggtgctgagctgactgggagaagaagggcctgcaggaccggctgcaaagcccttaggggagggaggaagtgaggaatttggtttcctaaacgggtggtccaagagaggccgggttcatcgctgtgcagtgaggtggcactggaaggagggagtcctcagatgggccaccctttggggctataagtctcgtggtttgtttctcttggcttcaagataacatatctagtttgggtgttttgggatgatgaggttggggtgtttgggaattgaggtggccgcgtaggcattgaggaagatactggtgttttgtgcggtcaaagggcaatggtgtggaactcagatcccagctctgaccctgtgtggtcttgggggatcatccaccatcagtctatttctctgtgacttggggataacagtacatgtgagcgtgaaataagagtataaattgcatcaatgtctgtgtgtcaaggttgcctgaggaggagttggctgggcttgcactgacgcttgattctttgtatcactccgacttaaaccacgacacttccaaggcagagtctaaagcctgtcctctcacaatcttctacaggtgagtaggaggccatagaccttgtgagtacagagtcctaaaagaaggcagaaatgtgtgaatctgccaaaagtaaagaaagggtgttactactggtcaaagtcgttgcaagaatgctggcttttacaactcctgtttctgctgctatcacctgctgcctgtgtcttgtttcctgggctccagatcattttcacatttctcaaaatggtccttggtagctgtggtagatggaataatggccctcaaggtgtatctccatcctaatcctggaacctgtgaataggtcattctacatagcaaagtggactttgtggacgtggtttaaggatctcaaggcctggtgccaggggctcatgcctgtaatcccagcacttgaggaggctgaggtggaagggttatttgagcccaggagttcaaggccagcctgggcaacagagagagaccctgtctctagaaaaaaactaaaaattagctgggcatggtggcacgtgcctgtagtcccagctactcaggatgctgaggtgggaggattactgaagtccaggaggtttaggctgtagtgagccatgttggcgccactgcactccagcctgggcaacagagcaagacactgtcccagaaaaaaaaacaaaaacaaaaggatatcgagatgaggttggggaggttgtctgggtgggcccagagcaatcacagaggtgcttctgagtggaatagggaagctgggggaacagaatcccagaggagataggaggatgggcgcagaggccccagtgatgtgggcccatgagccaagggatgctggcggcctctagaagctggacaaggcaaggaatcgaattctcccctgaagcctttaaaaaaggacacagccctgtgacccattttagacattgcacatcgagaacctaagagagtgtgtctgtgttgcttatggtagccgagctggagattctttgtgacagcagcaacaggaaacgcagacagtgggtgagcaccagatggtagagtcaagtttaatatgctggagcaaggagggtcagctaatcactggcaaaagatcagggcctgggacttttgctaactgtttctatggattcctccttcctcttgcaatgagaagcgacagcctcgtggtgaaatttgttagctgtttattattttcattgatctgattctactagtgtgatttatgctaagcataaatgaccaaagttgactgtggttttttgaagaacattggaaaataaacgtacaaaattatgtttttataataatggttcagtccaaaataaaggaatatattcatagaaattagctaaaattatagagggtaagttacatacatcttcttcttaaagatgctggtaccaacactggaagaagctgtacaagtgggcaggttgttttttgtttttgagactaggtgtcactgtcacctcaacctccccaagctcaggcgatcctcccacctcagcctcctgagtagccgtgactacaggtgtgcacctccacatctggctaatttttgtattttttgtagagatggactttcaccatgttgtccagactggtcttaaattcctgggttcaagtgatccagatgccttggcctcccaaagtgctgggattaggggcatgagctacggtgcccagtctcaatttttaaaaatatattttaccatcactttccaagctttttgtcctatgtgacaacagaaaattgaatttcttaatccacttacattgaatttaaaatccacttaggaaagtgagcttcaggtattagaattattaactccgaataagcagatactctagcatattttatcttccagattgtgttgtgattgtaacaagacacattttatgcattttagttttcatcacaaactggctgaaaatcatgttatgtacaaatatgacttgattcaatacaatttattgtttgggtataatttgaattagaaagccatttgtataccttttgctcacttacattatgctattatgcttttgacatcagaggaaatacacttacttaaaatcctcgcagatcccagagcaaatgaagagtttttgttcttttaaaaattggaagtagtctagttttctggttgtacagtaacaatgtgatatatattgtctttatcatatatacacacatacataaatcatctttccttcaaagatctcagatcacttttttaaaaaacagctttactgagatataatttacataccataaaattcccctattgtaaatgtacaggttcagtgaattttagtaaatttacagagttgtacagacatcgagacagcacaattttagaacattgtcatcactccaggaagcgtccctgtaaccattagcagtcacgtcctccccagcccctggcggccactgatctattttatgtctctggatttgcatattctggacattagatataaatccaatcatataacctgtggtcttttatgtctggcctcgttcatttagttttcaaggttcatccatgtcatagcatggattgatccttcactttttattttattttgtgttttttagaaacagggtcttgctctgttgcccgggctggaatgtagtggtaggatcatagctcggtgcagcctcaaacgtctgggctcaatcagtcctcccacctcagcctcccaaatagctgggactacaggcagacaacaccacgcctggctaatttgtttttagttttgtagagagagtgtcttgttatgttgcctaggctggtcttttgaattcctgggctcaagcgatcctcctgtttcagcctcccaaagccttgggattacaagtttaaaccaccacacctggcctgttttttattgttagataatattccattgttataaatatcccacatttttagattgattcatcagtttatggacatttggttgctcccatgttttttgctgttataaataaagctgctgtgagccctcgtgtacaggtgtttacatgcacatatgcttttattcctctggggtagatttctaggagtggagttgctgagtcatatggcaatgctatgtttaactttttgaggaactgccaagctgctttctatagtggctgcagcatttcacattcccacccaaatgtatgagggttccagtttctctatatcctcgccaacacttgttattctctctcagagaactttctgaatctctcttataatgcctagggggttccttgttgaagatgaaattagggactaccatgaactgctttaggaaacctgggagaaaggagtcaggcccctttttcatatctatgcagtgtaaccggcctctcagaaagattggttggagtggatgggagaataaagaaatgaatgggttgggtgcagtagcttacacttggaatcccagcactttgggaggctgaggtgggaggatcacttgatcccaggagtttgagatcagcctgggcaacatggcaaaacctcatctccacaaaaaaatacaaaaattagctgggcatggtggcacacacctgtggtcccagctacttgggaggctgaggtgggaggattatttgagcccaggagttagaggctgcagtgagctatgattgtgccactgtattccagcctaggtgccagtgagactgtgtctaaacaaaaaaaaaacaaaacaaaacaaaaaaaacagtacaaagtgttcagtgccgtcagatgttctgaatatagtatgatgagaatgcagtggtgggggagaaggtggattagtttctgtggctgctgtaacaaactaccacaaacctagatgcttaaaactacacacatttactatcttaacagttctgggctgggtatggtagctcatgcctgtcatctgaacactttgggaggctgaggtgcaagaattgcttcagctcaggagttcgagaccagcctgggcaacatggcaagaccctgtctctctctaaaaaaaaaaaagccaggcatggtggtccacacctgtagtcccagctacttggaggctgaggtgggaggatcacttgagtccaggaggtcaagactgcagtgagccatgcgagtgctccagcctggatgacagaacaaaatcttgtctctataaaaagaaactggaaaaaaaaaaaagtagttctagaggtcataagttccaaatgggtcttattctgctaaaatcgaggcatctacagggtggtggtatttgctgaaggctcgagggttaagtttctggttttttgttttgttttgtgttttttgtttttgtttttgttttttttttgctttctcagtttctagaggctgcccatattccttagctcatggccccttcctccatctttaaagccagcactgcttgttcgagtctttttcacattgcatttcccctttcacattgaaagcactcttctgatgaaccacttctgttaaaaccactcttatgatccaagataatttacttttttaaaagatgaactgattagcagcctgaattccacctgtagccttcattcctccctgccatgcaacttaagttgttcatggtttctgggaatcaggatgtggacaccttgggtggggatggaccttaactctggctgccaccaatggcgcctggtcaaagtatcctgtaggatttattcttggaaacggcgttaaccccaacgccctactttgctggctgtgtaagaaacacgaggtcagtcaggcagtaagaggagcatggacttgttttctgaaacagcgacacaatccattacatattttcgaatgacgagatgagatcagacttctgctttaggaagagtcacagggttttgtggatttgcaggggaaacaggcggtcagagggagttctgtgtcaccgtccagaggctggggtgccaaggagggcagtggcagtgggcttgaagagatgcaatggggctgctttggggctgaggcgactggactggcgtctgattgatggaataccaggagagggatgggagagggaaagagatgagtccaggatgacagttggaaagtcctggacttcggagtaaagggtagcgattgaggagttaaagggtagaatcaggctggggagagcaaatttacttttgaaatagtgacctttggatgctggacagggagatatgaagcaggcagaggaaatatgggcatgaaatagagcttcagcattttctacaaagaagccaccacattcggtgacatgacaagggagtgatgccagagggaagagaggtacaagggcagaatgctggggaaatgcctgtgtttaatgggcgtggagaacccgcttaataaataatgagaatatattgctggactgaaacaaaagtcctcattagctcattaaatgtttcctggaattcccagtcaaatctgtgaaacaattttaatgctagatgttttgtaagtatttctccggaaatctggaaatttgtccacagacccccagacattgtttataaactgaagtcagttgactcaagtattttgcaaatgtctatggaccctagtgtgattaatagaaacacaaattattttaaaggtgtcactcaatttacagtcattctgtatttttgccatttggtattttttcctgaaacattacataataagaatgcagcatgctttctttatgtaggtgatctgtgaaactttttgacaattaaaaattggtttttggccaggcacagtggctcacacctgtaatcccagcacttcgggaggccgaggagggcagatcacccaaggtcaggagttagagactagcctggccaacatggcgaaaccctgcctctactaaaaatacaaaattagccgggcgtagtggtgcacacctgtaatcccagctacttgggaaggtgaggcaggagaattgcttgaacctgggaggtgcaggctgcagtgagccgagatcttgccgttgcactccagcctgggcaacaagagcgaaactccatctcaaaaaaaaaaggaaggaaaaaaaaatatatatatatatgtatataaaaattggtttttgctgtttgttgcggcatcacttgcagttacaaagaagtgaacatagtggttacagattgggttgtaaggctggacctggccgtatgatgggttactaggcacctgttaaaaatagtactgtggaagtggtatatttattggcatgtccatgtgtttacaatatattacaatggtgttactgtaatccccaggagaccagcagcccagctgggactctgagagctctaagatacgtccttggagtaaaccaagctgcaaggaggtctgttcacttctgtattgtttatccactcataaatttgatttacatagctggactttggtgttgtacagttatctcataatgagggttattttaagaagtgtctcaaggaaatgtgtcgtgtgtttactgaggatagcgttgtatgtagtccacaatttcctctttctgggagaaattttgcacatgtatcagaagtctaggagctgtgtttctgatatttgcatcttctttattgtttagatactgtgaatccagcatctaactatagttccttctttgaggtctaggaaacttggaattggattgacaattcccttccaagtgatttcaggttgtatccgactgcgaactttggataccgccttcctgtctcagcttcgtctcctttgtcctaccatgatcttctcttggccccagtttacccagtgaattactttatttttgctattttgtatgtgtttttggaagccacccccagttttttctcttcttttcctgggtggggagttagaagtgttgcagtggatgatggtgctgtggctttttggaggttggtttgcagtagcttttgagttctggtgtgttagtgtcatcttattctaatctagctgcttcctgttgaagtacatcaagacgaagtatatttctaaatttattacgatgaatactctatcaaaagcagctggtgcttaggccctaggtagagctttaagataaagttctttaatatcaatttagaaaaagaaagattcataatgattaatggagctcctgcatcactgaattttactggaataaaaaaaattagtgggcttaaagttacattgaatgtagtggaaattctttttcttatctccattactgttggggaacaatttcatctaaaccccattgaaaactgggccttatagccttcagtatacttcataacatttgttggaaagcaggaaatgaaaacgaagtatttgaagtaaaagttcttaaatgtgtcccaagaaatgaggattactgcagaaagaatggatcagttatttctcgaattataagaaggaaatatctgcagccttttttgtcatcagtgcagcagccccggtttttctgttaatcatagctggtaataatgccctccggtttatagttttgatgagccgggagctaggctgcgtgttttacatataatatctctgttccatcagctgcataacctagatatccttcaccccatttttatgagactcatgggttcttgtctgggaccatgcacctagtaactgacaagattgcaaactagttatgtcacctgtggagttccacgacaaaggcaattctaggcgatgtttatgtagtgttccttgcatgccagggggattctgtgctctttccatgtgtgaatgatagcatccacctgctaactttgttgggagggttcagttatcctctctgtacaggtgagaacaggaggtactgaggacatctggcccaaggatactaccgctggcacggggtggatggtgattcgccctcagtccctctggcgcagcatctgtgctgtttgctgccaggccagctgcatcccagatagagtgacaggatctgttcgcgtcacatccagaaaaggctctgaggccaagctccctgcgttgcttctcactttcactctggaatcagaggtgcgtgcctggaggacttagctctgcatggacagctggtaaggtgtcacagagggtgaggtgggccattgtagcagagagttgttaagagttggttacgtgggttttctcacagggtacaaggctgaggaatgggaaaccagttaggagaccttgctaatagcgtggaccaaagatggggagtaggtccagacagattccgcagtgttcatgcagtgttcatgaagcaggtgtagacagattgcggggccattcatgaaggtgatttgccggggctttttacggatggaaaaccccttttctgtgttcatcccacctcctgttgtcgacagatgacacctgcacaatcaggtcctcccaactccttccaccacccaaagtgaaatacgcaagtcccagagaactgtgtcattcttaccgaagtggctgatgtaggatgttagaaacatctcccaccccaagttgtgacaacctgaaacatccccagacattgctaactgcctcttggagggggcacagtcacccgctgttgggaacacaggcctaaaagcttggagccagggctgactgtctgtgtaggctagaacagaattcccaatgacccatcaccatgacatctgacactcaaaccgcaccccaccccgaccccccacaaccaccaccttttaaaaatttccatttttggaaaaggctggggcttagaagtcattatgaaggcacccatttccagaagggtaagaatcagaaagttggctaattcgggtctctgctttacaggagttccgcagcgtctttcagtagagtgaagctccagtatttgtatgagtgttggggttgtttggtggtgtggggtaatgcaggaggagagaattggggaactgttaaccaccacccaaacaggctatagagaagaatgccaggggactttactgtgatggagacaggagcgttgaagtctgaagagtgacatctgggttctctgtacgttctgatttcttctgctaggatgagtatagaaacatgttctctggggtgaaagtgaagccttgtgaaattcatacaggtgaagctgctgatagcagctcttcccgatggcatgaatatggaggtggcggttgaagcaagtttggtttgtgaatagaaatatacgtgttcatatgtatgtgtgcacgtatgtgtttgtgcatgtgtatgctttaggacccagttcttggattagctgattatttttttccctctctatagacattggtgacctaggttttcagatacttatgtaagtgaatagttgaatttgtttgagcatatttaattgctttcctgaagggatttgctggctgttttgttaaatgaaattgaagacagtactgttgacctttccaggtgaggagggagtcagaagtgttttgcaaatgatggaaactgaaacgtgagtaccaggaccatatgatgttcagaaacttttatcataactacagtgaataaataaagtgcttgacaattagatttaaaattaagcttcatcctcattgcaaaatgtggagacagtgctttgggacatgaggaagagattaattaggattcttttctacctcaagatgcgctatgtcatctctgaacaaaaaactgattggtattacgtgaggattatcttcataaagttcagagttgtatctacggggacagatttgaattgctgttaattgacaatttgctgaattggaaagatcatattaccttaatactttaatgtatcatctttaaatgtgattctttttctttctctcactaaagattagtttcatgccactaaataaaatttaatcttttgctgtaatttaaataataataagtgcttacaaacatattatgcagctgatagcttgttaaaatttcctgtgggcttgttttttgtttagaagtactgattttgccagttgtacaagcatgaaatattgtttatcaagcctcataagacattaaagaggaaatcaagtttgtgtgactttaatgtctctttttctccttatttcagtggctcatacttttaccctgaacttgtaaaatctacaagcttaataagattccatattttataggaactaatggatattcaatgacttgcctgaagagtagactaagaaaatgtatttctccatgaatctttacatagaaaaatgaaagatttttcctgaatatttatttctcaatatatacagcattaatatgtctgtttttcttcaaagcagaaaaaaaaaaaatcagtgattgcctttgggttttgatcttgctctgtatttgttttaagtacacacctattacatgcccactgtattctaggcactaagctctaatgaaaagtggtttccagtcattcgaatggaacaggaggctcatgtactttgaagtgggtatacagaacttttgcactttggttttattctactttctgtctatgtccttggcactagaatgcttggacgacagtttgctatatctgtggtatttatggaatgagtgaaacatgcaaggagaatgccctggctgccgttctggcttctgccctacccagagcatccagtatacagaagcagcgtttcttaccacagcttgcggaaagacacggggagtagtcggcttgccatataaggaagttgccttcagtggccttgttcattttaggtgttttttaatacttgcttctcttataatacatgttactgttccgtgaggaacctcagcagctcccctaaggggaaaaaaggaggagtacttgaaggagtactgtttatacttcaggggcaataaaatccatgtttatgcacaaagggacctttccacttgtgtgataaccattctacaaggcccttgagttcctgtgaggaaggaaggacgccataaggaatgaaatcacagaaccttattatgaaaatagtaatggtgggatttggaaattatactcaattttttcttctgaaaacaaattgaataccacctgagagttggtgctaaaggccctgattttcgtattttaaaaaatttttggcatagtctttggatttgtgctgtcctaatatggtagccaccagctgtacatgagtatttaagcttaactaagattaagtaaaatgtaaaattcagtttgtctcacactagccacattttgagtgctcagtagccacatgtggccagtggataccttattagacaaggaagatgtagtgcagaaagttttattggacagaagaacaatggttattcagatatttccctattgggaattccagggaagaaagggaaaacttaaatctgaagaagaaaaattttataccaagggactagggggcaatgcagaaaaattaaccacatcaaaacaatttactacatcaaagttcattgtcatgacatattagaacattagcataaaggaagtatctatgcacttcccggatttaaaaaagagtcacacgaaggatcttggaatcagaatgacattgtatttcttaacagcaacacgtgaagttagaaaacagactgaacatagacttctttgaaaataattttccctcagaattttgaaggtgttcctccactaattattaattaaggatagaataaagatgtttgggccgggcgtggtggctcatgcctgtaatcccagcactttgggagtctaaggcaggtggatcacttgaggtcaggagttcaagaccagcctggccaacacggtgaaacctcgtctctactgaaaatactttcacatgtcacttctaggaaacttatggagaatatgtcccaccaaagtgagggagtaaaccaagaaagggggaggtttgggatcttggaaacagaaagaggcagaaggaattctcaaacaaaggtgttttcagggcagtggctcttgtagtacagactagagcaggagacaaattttaggaggaggccaggcgagatggctcactcctgtaatcccagcactttgggggggcccaggtggacagatcacaaggtcaagagattgagaccatcctggccaacatggtgaaacctcgtctctactaaaaatacaaaaattagctgggcgtggtggcgcgtgcctgttgtcccagctacttgggaggctgaggcaggagaatcgcttgaacccaggaggtggagcttgccgtgagccaagatcgcgccactgcactccagcctggtgacagagcaagactctgtctcaaaaaaaaaaaaagaaattttaggagaaagtttggtgttagtgtattggtcgaaggtgggagggatgtgggtgggtgttgcgggaggaagggcatggaactgacaaattatccaagagttttgatcatgtaaaaaatgtaatagattgttggagagtgtgggaaggattatcaaagagtacaaagaaaactgaaatgaaaacagaggcaaataataattctaggagaacacaaaaagtatactaaaaaaaaatcataggctgggtgcggtggctcacgcctgtaatcccagcactttgggaggccgaggcgggcgggtcacgaggtcaggagatcgagaccatcctggctaacacggtgaaaccccgtctctactaaaaatacaaaaaaaattagccgggcgtggtgttgggcacctgtagtcccagctactcgggaggctgaagcaggagaatggcgtgaacccgggaggtggagcttgcagtgagccaagatggcgccactgcactccagcctgggtggcagagcgagactccgtctcaaaaaaaaaaaaaaaaaaaaaatcataatcatactatattgcccactcagcagtgcccattccattgtcaaagtaatatatgtgaaatattgatttagctgaaaaaaaaagttatatgagctatcgaaaacgtggaagggtcagtgtaagattggtggtgggaatgtaaaaaaccaacaatccttacctatgtgtgtgaaaatcagtaagtgatatctaaacttgatgtattgattagagtatcacaaacagactatttagaaacatggaagtctggccaggcatggtggcttatgcctgtaattacaacacttcgggaggccgaagcgggaacgtcactagagccccggtgtttgagaccagcctgggcagcatagcgtgaccctttctctaccaaaaaatttaaagcattagccaggcatggtggtgtgctcctgtggtcccagccactggagaggctgagacaggaggatcacttgagtcctggaggtcaaggctgcagtgagtcgtgatggtgccactgcactccagcctgggtgacagtgagaccctgtcccaaaaacaaaaaacaaaaacaacaacaaaaaaacaaacttggaagtcactatgcagggaacagcaccaataacagaaacagctccaagaaagtggttgctttgggaagtggaattggtgatagatggtgctaaaaggcatgtaattaataaaaggagccttttgcctcacctgcattttaaaaaaaattttgtacatgtattactttgtaaagactaaaagtggtttggaaagtgaaagtataggatatactatctgtataattacagacattttggcatagttaaaagcagggtttcacaaccttggcattgattgacgtttgtgtcaaataattctctttgttaagaggacctgtcctgtgtgttgtgggatgttccgcagcatctctggcctccacccactggatgccagtggcattcctccgccagtcctgacaaataacagtatctctagacattgcccaatgtttcctgggggtcaaaattacctgtaagaaccacttgttttgaaggatttttaaatatgtcattgaataaacctcaatatataaccctgctgtttgatattggtaatacaggaaacaccagcttccttacacagaccttgaaccctggagcaaatgaagcggtttggaatcctctggcactggaacacccgcaatgctcatgctggtgcatgtattagtcagcgtctggctcttggcccggttaattcagagctcactaaaaacagaaaagggatcaggaggaaactgcagcttctctgtcatgcttagtggcttctgaaaacatattttagatttttcatgttgctttcatgatggtacaacttgaatttctctggagttgaaatgttaatcattatggcaaaaatattgcaccctttggatgcattccagtgctcaggtggctgcggacagatcctctctgtctctctgcttccctccacaattcttttgcaagttcttagttaagttattgtcaagtgtttttccctagaattgacacaggaagtcaacaggaaaatggtatctcagattttttgatgtggatgaaacctcataaatagtttaaaaccctcatttcacagctgaggaaactctggtgcagagagggttttttacaattaattgggagcacaatggggcctggaactctgttcttctgttttactctttccttttaaaatacaacatgtgtgcccagtaatgctggaggaggatgatagaacgggctggggaagggctagggcatctggcgggtcatgggagtttgtcaggattttcgcactgttagaagttctcagcatcctctgccaggggcgtgtacccttagtaagcttagagaaaatggcacagagaggcaggaagtgtagtttccatgatctttccaggaggtgctcctgtacctcagttcctgatggcccagaactgggtggagagtgtaggctggtgcattggcgtgtctgacagggaagaccctggcctccttatcttgcagctcttgctaccagggcactcatggagccagcgtgcaccgccactgcagctgttcttgaagaagtggccagaagagtgaaattggcccgttgaggaagggtgtggagctgcttctctgtgggtccctgcatgacttccctgttccttcccctgggatcaaccttcctcaccccacatggttcagcagatgagggttaagtctgccccagcttgggggacgctggtgtcccactcaaaccggttgtccagtattttggtgctgcaccaggagagtgccatctgcagtctgcagggctgtcttgcccaggtggccccttcttccctcggatggatggggcatactgttctgaccaccatgtctccttccaggccacatcctctttcgtgagcactgtgagggcatcaccccacatttttagaaacctcagcgccccatcttgcccccatcccttgcctttggcaccacttaaactacagcctcattctcttcctcctcgcctgagttctccagccaactcaagtgccacctcctccatgaagcccctgtaggtttcctccactgggacaaggacgcgcagagatgaaaggcagagaagtccagccctgggacttccaggccgtcagttcaatcctttgagcctctgtctcctcctctgtgcagtggggcagttcagtgctcccccttagtgctgtggcacgctgcgttgattggcctgggtgctgttgcggatgcccagcgagttctctgtctccctcctggttcttgtcccactccctgctccctgttacagcctggaagtggttggacggtttcccctgggagtcttgagaacccccaaagacgccatgcatcttcttgtcctcttttcgtggcatgttctgtgttgtgtgtgtgtgtctgtgcaacgtgctgtggcattatgtgtgtctgtgtttgtggcgtgttgtgttgcatgtgtctgtctgtactgtgtgtgttgtgtgtgttgtgtgtctctggcgggctgtgtatgttgtgtgtgtctgtgcacgtgctgtgcggcatgctgtgtatgttgtatatgtctctggtgggctgtgtatgttgtgtgtggctgtgtattttgtgtgtctgtgtggctatatgcggcgtgctgtgcatgtcgtgtctatctgcaccgtggtttgtgtgttgtgtctatctgcgtggtgtactgtgtgtgttgtgtctatctgtgcagtgtgtctgtgtggtgtgctctgtgtatgttgtgtctatctgtgcagtgtgctgtgtgtgtgtgtgtgtggtgtgctgtatgtctgtctgtgcaaggtgctatgtgtatgtcgtgtctgtgcagtgtgctgtgtgtgtgtctgatgtgctgtgtgtgttgtgtctatctgcagtgtgctgtgtgtgtgtctgtgttgtgtgctgtttgtgttgtctctatctgtgcagtgtgctgtgtgtatgtctgtctggtgtgctctctgtatgttgtgtctatctgtgcagtgtgctgtgcgtggctgtgtggtgtgctatgtgtgttgtgtccgtctgtgcaccttgctgtgcatgttgtctatctgtgcaccttgctgtttgtgttgtgtctctctgcacggtgcactgtgtgtgttgtgtctatctgtgcagtgtgctctgtgcggtgtgctgtgtgtgtgtctgtgcagtgtgctctttgtgtgtgtgtggtgtgctgtatgtgtgtgtctatctgtgctgtgtgtgtctggtgtgctgtgtgtgtgtctctgcagtgtactgtgtgtgtgtggagtgctgtgtgcgttgtgtctatctgcagtgtgctgtgtgtgtggtatgctatgtgtgttgtgtctatctgtgcagtgtactgtgtgtgtgtgatgtgctgtctttgtggtgtctgcagtgtgctgtgtgtgtgtggtgtgctgtgtgtgtgtctatctgtgcagtatctgtgcaatgtgttgtgtgtgtgtggtgtgctgtgtgtgttgtgtctatctgtgcagtgtgctgtgtgtgtgtgtgtggtgtgctgtgtgtgcacgtgtgtggtgtgctgtgtgtctgtgtggtgtactgtgtgtgtgtctatttgtgtaccgtgctgtgtgtgtgttacatgtcctgagctcacgccttctgttttcacatttgactgtgattactgtcctttttgagatctgagtaacagggacagggctgggcccgatgacttaggcctgtagtcccagcacttgaggatcatttgagcccaggagttggaggctgcagtgagctgtgatcgcgccactgcactccagcctaggtgacagagtgagaccctggctcaagaaacaagaccaaacgaaacaggaatgggtggccagttctgccacttcctttttatttgtgaaatctaagcacatacataatccaggtagttgtcacggaaaggggccataactcaagagaagtggtgccctggagcctaaaggctttcccattaggataaattagaactggaaattgtcataaagacaatgcagggtttgtggatttcagctggatgagtaaagaccagcctgggcgtgaaggattttcatagtcagttgctaaaggtggtgccccaggaaggctatttggcaggcgtggggcgcagtcctggcatggggtgggatggggctggaggtgctgctaatctatcttattaaaacccaggaagtttcacaggcgccttccaaaccacagctcgttgatttaaagatgtgaattccacgtgtgtaagccaacagaacaattgcgttttgtggtctctggctgatgaaaagtccctgatgaagtgctgtttggtaaaacgattcctctccattttcctcccttccaatctgtggttcacatttattcaacgttcttttctttcaaacagcatttgtgtgtagccaacacacatgcatatggagtgctgcgaagtctctgtgcattatctggaaacctgctttctccagaaaagctgactatccacttcccgtgctctcaagcccaagagacaggaatgggacgtggggagcgcgtaccctcttctcaacaagcaggttgaaaatccagtgaatttctttatgatggaatttgaatcacgtggacattcattagaatatttgggcaggattaagcccttaaaactggctctagattatggttataaaatggcctcaaaggaccctgaaactaatgaaagaattcttccatttctgacatgcttcactccctctggctctggctcttatcccaaatcaaagaatgttggtttttttagtgtttcctttataaacaaggatggtttccagattttttttttctttttgtttttttttttttttttgagatggagtcttgctctgtcacccaggctggagtgcagtggcgccatctcggctcactgcaagctctgccttctgggttcacaccattctcctgcctcagcctcccaagtagctgggactacaggcccccgccaccatgcccagctaattttttgtagttttagtagagacggggtttcaccatgtcagccaggatggtctagatctcctgacctcgtgatctgcccgcctcggcctcccaaagtgctcggattacaggcgtgagccaccgcgcccggcccaaagtgactcttatactccattataattatgaatttggaaaacaataaggatattatatgagtctgctcaggctgctgtaaccaaagaccacaggctgtgtggcttaaacaatagaaatttcttttctcacaattctggaggctggaagtccaagatcaaggtgccaggaaactcagtttctggggaggcctctcctcctggcttgcagatggccgccttcttgctgtgtcctcacacggcctttcctcggagcgtctgtgtatgggtggggtggaggggcaagcagagagcttgcacacttcgacaatatgaccatctatcataggcatcaatttagtttaacttcatttcatttacagggtgttaaaaaggaaaatcatctgcataatttgagctttttcatagtgagttctgaatctaatttattttgagttattacagaagtctgcggatatcccaccttaagatagccatatgcacaattagtcatttcttaagggatcccccaatgtgaaaagaattccccgagaaaagacgacctgaaagatcttggcctttacataagtgtacacagaattatttttattgtgataaaatatacataacataaaacttactatcttacacagtttaactgtacagtttagtggcattaagtacactcacgttactgtgcaggcatcatcaccatccttctctaggactttcccagctttccaagctgaaactctgtcctcattaaacatgagctttccattccttctctccccaccaaccacctggcacccactgttctactttctgtctctgtgaacttgatgactctggatacctcccgtaagtggaatcctacaggatttgtcccttttgtaactggcttatttcacttggtagaatgtcctcaagattcatctgtattgtagcatgtgacataatttccttcctttttaaagctgaataatattcccttgtgtgtatagaccacattttgtttatccattcatgcatcgatggacagttgggttgtttacaaggaattattttaaagccgaatccagggtggctggcttgtgactactatttagatgcagacagtgattccaggtggtgcgtggtgaaatcatgtcacacccccgcggaaaactccacagctttcctcatgtgccctttccatcacttctctgctgctttaggaactacttttcttctgaggtgacctctttctgttcctttcagtttttaaaggaaagaatagtagaagtattaaaagcagcagcagaagtccacatgttaaccctgtgccagcccacatccccttgtgatctctggcagtggggtctcttctgctagcttctcccgagcttcctgccaaaaccctgtagccggccttcgccatgtccctgaatttgcttttctttttccaccctctacaaccttcctttcctgcagaagtataaactttcaatccgtgtgtataaactttggggacacttcgcaatcagcatgatgaagttttatttttatgtgaaaactcttgatgattctgaaattgtggtgtctgtaacttaaacatcatctacaaaatcactgctctatctttggatgtgagtttgttctagcatgttatcacagtaccgaattccaaagaaactgctgtttacttaccaagggtaggctttcaactcagatgagtttatgactttatttacatggaatagtcaaaatggacttctgacatttgctgcaaagtaggacaacttaattgatattgatggatctactcatttattcagcagataacaaagcccttccgattgcaggtgttgtggagagagcaggatattcatttgctagggttgccataacaaagtttgatttgatttttggttggggatggaaactgtgtaggaggcaagcgtggagcttgatgtgagctccttgaaataatgaaaaaccagttacaaaatctgtattacctgtagcagtacacattctcccaaagcattctgttggcattttaaagtcctttaaaacacacagctgctttctgttgcttcaaactaaataaggcattatcttcacttttccttttgttaacctaaagaaaaaccttcatttgtaaagcaaatcatcacagcaggaggattttctggtttatgcactagggtgcatttaatctttattttacactgctgattaactttatgattcaaattttaacttatagtttctttttaaattaattacattattgggtgctttcatgtttttgctaaaagccttcctattagaagcactacaattgacagtgatggactgacctttaatatttttttgttatgtgaccagtgtttggtttataaaaatttttctctaaaacaccaacttttggctgcaaataccaccttttcacttgggttcttttcatagtgtttatttacatgggatattgtcactttgcacgctgtagctatttgtctttgtcagcaaatgtaggtaaaatattaatcttgtatgaaattcagataagcagggaacagatggatttatggtgcttgaaacctctgaactctgcagctgtggcaagttgttgaactgtaaataaattctggacggtggctagcaggggctggcgtgacctcatttgccccacaatacctcaccgtgccagggatgcatttcctgccctgtgccacctgtggtttggtcctagtgctttggggccgcagagtggagctgggctccctttgaggaagtcatcagtgctgagagccctcctcacgggtgagagtccagtgggatgtgtctgagcagcctacgctgggcatgggccggggcacgctgtgtcccaagcatgctttaggggtcccagtggcaaaagcacatttgtggttgtttaatctctggaggtggaggatagccccagctcctgggtcagtcagctggcggaacagggtaggccaggggagacagcactccaccctgctgggcatcttattaaatgcagcccagtatattcaatgccggcatcactacttcatgggaaaggatgcagcgcttacagcaggtagtggggtagagtggctgtgtggggattttcaaaatggaggctaaagtgatgcactttggactcgctggaaagtgcctggacctctggtgagttcagcctgggaggtcagagcaccacaaaatttgcttgctgtggctgggtgcagtggctcacatctgtagtcctagcaggagctcagtagtccaagctcaggagtccgagaccagcctgggcaacatcctgtctccaccaaaacaaaaccaaaaacaaaaccaaactggcttggtgtggtagtgtgtgcctgtagtcccagctactcaggaggctgaggcaggaggattgcttgagcctaagagttcgaggctacaagtgagccatgatcataccactgcacttgagcctgggtgacagagtgagaccctgtctcaaatgaaaaaaaaaaaaaaaaaaaaaaaaagtacttgttgcctggccacaggaaggtctgtgtgttggtttgtttaccttcccgaacctttgctggggagactttttatgcccccatatgccccagattcactaacaagaaggaagtgttctgttctgtgtaggatgtgcagaaacagccttgaaaatgttaccaatcaccgaccttctgaaacgagcttctgtggatactgggaaagcactgggacaccattcccctcactcctgcctctgcttccccagggtggaactggcctgtgcttgatggtgccagctgtcataaagaagtcattgagcatccctgcatttgcactgtgtacccagcaccatggagggatagccactttagccaaagcagtttttcagctttactgagatgtaatttacataccttcagactccctccgagggtgtttttttgtgtattcgcagagttgtgcaatcatcactatctgagtttagaacatgttcagtaccccatgcccactgtattagtctgttttcacgctgctataaggaactacctgagactgggtaatttataaagaaaagaggttgaattgactcccagttctgcatggctggggaggcctcaggaaacttgcagtcatggcagaaggcgaagaggaggcaagacacatcttaccacagcaaggcaggagagagagtgagaggggaagcgccatacttctaaaccattagatctcgtgagaactcactcgccatcacaagaacagcatgggggaaacccgcccccatgacccaatcacctccaccaggtccctcccctgacgtgtggggattacagttcgacatgagatttgggtggggattcagagccaaaccatatcacccatcagcagtcacttcccattcttccctccctgtcccaaccggtgcaaccagcaatttactttctgcccctatgcatttccctattctgacatttcaggtaaatactcacaacatagggacttttgtgttctcatttcactgagcattgtgttttcagggttcactcatgttgtcccctgtgtcggtgcttcgttccttttcatagccagattatactatctgttcatcagttggcgggcgtttgggctgcctccactgtttggcgattgtgaatagtgttgttgtgaacatttaagcacacgtttttgtgtggatgtatgcaaagtcattttttttgaaagccacttactacacgattggctaacttccatcagagaaatgttgtttggtggagttaaaaacagattatctgtgtactatattaagttgggtgaggaatgatgaagtgtaaattatacttacataaatattataatgctgtgcagaaactcttaagctatcattcttttagaaaatgaattttatgagcttgggacctttttgttaaccaatctgagaaaagtctgttgtcagtgtggacatattttacctttaaatggaggaggggagagaatctttcaaaaacattaatatcagtgagattaatactaatctgtcaagatgacccagtgaacagttggctatcaaagtattataagaaggtttttaaaaggaaagtgtctattttgtaaagatcttgagtaaattatgcttttaagtatgttttgatattcccccccctcctcccaaagtgtagcatgcctgagcgctgtcatgtttaggaggtgatgggttggggttagagggtgattgactgttagcgaagtgggttgggatgaacaagtgcacttgagtacgcgctgcacagtgtaggcatcaggccacgtcagtgtgtctctgcatttgggcagatgccaggcctattgcaggcagcataacatctaggaacgggtttatggatgaacctgggtaactctgggagcacaaacccagaccacacccatcgggagagattgacctgagtgatgcgctaacgcatatcattgagatggggccagatatcttgcttagatgaataattggagttcatgtcaaccatctgtcctttcccataatttaaagccaacttctatattttccaggttcatactttttttttcattaattgcatgtaaagttgcggtgaacaccttctttcttgacttcctgtttaaaaaaattacagttcttaaaattataagcttattcaggatggagtggtcagtttgtagaaaaactagctctttagatcttttaaaagcactacattaaaaaaaaaaaaaaaaaaaaacatcggacgtggtgggtcacacctgtaatcccagcactttgggagtccaaggtgggaggatcgcttgagcccaggagtttgagaccagcctgggcaacatggtgaggccccatttctacataaaattttaaaaattagccgggagtggtggagtgcacctgtagtcttagctacttgggaggctgaggtgggagggttgcttgagcctgggagttcaaggttgcagtaagccgtaattgcaccattgcactccatcctggatgacagagcgagactctgcctcaaaaaacaaacaaacaaaaacaaacccagagaaactcaaaaaccaaaaaagaggtatccttattttcccaggcctcaatgatgaaatgtgcccagtgttcatttgaatctgcccatcaattagtcttttcctgatgtctcagagaagcatgcatgatgtacggaatgtcttgggtgacctagagcggcatccccaataggactgccctgtgaacatggccccacattcggctcttgggcacttaaaagatgtggccattgtgactgagaaactgaattgtgaatgttatttaattttcacgtgtttaagatgtggccagagcagacagatgaacagtctggcttgatggataactgcagggagtttcacgatgctggtaggaggcacagtgagcttctggaagagccggccccacctaggcctgattttggtggctgctcaaaaccgctggtactgaattcctttagaatagtgcttctcaaagcgggtgactttgtatcctccccaccctccaggggccatctcacaatgtctggagacatttttggtggtgacagtgggtgcttctggcatctggtgagtagaggccagggacactgctcaacatcccacagtgcacaggacggcctcataacaaggaatcatctagccccatatgcgccacgatggaggagccctgctttctattccgaagaccagcagtcctaagatacgatgtggacagcacagacccagttttctaagtgaagagataaggcttgagcaggcagcagcctggtaatgccaaggccaggacagttagccaagtgtctgagtccatggagcttctcgggcagtgttctcttttctcttcagctattccagtttgtattaagtgtaagaatatgaagttgatgtttgtcgtgagtcaagacggtgacacagaagcagtctttcgtgctttggtctaatagctttattgttaaaggagagaaacagaaaactcctctttgcctctgcagttttctctgaaattgaatttagggaaagctgaccctagaccatgcgtgccctttccaccagcatcgctgtgggttccactcgtgggagatcgataaggaagtggggatgaccacgctgcacagaagtgttctcatcacttttgcgcttgcttatttaacccatgattgttagaaagcgtttagaaagttggtctttgcaaaccagccctgttaagtgctgagatgaaattcttaactttttttttccttcttagagataaggcctcactctgtctcccacgctggagtgcagtggcgcaatcaaagctgactgcagcctccacctcctggactcaagcagtccccccacctcagcctcccaaattcttaaaaatgctaacagtaaccctcacacacaaaaagtgctgccgttagagatggcactggtattgagaagcacgtgctgtcagtgttgcaattggtaatgcacaccacacttgggcatagaaattggaaatccaactgcgccaagctggagcctgcagaaaggagcacgaggagacgggacagcaatagagctctgtcgacggcgctaagtagaaccagacgctgcaataagacaagcgtccccctgtgctcagtacaaatgggttgcctgtggcagatgcaggggtggctttggcagagagacggctcctggcatcgtggaattgaattggctgtttcttttaaagatactgcaaattgcggcagcatttatcatcctaaggaagcccgcacagcttgccaaacagataatattgatgatgataacaacaatgataaaaggaaaccatgatgcctctactcaatgaaaatcacttttatcttatttgcaaaagtcagaggtaggacagatgtgtcagcgtcttaataagacagttattcaaggagttaaattgaaattattcacatacccaaaataagctatttggcaaacctggagacccaggggcctttggatctatcttagtgtaaaatttcttgaagcagagacctagtaggtactctgttgcttatggttccaggcaatgtattgttttttcttccccctaaatatctgtgaatgtgtgaagtaccctgtgtgccagagatggaaagtaaaaccacagaagcggggtgcggggagatggcagctaaattccttttcagcagagttgaagcatcttgttgtaagagtctagctccacaacagtgggatgcaggaaactgtaacagctgaaatacccaacagatgtattcaccatcagtgcattgggaaaccctctcaaaagtgtcatcacaaatgatgatcttaacttttgtatgacaggatctttaggtcacccaacagtaggtgcacagtttctatgatttcaatttttaccacttctggagacttgtcttcccatttcttgtatcagtgccttactgatagagttggaaattggaaccaaagtaattagattggctctccagatctcttacatgagccaagaaaggattcaaaagcatgccctgtttccttcttgacaggctgggagaggaagtgaccgggaagtgaattgctaagatgtggtcgtcattttcctttacaccacagagcctctgcgtttgggaactgcaggttcatccgagtcaatgtcagaagtgccttgtgtctactgtagtgaacatcctttgtttccatcgggtcctgtgggaagcagcactgcttattgggtggtttgagggtgaatgctattttacaacttgtgacccccttgacacactaccttttcattttagcatggagcacagagccatttctcccctgtgctggattttgaatgttctttcaaccaccgtgatagaatgtccaagaaaggaacaaaggaagaggcaactaagggaatctttcagtgggttcataagccatgctgctcctggctttgacaggagttaaaatcatgggtatccctaaaccactatcattattggagttgctgttactgtcgacgtaaagagtcaaactctgtaaaatatttgaagagatttattctgagccaactctgagtggccatggcctgtgacacagccctcaggagatcctgagtacatgtgcccaaggtggtgggggcacaacttggttttatacattttagggagaacacagcttggttttatatgtgaacccccaaaatctgagacgggtctcaatcaatttaggaagtttattttgccaaagttaaggatgcgcacccatgacacaacctcaggaggtcctgacgatgtgcccaaggtggtccaagcacagcttggttttatacattttagggagacatgaaacatcaatcagtatatgtaggatgaacattggtttggtctggaaaggcgggacaactcaaagtggggagggggctcccaggtcataggtagacaagggacaaatagttgtattcttacgagtttctgattagcgtctccaaaggaggccatcagatatgcatctatatcagtgagcagaggcctgtcgttgaatagaaggggaggcaggtttgctctgagcagttcccagctggattttccctttaacttagtgatttgggagccccaagatttattttcctttcacatacacatttgagggagacatgaggcattgatcagacacatttaaggtagacattggttcagtccagaaaggtgggacaacttgaagcaagggtgcagggggaagggggggtgctttcaggttataggtagatttaaaatttttttgataggccattggttgaaagagtcattaccaatagaaaggaatgtctgggctaccttaagaggttgtggtgaccagtgttttatcctgcagatgtagcctccaggtagcaggcttcagagggaacagattgtaaatgtttcttatcagacttgaggtctgtgatgatgttcgtgctggaggggcttaatgaggcatgcttgacccccacttcccggcagtcatggcctggtccgtctttcaggataaatttagttggccttggcccagaggaggaagtccattcaggtgcttggggggctttcgaatgttattgttggtttacattatgattgtcattgttattaaaaaactaagggctgtagagaaatggttgcagcatccatcatgtgtccctaggaattgcacatagctaagtgagaacctcacagaaccctttcacgtgcagcccgatgctgtcactgttcataaacaattgtattttgccttcctgaaaggccatctgagttcattaaacttgcatgcttccatatctatacattcttttctcatggcctctttgtggatggtttgttttaccatttgttgtccatcagcttgaatggtagggggaagagttcacaccgtgccccctgtgtagcagaatagcccacagttcaggcatggctctccagcaaggagctttctagggctctgatgctcaccagtggggggattgggcacccctccgcaactgccaggggacattgacaatgtctggagacattttgggttgtctcagtagctgtgtgggggatgctgttggctagtgggtggagccctgggatgctgctaacatcccaccatgcacagtacagccccaacagccaagagtgatggctcacaaatgccaacataagaaacccattctagggtacctttcatttgcttagtgctgcgagaaggtttatctgccaaagatcatcatcttggagagggccaagatcctgtatcctgtactggacagatatgcaggcattcaaattctgaaacgccgttggaaacatgaggctcggatcacagaagcctcctgtacatagagcaaatgagagctggaggcctgctgcccagcccagctgagtcctgtttcttatttcggttttcctttagattccaccgaagtttctctgaagaatgctgactcaggctgccccttttattccatttctttgcagggcagtttaggtgaagctggaacacagtgttccctgaggaagcattaggacaattagaccctgcctttgctaaatgaatgtatcaagaaccttcaacgtctttacaagaagcaggataaccattttgcagagtactgtgcttagtagcagagcatggcttctgttacacagtttcagtattgcaaaggtccccagccagtacagtcccacccttaattactgcttcagagctgcaagttaacgtttaaagtgttttcacagtagcttgaagtgtgatctcccatattacggtcatatccttggacttagcccatgttacataaattagatctttataagcagcacacttctttgcaagcaatttgcttccctttgggaatctgattccatagaaaacagtagtattttaaacatgttgattctagtacttacagttctattcacgtgctcctggtatagtacatctaataagaaagaatcccttatttttacttttatccaaatgcatgtatgttctttcagcatgagatataatttgtctgatcaagtatatagggagatgagattaagaattaagatttgtttcaagatatgagattaagaattaagatttatttcaagaaactcaattgcatggttgctcgcataagccactatgcagtggcagctttaatgaatggggttccaatgttttccttactgttttcaagaaggtagtgaataaaattagatgttaaagcgaattgcattgtgtgaagattgggacagatgccacatatatagttcagatgcttgcctgccagtccctgagatatactcttagcttgttaatatggaaattgtcaaacatattcagaagtatacagaatatcttggtatattcctgtgtattcttcactcatctccagccactgttagcgtgtcacgagcttgtctcatcgtcccctcactgttttctctttagagtaatttaaagcagatctcagacatcatgtgatttttacctataaacatttcaagttgtatccctaatatagaaggatttttttatgatactattattctgtaattgtttcctgtttgccttaacgaaaagaccacagactaggtggcttaaaatagcagagatgtattgtgtcattgttgaggaggtcagcagggtggtcaggcggcagcagggtggcttccttttggaggctccaagggagagccccttctgtgtctgtcctccaggttctggtgcctgcaggtgccccttggcctgtggctgcataacgccaatctctgtctgttaggaggacactgtgtttagagcccatgcaataacccagaatacctcatctcaggattcttaatttaattacatctgcagtgacccttttttcccaaatgaggtcacattcagtcttttactatataaggtcatattcacagagtccagggatcaggttgtgtacttaatcctgtttctttcgtgctcatgggaatgtatgagttaggggaatacagattatctttgtgttgtagggttttcttaagattatgatttattgaaaaagaaggtcaatggcatataaaggaaaatgtcattgataaatataaaaagaaatgcaagttttttaggccaagcagaatgcttataggagccagtgtcttggattaaaattatatgtgaacctcaagtgttatcatctataaagtgaaggtagccgtgaattacctcttagattgttgtgaagataaaaatgaatacagcattaacacagtatataaatgctaagcatttagtaattatagttcgcctctttttttctggaggctcaaagttgattgtaaatgtcaaaccaagaaataatactaggtactagcaacacataatgcaaaggaatgattcctgtgatacatgaagaactcctataaagtactaaggaggatgaccagcagcaggccatgagaaaaatgaaaaaagacatgaacagttttcttaaagggaaataatgaatagctctaaaatgtatggaatgaagctcaatctccctcatgacatggggaatgcagatgaaaagtgtaaggtaccatttcacctttcccattagtagaggtcagaggtgtgactgtgttccgctggcaggagctcaaataaaagcgggtgttgttgctggcaggcattgcaagaggtccagcctctttggggagcagattggcaaaagatatctgacctagaattgtcacttcttgggatttagctcatggacatagtgtaaatatatgcaaagaagtactcacatgatattcaccaaaggcattgtaaaagcagaaggatgaaagcaaccacccacagtgaacgtgttagattataataaaggcatagaatctatcaaacaataggaaaaaaagcataattctgtatatggaatgaactccacatgacgctcttgcatgtaaaaagcaagacagatacctgattgtgagtagagtttaatacaagttctatgtcaaagtgggaggagctatatgggctggtctaggtagaatatttctggaaggaaataccaaaaattggacttccctgttggggagaggtggattttagagatggggtagtagcagcttctcaaaaaccaagagaaagcttcgcatttacaatgggattattggaagcaataggaaacacccatttttgtaaaatctgtgagaatgtgtatacttggtaaaagtatagatattcagccattaaaaggaatgaagtattcatatatgctacattgtgagaattgaggatatgctacattgaaagaaaccagccacaaaagactgtataaggttccatttgtggaaaatactcagaaaaccttgggggaggaggggacaggaagtgtctgtttagtgggtattagatctcctttggaggagaggaaaatgttttggaattagatacagaggtggcggtgattgtataacattgtgaatgcccccaaatgccactaaattgtacacttgaaaatggttaattttatgtcgtgaatgttacttcaatttttaaaaaaatccaactgcaaggagagaagattctctagggaatggcttgtcaaagcatccatgtcaaagggaccatttaaaaatttccagtctgaggtgggtgcctttgtgaaaagcaattaaaatgtataactagaagagcaatcatgtctcagacaccaacgcaagcacaacttgccctaagttttctaagcacttcttacctcattcattcatcaccagagacagacagttcccaggccagaatccgcacctggatgcaacttttaatacatggatctagagttgtgttcttccagctctagaagagctccatgccacccccctcccctcccccccccgccacagcttgtcagaaatgcagatcacaggccgtctctaggtctgctgaatgagaatttgcattttagtaagctgcctaggcagctcagaagcacattaaagtttgagagggtaatttggggacagtaaagtgcagtcggaggaggatggttttgtggccctttggactggtcacttaatgactgtgaccctgggcaagggactgggttcgttccctaggctcctgtaacagagtgccacagactggtggcttaccgtatagaaacaaatgctctgcagctccagaggccacaggtctgaaactgtggtgttgtggggttggcacctgttccaggcctctcttcttggcttgtagaaggctgtcttcatgttcacatgaccttctgcctatgtgcagttctgtatccaaattccccaccttaatgacatcatcttcactaattacatgtacggcgaccttatgtccaagtcaggtcacattctgaggtactgggcgctaggactttaacatgtgaattttaggggaacacagttgaacccgtagcagtacttaacctttctaatcctcaatttcgtcatcttaaaaatgagtaaactacacattaatgtgggtaccatcaaaaaaacaaaaaaaccaacccaaaaaatagtaagtgttggcagggatgtggagaaattggaactcttatgcactattggaaggatcataaacaggtaaacactatagactatagttcagcagtttcttaaaactagaattatcagatgatccagcaaatccacttttgggtatacatccaaaagaattgaaatcagaatctcaaagagacacttacacactcaggtttagagcagcgttatttatattaaccaagaggtggaaacagcccacatgtccctcagcagatgactggataaacaaaatgtggcctgtccacacaatggaatagtattcggccttgaaaaggaaggaaatcctatcacatgccgcaattttgtatgaaacttgtggacattatgttaagtgaaataagccagtcacagaagagaaatactgtataatcccactttcatgaggtatctaaagtacacaaattcgtagagacagaaagtagaatggcagttgccaggggctgggggaggtgaaatggggaattgttgaatgggcatagagttggagttttgcaagataaagagagttctggagattggttgcacagcattgtgaatttaacactgttgaactgtgtacttaaaaatggttaagaggctggatgttttgggtcacacctgtagttccagggctatgggaggctcaggtgggaggatggcttgaggccaggaattcaagaccagcctgggcaacatagtgagaccccatcttttacaaaaaattaaaattagccaggcatggtactgcatgcctttagtcccagctacttgagaggctaaggcaggaggatcgtttgagcccaggaggtcaaggctgcagtgagctatgatcacacagttgcactccagcctgggtgacagagcaagattctatctcaaaaaaataaataaataaaagatggagaggagcgttacttttttgtgtgcaggaacgattgctgactgcagagcctggctggctaaaattagatttgccttgtcagtataataattgtaggtatttttggagggaaggatgcctggagcccggctgggttatttccgcccttggagtgagccagggcagcttagagggctacccgcgtgcagccctggaaggtaccgaaggagccctggaggcaccgagcgctggaggcctcatccctgagcaggttgccctccttctggtcggatggcagggcggaaacccatctgtgtcgggagtgagagctgtctgctgtccgcggcttgcgcttggagcttttcctgcagtccagggagagcagaggaggccagtgacttccatgaaaacacccccagtggtggggagggaggcggcatcccttggaggtagggatggggcccctgctgtgacccattagaggcaaagaagggcttggaagtttcattttgtcttacatgagtgtgtgtgccgagttcacattatttgcacatctgtgtttgtttttatataatgataaggacatcagtttccattgataaactataaggaagatgtgccatgtttaccagggccagagtgaagagactgaggtgcttgctttgggagaaaaatttgagggggtgacaaacaccacagacatcaagataaattatctgtgtgtattttaatagctttattgagatgctgtgcacagccatacaattcacgcatttgcagtgcacagttcagaggtttttactatatccacagaggcgtgcacccgtcaccacagcccagtttagaacattttcatcacctggggaagaaacacccacccagtggcagtcacttcccaccccacccccacccctgccaccgtgcattctgctttctgtagatgaatgcgtttgtctactctaggaacctcatacaagcagagtcatacagtgtctgtccttctgtgtctgacttctttcactctgcgtgtgttcctggttcattcatgtggtagcacgtgccagacattcctttctgttacacagtactgtatgtattatatatgtacacagccggctgttcatatccacgagttctgcttctatgaattcaaccaaccgtggattgaaagtatttgggaaaaataataatgcaacaataaaaaaatacaagtttaaaaacaaatagagcataacagatatttacatgacattgacattgtattgggtatgatacataatccagaggtgatttaaagtgtaagggaggatgagcggttatatgcagatgctactcccttttatctaagggactggaggatactcggattttggtatctgcaggggtcctggacccatcccctgtggatgctcaggggcggctgcaccacatttgatctatgtgttcatctgtcagtagatgtttgggttgtttccattcattttttggctaagtgaataatattttaatgtgatatttaaaaaattaaaatgaatgcaagaaattccatgaggaacaaaatattaattttaagtaaagaccacaggatcagtatttctgaagtttccttttgcctcaggatccagtatggctccatacattactgatcctgtctctctctctaacattttgatattttgtcatgtactttttgcattcattttgattttttttttttctttttgagacagagtctctgttgcccaggctggagtgcagtgatgcgatctcggctcactgcaaccaccgctttccaggttcaagcattctcctgcctcagtctcctgagtagctgggattacaggcacacaccaccacgcccggctaatttttgtatttttagtagagactgggttttaccatgttggccaggctggtcccaaactcctgacttcaggtgatccacctgcctcgacctcccaaagtgctgggattacaggtgtgagccactgcgcccgtcctcattttgatttttaaagataatgtattacactattgtttcttttgatggttgaattttctggcatccccttcaattttgcaccagaggtaagtgatcctaatccctgccctgacattttacactgtgctgtgaataccccagggcatcatgaggaataaaatttgaaagtgtatttcagtgagctaacttggctggacagaatacccatgggttatccttaccagtggtgccatatttatgcctttcagcagtgttgtgattaaactcaggtccagtaaaattatcattatactatattagttttgtagaacttctgtaacaaatttccacaaactgaatggcttggcttaaaacaccagaagtatatcctctcacggttctggagtccagaagtccaaagtcaagatgggggcagggttgtttgcgtctggagcctctacaggaggatccttcctgcctcctccagctcttggtggcgccaggctccagttcccttgtagatgctacaagggaactcttgtttatagtcgggatagaaattacacaaaacccggtcttgattggggataccttttggagtactggcaagttgccgcatggactgagccttccgatcggagtttgctgtcttgctggtgatctgcctggatgccggtgcacacactaatccctgaacacactaagcattgcgcttgctgttgtttaacttttcatccatgattgaattcaggagttctttttttaaaatggccatttttaaagatttctaattgggagtttttcttctgaaaagaatacccgtaaagcaaactatttaaattatacactgagagacgtatgttcattcttgtatccataacagttaagaatcattacctattactagcataggcacaaagcgtctcctctaagacatttgttaattacaaaagggacaaaagtagtgacatgtggggaagaaacccagcagataccacctaggtggtcaaggtcatcatcatcatcacgatgagggcatgttgacaccctgtgataatctgagaaggactcagcatcactcctgtggtgttcctgccaaaaatgcgtaagagtctaatcacgagaaaaattagacaaacccaaactgagaggcattctgcaaaacacctctcctgctcctccaaagcattaagagtgacaagggaagaacggggaaccatcacaggtcaaaggggatgtgctgactataggaatgtgggctcctgggagagagaaagggcggaaggagaaaccggtgaaattgggtaagtctgtagttcacttacttgtgctgtgccgggtcttaactttcttatattttgctaattgctatgtttgtgtaagatgtcaacataagtggaagctgggtggcagttatatgcaactctgtgctatttctgcagcttattgtaagtctaaaaattatttcaagattaaaagtttttttttttaaaaaagtcagatgaaaacacgaataagtaaaaaaaacataaaaagagagaaaaaaggagccatttatatgattaactttttggttggtgtcgccataagttttttcagttcggattcttagtaaaggatgtggatcaaaacaaatcttcatactaaaacatcagcagagaccttatttcatttgaacaaaatatcatgaagtcaggattcgttttgcatttgaatcttgaacatttaagttttttaggaaatttgtggtgctcctgtccttgaaaggaagcccacatatgttcaaaatgcagtatcttttaaatgcatttgaattttttaaagttttggtgtttgttgtttttggttgtttattgctttgatttttcatgagcagtgctgttcaggggtactattattgtcagttttaaatcactgctgcagcatacttcatttgatcttgagacttgccatgagtcttactgtgggggtggggaggatggggaaagaaaccattgagtatgagttggcatgtcccacagaacagcgggcggacacttcagggggctgtgcctttctcagagactcgagggctatgcccaaatcgttatgcagtgtgtatgtgtgggggggatagttggggggacgggtatggggaaaggagtaatctaccagggacgacccaggacagatcccagagccaggaatgagggttggatcttgggcaaggccatctctgccatgactgcttgtgggaactcctgcttactccccgtgaccctgagcaaaacttccaagtttgaagcctcaattttatgctctgtcaaagaaactagtttttcaccctccaccagaggatgaagtatcattctccacgtgaagcactcagcacagtgcctgtcccctctgcagacatgatgccaatctgtgatgatgttctcttctgtcagcattttacaaagcagatgagagcgttcacttgcacagcctcctgttgacctttcttctctcagacgccttgctgtagatcccaatcgactgcttttccttggccagccgattcatgcagtctcttgcttacttaatactgttgatatatttaaattattgtttaataaatacttgttattctggagtatatttgttcatccaaggatggtttactactgcttgctttgtgcaggttataacaggtaagggggtggaggtgtgtgcagagcatcagctggtcatcagccatcttgcgggagtgcccagaggggggaagagcaaagcctaccccttctacggagtgtgagggaggcaggcttgggtggaggcaggactgcaccagccttccagagctcagagaggtgacacctgagccaagtgacacacacatgataaagaggaggtttctggagtccagaggaggaaggcatccttggctaagaggacagcatgaactcatagggtacctccaggaatttttcccctgggcagtaggggcagagaaaggtacccaggggggcaggggataaggactggcatggagcatgggctcgatatcagcctgctgattttaatgaaagccgtttggtcacctgaagaacagctttgattttacttctgtaatctaaactcttttgagttggaatataaaactcagtgttccatgtgacaaaggggtttttaaattggtcattcccttaaacatctttacattttcgtatctgttgatgtcatttttttccccattgctgactcctgttcctgtcttctatttctgctcttgacttaataattcttggcttcttgacgtttatcattgccgactgctctgaatcctcatcttcccttcatttatttccatttgtccgctctgtttactgcctgagatgttgaccttttttccaagcatgcactaagcggcattttaaagaagcagcatcatgtcatagctcctggtagtggggctgggcctattcatcttggggcttctttatctaccttggttgtaggtagttaagaaaatcttaacccttgggtcattatttctatagtgggtcaaagagatgaccacgttactaaaactttcatgtctagttgcatattctgttttttttattgtggtaagatatacattacgtaatacatttgtaagtgtacaattcagtggtatgaaaacattcacaatgttgtgtagccatcaccctcttacacctaaacatttttccattatccttctccaaaactctctgctcattatacaataactggcccttccacactcccctccccacactcagtccctggtgacttctcttttttctctttatttgcctattctaggtaccccatagaagaggaatcatataacatttatccttctgcgtctggcttatttccctaagcataatgttttcaaagtccatccgtgttatagcatatatcaaaatgtcatcgtatttttgtggccgaatactaatccgttgtagggtcactcacacgcacacacgtagagtagctgtgagtacagtgcccagattggtacagaaaggccacagtgcccatgggtctgtccattttacatgctgtaccgtgtgcttcatgggaaatatatttcttctgtgagttttcttgtacattgcttgtttccagacttctaaaggggtggttgtggggatgtggtgctgtgtctcaggtatactctgcttatgaaatagcgggtgtgatggaagggtggagaaagggagttgagtaataatgttcacctggggtcgggcgcggtggctcaggcctgtaatcccagcactttgggaggccgaggcaggcggatcacctgaggtcaggagttcaagaccagcctggccaatgtgttgaaactccgtctctactaaaaatacaaaaattagccaggtgtgacggtgggcgcctataatcccagccactcaggaggctgaggcaggagaatcgcttgaacccgggaggcagaggttgcagtgagctgatatcgcaccactgcactccagcctgtgcaacaagagcgagactccatcttaaaaataataataataataataataaggttcacctgattgaaatagcctctgtattgaagaacaccagcaggtgaagttcgcttagcagatctgagcttcctgttaccctaaacactgccaaccttgacctacctctgaaagccagtgggatgaggtctagggccaggtgggaaccttgggaaaggcatgccctactgtttgaccaaggggatgaggaggctgggtactccagtgatggagaccctttccccaccttttctctcacctctcctccacccagtgccctttcacctttcctttccaaccccacacccatccttccgccccacttccccatttatttctctctgctctttcatttccgtggccagccgcctcccaagccctgccctcaagcttcccctcccttttctttcatgcccatagcctacctggatctcctctccctcgtcgggcccacctccctccacccttgggatcctggtcaccccctccactgcaagggggagaagggctgcactgtgtggagggttctccctaccttggctgtgttctggggatttcccaccagcccttgcgctgcactggtgatgcccgatgtagctgaaactctgccccgctcggggttactggcctgggatcagcataggagatgggtttaaaacaggatgcagggaggctgctggcagacagttatttgaggaaatgcatttcttaggatatagctttcaagaaggtgctgttattgtgcgtcacacatagagtggctgtaatgcgccagggcaaatgaaaattatgtttataaaatagggcaccttgtcaagattaacttgtgtgaaattcccaagaatatacctcaaacagttttttatgtcagtgcatgatattgtagtaactctcccagttctagatatctttattttaaaaggaatgcttgtgtgcagacacatttttaggtggaggttagtatgttttagttctcaggatttctaggagaataaatagccataacttgataggattggtatgaatagtacttggtcttgggaagttttctccatgaaaatgtttcatgttgacgttttgctccctcccgtcttggttttacactcattcttcacagaactgtcatttataggaacttatcccctggccatctctataggtgtctttcttgcccagataaggtgagaatcattttggaaaccaacttcttgagaatccacaagaaatgggttttagccacaagggatcattgcattgcattctataagatgagagcttctacaagaaaaaattctggagccagatattttagggaagacagggggctgataagtgaattgttattttaaatggttttcatttcccctcatcctgatttagaagaggagagaaaactctccttagaatcagtgggtagtcctgacttgaatgggtttattttctttttctctcttgaattgtcggtgtatacccgtgtctttcttggtttatccttcatccccattcctccggatacccctatttgcatttaatctgtttggtcacataacctctcaagtagcgatcttggaggtttcaaaacttaacatttcattttccccgctgggtcaactaccagtctggaagcaccagggtttccaaggttaggttacagtgaaggcacaggggacatcttcctgtctcctctgcagagccagcgccactgtgcagtggggtgtggaccccggctcctccccaggctcccaggcctgcagctggcacaggggtccccagaacctgtgagggggtccttccctctgcctccctgagggacttggtgattcttagccctctctaacagagggagaagacgctgtcaaaaatgtggtttgcccaaacccacatagagctgggaaaggggccagggactcaaatagcagagatttcctggccatccatcagtcaggttacatcagtatactccatgtggattccactgggtgccggcctggtggctgaccctgcctttagagggaactcattattgtgtatttgaagtgtaaatacctcttttcccagatgttaatcttgtttcagatattcgatggagagggttcacataataaataattccctcctgagtcggcttgcgtggctcctgagagcagctggtcagggcccttcttgtcggtgtctcactggcttttagcaaaatggagacgaagatgaaagggaaaccttaactatagcttgaatccttagggtggactaagcactcaaagccttccatgcaaagcagtgtggcttataaattggaggcatttttcttattattaggacaaaccagcacccgaattggtttgtcaccagtaaaagaatttaaaacagtgcccgatttgcacagctgagattttggcaacagtatcttacacatctgaatgggtggagtaagatggagcatcattctgtgatatgtttaaaataatataccatgaaatgatgcagtaagtgttggagatatcttccagaagtcttaggtcatttgttttcatgtttaaattgtttccgcaaaggcattctcttcaacataaggagagctaaaaatcaaatacacagaaattttgtaagtgtgttgtttttttcttttcctgtttagactttataacattacactatttacctgggctaaacaaaataaattattttgtacataaaaccacaaggagatggtttagcctacttatgggaccaaactgttgtattagccagtgtgggagaatattgcagagatgtgtggcttcatcaatgaagattagatgtaaagtctttttaaaatatatgagaatgttgaactaaagatggttcagatgggactttgctcgagttgcttgagtctagaaggcaaaataaatgtttgtaattgttacataggccagccttccaaaatcccagctatccatagaaaacaaggggtcagcaaaattggccatctgcctagactggtaggttgtatgggtctgaactagaggcagtctttccccaggggacatttggcaatatctagagacatttttggtgtcaccttgggggaggggtagtactggcatctggtgggtggagaccagggatgccgctcaacatcctacaatgcagcggtcaccgatagcccaccctgccccaccacagccaagaatgatgcacccagtagaagcaccatccctcttccactggtgacatccgaacatgtctacagacactgcctaatgcctcttggggggcataatcacccctagttgaaaaccactgccctaaactgagactctgaaatcaaccacttaatctcctttcctctgagctcaggggagggacgtgactcctgcgagctgccttggctttttgtaggggcacagatagaagccatcccccaacacggtgccctgggttctgtggtggtctctgagaacccatgaataaggatcccagggaagcctttctaggtcgtgctgctttaatattattctagatgccgatttaaagtcataaaggaagaagagctaggactgtgctggaggaccctaaagcccatggcccatggtttcctataatgctaaccatgcccggagtatctagttataaataattgtgctgaggtcatgaatatttgactttggttctcaaatattcctaagaaaaaagtcatgaaagcccctgatggtaaaaggaggagagctgagacctaagtggataggagactcaggaaaaagcaagttagaaataaagttcaacaaccacaggagaggagaaaatgggtccaaaagacttgggctttaggcacatcttacctaaggacaaaaaagtagagaaaagatcaaatgttgagaaaagattgagccatgcggagaacgggcagggtgttgaagtacctgctgctctccttaaacccagcatgctgttcactgctttattttagagagtgggtgtagtggtctgtttcagaagactcaagtctacactgcctctgccactgaggttccttttgactctgcagaagtctttacctttcatctcctttctgaaatgctgtgagcatttttcctcccagagacattaattgggaacagcagtgaatgcctagttccttgcagtcctttggcccacacgcatttccagctgcccactggccagactggattctaaatgccaaaagctacaggcgctgacagagtgcttttgaaaagaaagaaatgcatgaaatgccccgaatttatgggaaatatttatacccagcagtccttgagccatgcgtgtcctttaggaacggtgctaccagacagccgtcggcatggccttgctcctggtggtgcaggctctgatgttccactgatgtgagcccaagagaggaatgaccagtcagcctgtaaccccagctccagtgttgttaatgagtgtcaccgatcaggtttcagacgttagtcagtgtcccggctccagtgttgttaatgatggccacggattgggcttcatgcgttagtcagtgtctctgttaggagctgaattgtgtccctgcaaaagggatgtatttaagttccaaccccttgcatctcagaatgtgagcttatttggaggtgggatcttaaccgagtgtgactggcttccttagaaaaagaggaaatttggacacactcgtacagggaaaaggccatgtgaacagccacctccaagccaaggagacaggctcagaacagattctccctcacagccctcagaagaaaccaaccctactgacgccttgatgtctctgaattctgcactccagaaccgtgagagagtcagtttctgtgaagccaatcagcttgtggtactttgttatgttgggcctatgaaattcatctactgttactagcctttcccaaatatttcagtccatgaaatgcacccagcatggcaactcttcaacttacagaaatggaaaagagaaagaatactgtgcttcagctagttttctcattacccagaaatgaaaaggcctgacctctgaaaccttgaggaatctctttttaagatgccagagcctgtacttctgcctgatccaagcagagtttgctcgctaccccgggcatcacttctcactgcccaggtggcactggatgatgtccaagactggccagatctggatggattccataaatagctcgtgctgtttctggtcagtgaagaaagaggaaggcaaagccacgtgcataagtttgttgtggatgccataacaaagcgctgctggagtggctaaaacgacagacgtttattgtatcccagttctggaggccagaagtccaaaatcaagatgtcagcagggctcttcctcctgagggcttgaggcaggatctgtcctgtgcccatcttccagcttctggtggctgctggcagtctttggtgtcccttggcttgtagctacatcacccagatctctgccttcatttgcacatggccttttccctgtgtccaaatttccatccccctaccttttttttttgttttgttttgttttgttttgttttgttttttgtttttttttttagacggagtctccctctgtcgcccaggctggagtgcagtggcgcgatcccggctcactgcaacccccgcctcctgggttcaagcgattcttctgcctcagcctcccgagtagctgggattacaagcatgagccgccacacccggctaatttttgtatttttagtagagacggggtttcaccgtgttggccaggctggtctcgaactcctgacctcaggtgatccgcccacctcagactcccaaagtgttaggattacaagcatgagccactgcaactggccaaatttcccctttttataaggactccagtcacattggcttagagctctctcctaatgagtttacatctgcaaagaccctatttcccaataagaagttactcccaggtactaggtgttagggcttcaacatacgccttgggatgggcagtcttgaatccataacaccgtcaattaaaaggttctgctttcattgccgccaggttgggaaaagttgccagggtgggcttggtggaggagggtctctcagcagggcagggtcattgcagggaaaaggagagagaaacagagacacacaaaagcagatagattgccttggcagaggtggccagactagagtctttgagttttgtagagagatcaattgattacttctagaaatgtcctcttcaaagtctctagttttctctcccatttccttatacaaggctctggccatattactacttctggcacagttgattcagtgacttttgcatataggtttccccaaagctaaagctaaaaacgaacaaacaaaaaaagattattcatgaatatgccacaaactttgcccatagataagactttgtgattacaagcaaaatctgattggaaaataaaatacattatatgttagaataccaggaaacttctttttggggagcgtctttatgaaatgaagccatgctaacctccctgggactgctgatcagaatgtgctccaccccaaagcctcggagagggcaggacagccagtgactctctcctgtcagtagacacactaaacctgaatccaggatgggaaatcaatgtttgacacagctgtatctctttcagttggatcagtaacactcgctcactcactaggacttccatttgcttttagctgcctgcaatgaaaacctggcaagacgtcttagtctgatccggctgctgtaacaaaataccgtagactgagtggcttataaaaaatagaaatgtattgctcatagctctggagactgggaagtccaggatcaaggcactggcagttttggtgtctggtgagggctgctttctcacagacagcatctttttgctgtgttctcacatggtggaaggggtgagagcgctctctggggtccctttgataaggcactaatcccattcatgaggccccaccctcatgaccgcattacctcccagaggctttacctcccaacaccatcatattgtaggttaggtttcaacataggaatttggtgggcgggggggggggtacacaaatgtccggaccatagaataggacattacagcttgaaaaagcactagagagaatgacgttgttcctttgtaacacagaaaagcattcacctctcaatttagatgagccattttgaccccagttggttctgaaaatccttgttgacaaacaaaattggagaggaccatagcctgcctgcttttcccgaggcccggggaaagctttttcatatgatgttattataatgttaggtgtaacaataaatgaaagttttgtatggtctgattgggtaggacaggcctgaacacaggcaaacccatctgcacagcatgctcaattcagtcagtgtacaaaccctgtgtcatgggagcagagagaagggtctgcttccattccggaggatgacagaggcttaaggacggtgctggcgtttcagctgagcctttaagaagtggaattttatccagaggtgatcttcttggaatagagagaacaaacaggtcagggcatgcagacttgattacaggtgctctggggaccactggaatttttgttgaacagaggatgatgaaataaatcagtgttctagtgtgttacctttgggcagtggcgagatccgagtctccatagtgaacaaatcagtgcacagaccagggcagaagtgcaggggaacatggaacattcagggcctggagggtggtacccaggccaacactgccccctttttccagctcccatctctgtccacatagttgggccagtgtagacatctgggtcatatagggaggcattccagtggccccatgtggtttccatggagatcttcaggaaggggttttggggtgagagttggtatctcgtggcaaggacacactccctgggctaggtacatatgggtggttttcttgtcctacagattgcaaagatacaggggtagctgttctgctctgggcagcttctgtagagacaggatgtgtatttgcttgcctgctcctggaagccagtcactgaggcagacctctttactcgtccagaagcatgacttggggatgattatagttcaaggacataaggcctagtggtgtctttcatcagcgccccccattttacatttctgggatccccctttctcttttactctgatctggcctcccttcccacccctctggccactcaggtgaggagatgccagatcccaggtgggcaggaaggaatcccactgaatgagatccttggaattgcagcgtagcctggagctgtatgttcattttagatagaaatattgacactattgacactatttggccgggcgcagtggctcacacctgtagtcccagcactttgggaggcaaatcactttgaggccaggagttcaagaccagcctggccaacatggcgaaaccctgtatctactaaaaatacaaaaaaattagctgggcatggtggcacacatctggaatcccagctactcgggaggctgaggcacaagaatcctttgaaaccgggaggcggaggttgcagtgagccgagattgcgccactgcactccagcctgggcaacaggtcgagactgtgtcttgagaaaacaaaaagaaagaaatattgacactatctgtccgcaaaaggtcaaaggcataattacaatatgattttgtttccatttttctttttcttcttatttcatgcaaatgctgtctttttgagagaagtggttataagcacagcgatattctatgctatgtacagctctcatatatagaactctctagaatggctcaagttaccattaagcctcaggtgatatcaaggttataaaatgtaaaatgaatgatcatgatcattaagtagaaatcctggctgtgtcttccaagttctttttctttctttcttcctttttttttttggagataggtactatctgcatttcagcttagcttgccgccagtgttctggtttcttgaccatgctgagtaattttcagccacaccttgtatcccttagaagcccttcttgattctgaggtacggggctcagaaagctttgtcgtgggaggttgtaaattaggaaacatgaaaatcagatcaacaacagtggctggtcctggctgcagggctcatctgcctggagtagcttgaagttgaatgttaatatatacttttaaattgcagttgtttaattaggtaaagtgcacaggtgactttctcacactaaatggatgatgagtattgggaagagttgactaaaatttctctatcttttgcccatatccaactctcattgaattttaactcttatgagatatgtgctatttaataaataatgagtctgagttttctcccttttggaaatgtcaggaaagtctcaatgattttaagtatcttttattttataatagcaatagaatctagaatttctaaaatcaaactgagttcttgattaaatgttgaaatgcttgtcttcatccacctgggagcagtcgttgtgaacgagaagccccagtgcataaatcattgaatgatacattggagaagtctcagagtaaaggaagatttgtttacttttcagacatcctggaaggtgagcatcaaagcaggtgagtggctggctcttggattcaagcttccctgatcctttccagaagtgtatccttctcctttaagagaa[450 bp omitted]cagaggttgacacccaggactagagctcagtagaggggccgtttcctacctgcagttcccttggaagagaaggggtgaagcttaccatgttggtggtggtttgtttcctggggctgctgtagcaacgtgccaccaactggctggcttaaaacatgtatggtctcccagttctggaggccagaagtgcagaatcaaggggtccgcagggcccagctacctctgaggcctccaggggaggatgcttcctgcatccccttgctgcttttggtgttgctggcggtccttggcttgtgggcacagcactttcctctctgcctcggtgactacatggcctccctgggtgtctctgtcttcttgcaaggacaccagtcatgttagattatggctccaccctgctgcgatttgacctcattttactttaactaactatctgcaatgaccctttttccaaatgaggttctgaggtgctgcacgttaggactttagcatgtgatttctgcggactcaggtcaccccataacagtagtcatgccccaccccatcccactccacccttctcccaattcccctggtatactccagggtggctctgtggccacacatgacccaggcccactggccattagacactttggcagggtggccaaagaaattctttgtgctgaataaaattaatgtgtaaatgcggcggtgctccaagggcagtgttgcgtgaaagggcaatagaaccatggctcctgataaacagaagcctgttaagcagcaaggtcaaaagccagatgcagaagtcagaattagccgggtagactttttatttcactttcccccccttttttttttgccagtggactgccaactgttctcttaacagaagggcagtttttgagtaaatgaagcaggacttgatctgggttgtcataaattgtctctccctcaagaggtaacttctcgtgtttgccagttcagaggtgtagggagacatctctgatgtgtagatgtcctagtttggggtgcagggtggctttgggtctgagagcctgctgttggccactgggtgcgcgtgggcttctccacatgacaagacgggaatgctgtgaaggaggccgctgttccgcttgggatgttggccgagcgccgctggcctgtgtccctggaatcctctctgattcaaccattgaacattaactctgtgaggtcacagccaccagcggggcttctgagcccggccctgttctggccatagagggtcaggaggagaagacgtttcacccttggattttctgtgtttggaatccaaggcctttcccgtggagtcttgtgaggttttctcgggaagaaatgatcctctgggagaggcttgggcgcgaactgaaacatctttcaagacactgtggctcttttcagggaaatgctaagccaagcaaacatccactcagaaatgttctgtatttggaagcctcagagtgttaggggaagccttgaccctggaatgtcatctcctggtggtggcggcttcacgtggtaaacaggaggtaacctgggtgtcatgtcacccaggtgacatgacacagggccacacaggatcatcttccagtggcagtggtgaagataggggatatgatttcacatcctcattagagcccacacatgagatccagctttataattggaatcccagataatgagcatgtgaacgtccgtaagttccgcctattctgggtatgatgtcacactcataaacaagctaagcacacaaactggaatttcactttggaggaaaaaaatttcaattctgttacatgagataatacaagtagtttaaagccacagagggtctctttcgatcaggtagatctattcttctgtgctcatgcaatatgatagaagagcttcttgcatctttatgtcaagaatttgctaaaataaatcagacaagtttaggatttacctcatagtaaatcaagaactttaagcaggggcttttcttctaattaaaaatgtcatgtataccacttagacatggaaatgcttaggtaagtggagcaaattattctctggggatttagaaaaaagaaaatcagtctggtttctatggctgcatgaatctggaaggtaaattattaacccagtagactaagattttactaaaaacagactaatttgttgtggcaagacagttccagtctgtgtgctagggcttttgtttgcatgcttgcttgaaggcagacaagtcaaattaaacaataattattggcttggagggggagcagatgtattggattagtttctgtgccacatttctctcatttccaccaatgcactccagtttcagcccttgtatcagttatctgttgattgctgtgtaacaaatgaccccaaaactcagcaggtgaaaactacaaacgttaatgatctcacacaggttctgagtgtcatgaatccaggtgcagcataaccaggtggttctggctcagggtctctcgtgaggttgcagcctgcgctgcagcctttgagacctcgtgtggggctggggggtcagttccaagctcccttagggtgtggctgcagcagaagtgatgcaccatgtgcaacaattctcttggtcctgtggatcaacctggtgaatgtgggacaggccggtactggagtgtgaatgccagggctcacggggaccgaccgtctgagaagctgcctgtcacgtctctctttgtcttttacacccataaatgggcaccttggtcagagaataactccttttgagtccataatcgtctatcagaaaattctgggaaaattacttgttgatttagccacgttcatggcctatctttggagccatcagagcccacaaatggagactgtcaacagcttagcagtcagttcattagaaagtagtgttactgcagcctgggtgacacagtgagactctgtctgtacaaaaacattaaaaaattagccaggtgtggtggcgcatggctgtagttgctggaactcgggaggctgaggtggaggatcacttgagcccaggaggtagaggctgcagtgagccatgatggcatcactgcactccagcctaggtgacagagcaagaccgtgtcccaaaaataaataataaaaaaagaatgaatcacataccaatttttttgctcttaattgcatttttgaacagaaaaacagttttccctgcaatcaaatgcaaacagttcctgagcccctaatggacgagcgtcctcagctcccacctgcactataaatttgcgttaatcttccagttaacttcagaactgctgctgtctctctatgttccttctgcctcaagacatataggaaatgttggcctttccctttcaaaagaacaaaacagttgaataacctactacagtcttctgtgcaaagttagcttcaaaaattatcaagaatgttttctccaaacattcacaaagtttacagagttttcccttttactcaggatttcagcccctttgttgctcttggctctcacagcaccaagatcgtctgtccactcgttcattgggcagatgtttattgaatacctgtgtgtgccaggccctgggccctgaagtcagggccataaacacagagcacagtcctaagggcaaacgattttctcaacagggatttgaggcctgtgaggtttgaacaaatgagcctcgtgagtgccagttctggacactcggcctgacttatcggacatttcgcagattcctaagattttagaattgggagagaatctttgagatttgcttgtagcccttacattttctagacaaggcagaaagaagtccagtgggatgaggcagtgctggtgctggcaccgcctcaccctggcacttgcatcgcctggaaacaaggcagagcccactggggcccccagggtccaaagcctccaggtacgtgtctgagttctagcattggagttgccgctctcacccttgccagttgctttggcatgaagcttgatggtaccagtgtgtttctgtcttcacagcttgtggccctggccctgagacctgaggcttggatggcactcccacttcttgctttaattcttccctggagagttctcaccttccctgctttccaagtccagctgagatgggcaaccaaaatttcccaagggagaaaatagctgaaaatagaagtagaacatgaaagaggatggcttttcttttttctttttttttctttgttccttttatttttttaagttgatttatttatttatttatttgagatgaagtcttcactctgtcacccaggctggagtgcagtggtgtgatcatagctcactacagcctcaacctcctgggcttaagcaatcctcccacctcagcctcccacaggtgcatatcaccatgcctggaattttttttttttttttttccaatttttgtagagacagggtgtcactgtgtttcccaagctgttctcaaactaactgatcctcccgccttgggctcccaaagtgctaggattacaggcatgagccatgtgcctggccgagaatgtttttcaatttgggcttgttcagtggttttcacatgattggactggggtggtaggttttgaggaacgagaccccagaggtgaagcgcccttctcaccacatcatatcaagggtaggtactgtcaacctgactcaccactgttgctgttgaccttgaccactgggtttaggtcatgggtgttgggttgcgattaatgtttttccctttccatgtagtattctttcaaaatccccactcgggtggaggaggggtgttaagcatctcttcctggaggttgtttatttcggttttatgttaaaatatatcagtgcagatccattcacccatctcttgatagaaggagtaggatttttcttgggacagggatcctttattcctagtttggagtcagcttcccccattccggatggtgcagcctctacaatgtttgtctctttgaagcggagtgggaattgaaagagatttatgaaaccatctcggtatagaatctatctaggattttattttcttttcccaaatcccttgaggcaatctgtcttggttaagtctctaaaaaagcagtcaaagtggtttttgtcgaaaaaataatttgggggtactcctagttcaccattttatataatattcaattacttttcgtaaatgcaataacaaggccaactgacataagcgagtttgaagcagtcagcagtttgggtgtttcagacccaggtaggcagctgaggtgggagatcccaggggaagctcagggagcagctgcccgccttggtcagttcagccaggttaagtggaggccttgggaagagagtttctcctcttgagtatttttagaagcagcagatatcagccataaatatttaatgttgtgtttctaaactttagcgtcataaaaatacaaaaaggtgactgggcgggggttggtcagtatatacctaggggagaaaagaacttcctcaacacatcacactgcataaggaaaaccgtcttaaacgttcttagaagaaaagtcagtaggtaaacagctatcgtgtaatctgatgaatacccaccggaggaagtattagtaattattctttgcttgccagggttttcataattcttttccaattataaaaattaatatgctgtaagcagtttttaaaaataaaagtaagcatgaaaagaaaaacatctataaacccacccctagaagttttgccccagcattttggtggtgtgttttcttccaggtgtgtgtgtgtgtgtgtgtgtgtgtgtgtgtgtgtgttgccccagcattttggtgtgttttcttccaggtaggggtgtgtgtgtgtgtgtgtgtgtcctgctgtattctgagctttgtagtatgccccttccacttgaccttctccaggaagcatttgatcatccagcaacatcgattgaaaatgtttgtatgcatctctttcatgaagtacatgttccatcatttatatcacatgtgttgctggagatttcaattgcttccattttcctttaggataaattgctggaaatagaactggagggctcttgagaccgattaccatattgctttcctgagaggctgtgcgggttgcgtggcagtgaggagggacgggggtaagtggaggggctggggcacaggcctctccaacacttcatgtgaacatggtcagctgagccaggaatgcgtgacatctttatttttccccttgcatttctttaattcctaacgaggtggaatatttgatcacatttgtcagctatttgcatttctttttccatgtattagacctaagcctctttgaaaggtgttatctcaggttctttccaatattgcactttctgagtttctcttgaatcccagttattttaaggattgcagtgttggagtttcagctgaaggggccatgtctgatgtttgctggtccattagcctcctggcctgagccaaaccatgcatcttcatgtcagagctgcatatgaaacaagagctaagtccagaaagcaagaagaagctagcagattgattttcctaggtggggcctaccagggcacttctgttgttgactgtaccactctctcctgaagggccctggttgtgtactgcagttgggactgctgacgtgttggggtgttacaagagcatgcggaggctgctcctctcctgtttcctggtgtgctgatcaaaagactttttatagaatgacagttgtaggaaaagcacagattcttatgttagccaataacggattattttttaatgttattataaattggcaagcttactaatttgtttctacttgtcattagccaaagttcagtgtttcccaaggatatatgtgaatgtgtgtctgtgtgtgacatctgttgtatttttcacatgaattaattgagtatctattatgtggcaagctctgtgctgtctttgaagcactgaactgtcttatgatacacacaggatgaggacaggatcattttctatatttctgtgaagtcctttttcaaattcccattcttttgctgcttctgcatctcctttgactgctttagggcatcccaggtagaaagcttacctaatgtcaactccagttctttcttttgtagtcttcattttaagcatgatttctgtttttctttttccctttaaagaaagcttctcaaactttgaaatgaaaacaaatgaaaggagagggaaaagattcagaaattattgatagattgctaaaaacaaatgctatgataattttgggtcggagcatctgtcgttttacagcacaacagatttagcttcttaatgatgtttgtatgtttttcctcaaaagtgtattgactaggtaggagttgagccaagccttgaatgaatcatttcctgccaaattcaatagactgagcaaatcctcggagaaatggccatatttctctaacactgggttcctttcagggctcaagattccattttctctcaatactttgctcctacagactaggagtcctcttcatgctacagtatgcagtgtgtatggaaactgtgaatggagaagcagccgttcatgctgccaagtttctttcagaaggtggctccaggtggatgactttcagtctgaactcagtgtcaccaggcatgtgtgtgcccacacactgccactttaagctgtggacaaacagaacggatattctcccaccaaaataaacatacaagcaaaacactctgtcttcattcagcatcatttgcatcctataaaataatggtttctccttgatgcccacctttcttatgggtggttcttaattagttccaaacagaacttaacgtggccatgatattccacttgctaaaacaagggcagtcgagtgttcgatttgccatcattgattagacgcatgcagtcacccagtgctgtttgcccaagcatctgtaggcggggattccccagtgctgattccccaatgcttgtaaggggcaggacttaattaaatcttaaagtgacagctgaaaatgtaagggtcaggaagtcatgtctaaaaggggatttagtataacaataataacagcagtgactaagactaatcctggctcaggcattttgtttggggtcacctggtcttaattagcagcactctgggatttgagtggcgctgtgctgttgcccacaaagcccatcagtggcaccattgcctgtgtctttcggggcagtctgttagggagggggtggcacaggtgttggcacggccatccccattttatatgtgagggaacctcagccaggcaggatccttgcctggatgctctgtggggagccctgtgagtttgtaaccctccgtgcagcctgccaggtcagcggccccaaaatggagagatacagagggcaccaaattgtaaggcagagcgttggctagtgacacaagctgcctttcgatcgcctgggcgttctgaagcccgcaaacattcgcctggaccttggtcaggtgtctcacagaacctacagtaattcactgttaagaataacttcaaacacagaaaatcgctttttgtttcctagagaaggctagtcttcagcgagaacaacttgtgatttttaatctgtttcacactggtcggggaggggggaagaaaagatgttatgggcatataattaaaaatttgtcggcagatacaattacaggaagaatcatgtggcctaaaaaactgaaagcctccatatgcctcttcatcttgccagctacagtccacaaattgtagagcctgcgggcactgtggaagccagctagatttgctctatccagtagcagcagattgagagccatacatggaatttatacttttctagcagccacaggaaaagagtacaaagaagcaggtaaaatttatattacaacatcttttttactgtgtattaaattattattgtaatacctattttaatatataataatgccataatatattttatttaacccaacgtatccaaaatggcatcatttctacaagcgattcctattttaaaaattatccgcaagatattttatgttctttcttttttgtacaaagtctgcaaaatccagtgtgttctttggtcagtgatgtctgagatcccaagttccaatgtctgtctgaaattatgaaaatcaagtcatgggagatggataccctattccctacgatccacttatttcacattgcatgcctgtatcaaaacatctcatgtactccataaatatatacacttactatgtaaccgcaaaaattttaagaatatacaaaaaattttaaaaactgaattaaagagcattgtagataattgtatttttcaaaaaataagtaaaatatctggtatataacagttaaaaaaaaaactgtattatcaactctgtgaccttagaactacctttttacattttcaaagattaactctccttaaaaaaataaatgtacaaattattaccaaaaaaaaaaaagaaaatcaagtcataatgtgaaaaataatttttaagctgaaagttacactgtttctaggagttttaaactaggatagtttgtggttattaatctgtttggaagtagtccagaaaaaaatgctatgggtcaataacttgaaaatgtgcatgtggactacttaaagaggaatcgtgtggcctaaaaagtccctgttatccctccaccctgcagactccaataggagaatttccgctgctgcagactctccttggtggccaagctgcccagcactctcccgtcccaccaatggtgtgactcctatcactgagaaacagaccccttaccatttcatttccttttaattaatttaaatttaaaaatcaacacttccttggttactggaatgttgggaaccatgtgggtgtgtgcatctatattttccagggtctattttgttacctataataccagtcatgtatttccaatgaaaatttaacttgtgaattgagatatagtacaaatgtaaaatacatacactgtgatgatttaggaaatttagtaggaaaaaggaacgtaaaagatctcagtaattttttaaatagaatacaagttgaaatgatactattttggatacactgagtaaatcaaaatctatcatgaaaattaatttaaggctgggcgcggtggctcacacctgtaatcccagcactttggcaggccttggcgggcggatcacctgaggtcagcagttcaagaccagcctggccaacgtggtgaaaccctgtctctactaaaaatacaaaaattagccgggcatggtggggcatgcttgtagtcccagctacttgggaggctgaggcaggagaatagcttgaaaccgggaggcggaggttgcagtgagctgagattgcgccactgcactccagcctgggcgacagagtgagactccatctcaaaaaaaaaaaaaaaaaagaaaagaaaaagaaaactaatttaaaattatacataaggcttgccttagatttctgttgggttgtgcagatctagaccacagttgtcatgtaacaaaggaaggagagtttgaaattacaggctcacagttaatgataaaattccaacctaaacccaagaccagacattccaaacactcaagtgagtcaatctgatgatttgtaaggcttaatgttgaaccgtcttcaaatgtgatgacctcatcctaactctttccaagctcccactttgggtatatcaagaggctgaatgtggtggctcacatctgtaatctcagcactttgggaggctgagtcaggaggattgcttgaggccaggcatttgagaccagcctgggcaacacagcaagaccccatctctacaaaaaaaattagccggatgtgttgatgcacacctgtagtcctggctactcatgatgcttgggttggaggatcattgagtccaggaatttgaggctgcagcgagccaggatcatgccactgcactctagcctgggagacagagcaagaccttgtctcaagaaaacaaaacaaaaaatgaattggccaagagaagtcaaggctcatctgacttggaagggagccaggttctcagtctatactgcttttctcatcctggcagcatccccatgagataaaaatgattattcccattgtacacttaaggtaaaaggtctcaaacagatgaaataattgcaccatgactatagaaactagtaagagtcagcgcctgaaattaagcccagggctgtctcctttgacactggccaaaaagcagtaacctcttttgatgaaggggcttacttcaagctttgtttatgtgatgaaaacaccccagggctccagaaacttaacatttggttccacatccagaaaagtaaatttacaaaatggtactgcaagtgataattctcgttgacctgggattgctagggtataagcattctgggaatacctgggtttctgatcaggaagtcattcgcagctataatggtgatcctcagtcaccgggactctgggattgctagggtacaagcactctggggttacctgggttcctgaccaggacatcactcgcagctatagatggaatgctttaccccttttctcctgtgttatatgacatcggttagcaccttttaacctttttagaagataggttggaagttgagttagataaatcaacaggtagctgatggcctagaatataactttctgtagctttcaaagtgaggatgaggggcatcttgttccctaaactgcttcctcatgatggggaacctcagcattgtcttgccttgtgtctgagtacccatgtaaaattcagtatttcattcttaaaagataaaggggaagaaggaataacaatagacaaagagattccaccctagtccccatcctcattctggtgaaaagttgtcattactaagacaatcacacactcgatggagaattgtaggctgtggacaacagagccatagatggtgtactaatagctgctacaaaggacgcctctgtcctacctttcatgcccagctttgagtatatcctgtctcttgctcattaccgatgctgagttttagccctgtaaccagagtcctctttctttttccacagatgggactatgaactgtgttttaatgattagagggagtagtgaagattttcactgtgaacattttcaccccctttcccatccttggccagagatgatctcacatggtcttggcaggtatctttttacaggagtgcatgttgtttatcttgggagctttttgcacagggaaggcctttgtcttccagctctgtgaatccttcttcactgcgtagcaccttgcagaacatttgcacatattaggctcttggtgaacacttagaatcctcagtcatttgcattcacgtcatgtttccataacacattgaatgaaccagcaagtatttattgaacatttactatgtgaaacacagggaagacagccatgaacagaccagacacaaatcttacgtgctactggataaaaatgtaccccacggatgacactttgggtattatgatgccaacaatgagaacatattaaatcactttggtatttgcattagattgtgtcctgtaagtttcagattggtgtatttgccaaagaacaattgtgtgtaccccccacccaccagaaaagaatacagtaaaagtgctaaactattgaatatttttaaatggtattatatttgaaacgtgtgtttgtaattttgagccatgtaattagaaatctagggtttatttaaattcttgtttgttttagagaaatatgtaaagccacatttccctttatataaagtacttggttgaaaaaacaatttttttctaaagaaaaaaaacactctttagtgtacttttgccaattaaaagacagtacagagaaattgattcctcctggagtttgtgtagaaattagaaaacataatgcttttccctaggcatgaactcgcttaaaactactgagaagcttatactcacgcaggttgaatggagtgaatagtggtttagagaattgagctgattaataagaagtccctgattttcttttaataacacgttctgacccaataaggaaaatttgcactatgttttcctacagcgatggtgctgttaaaacttatgcaaatgggacaactttattattactaagccttttacagtatgttgctttccagggagctttgtaaatcattataattgtgtttcctcagtgtatgggttctgaatgctcctgttgtcctgtgaggtgaatttccatttggtgaagatgatactgttaaatggaggtttctaccccatagaaattaagaagagataaatgcagacagacccagcccttggaaattctgctttgtgatgaattatttccttatacttatggtgaacttttttacccgtgatgtgcacaggggcccagaatcatatatgacaagtccttccatgtggactacatccatatgacaccatgttcactagttggagccttggaaatccagtgggaatggtgagatagtgtgaacagctccaaggcaccgtgtttttaatgtaacccattcgtttctggctgaataggctagttgttgatgtggtgggcattatgagatagtgttaatggttgggccacggcatttcaaagagatgccttataagtcctgagcccattgtgcgtctctgatcattttggtcttcatttgctccccttgcccaccgtccttccacagagcattctctggaagcgctcagggagcagaacagggcaggcccacgtagaaaatggtctcttgagagtagaaggtcaggttcgctgagatctctgactcagaccacccgtacccatgctttttgttgtgatggagaaggtgctctcatatatacacatttgtgtagtaattactgcatattgatagcaatgttactgcacctgttaattaatataaccaaatggcatagctacagtgttttattctagttcaatttaggagagtatatttgttctcaatgggaattgatctggggagacccagagagtggggacatgagggttatttgtggaggggatgacacagcagcttcagaaaacagaaacattaatgcattagactgctgacctgtggggtcacacttccttcagtgatgcccataagagtcttggagtgccggaaagtataagcaacgctgagttcctgccagtatcacaaaggtgtgttttggataagagaggagccagaaagattacacttgtgtagaaagtgaaaactgagtttgagggaacagtcacattctcatggcaataaggtgggtagaatgggccgctcagcctctgcactgtggtcagctggagctggaagatggttgtggtggggctgccgtgtgcacggtgggaggtttagcagcatcccaggacccaggagataccagtagcaccgcctcccccagttgtggcaactgaaaatgtctccagatattgccagatgtcccaggatgccatagggggagcatgcagtatcattgcctgttgagaacctctggaataaataggtaaatgcatacaaatataaggatcttagtcttgcattgggaggcggcgtctgacatgtaaagacaccactagagcacactgaagtaggttctttcagagcattgcatgcatgataccctggagcccaaggagaaaatgatcaggccatgcctcctggaatcaagaaggcttgacttcacggcctggaggagataagttttaaactgatccttgaaggtagaggtaggtgaggaactagatgaaaggatcagtattaggtgggcttttaaaatattttctggccgggcgcggtggctcacgcctgtaatcccagcactttgggaggccgagacgggtggatcacatgaggtcaggagttcaagaccagcctggccaacatggcaaaaccccgtctctactaaaaatgcaaaaaaaattagccgggcatggtggcgcgcccctgtaatcccagctacttgggaggctgaggcagaagaatcgcttgaacctgggaggcggaggttgcagtgagccaagatcgtgccactgcactccagcccggacgacagagtgagactgtctcaaaaaataataataaataaataaaatagaatttttctgagtattttgtatgctgttgaaaaatttatcacttcgtagatgtatctcactttgtctatatctaagaaaaaaactatgtgcataaatgaatttttattagctagttaatctagtcagtggaatggagtattatttccagagttccacttcatattccttggtaatattgagacgctggttgtagtgaaaatactcttaattaaggcatgttgtaggttcagagtttagatggctgaatttcatgaagggtcttcaaagcattgggggtgtttggtgtacggtagtgattttcttgtgttcatttgacattttaaagtgatagacgtttaaccttgggctttctcaggactctagaatatgaatgatcactgttaactgtttagaaactcatgatgtaagcccatatgacttatggatttatgcacattctaaacagataagcatcatacaaatataacttgagttttctatgaaaggacagtgagacaccaccccccgcaagtctggcctgaacattggtggactgggaatcataaaaactgatacatacatgtcttactttgtgtttgtttgttctaagcgaaagcatgtgaatatgcagtcatctgccaatactttgtgggccagcccaggcctctgctctgaggatggcccacagcctggagtgccccagtgatcccagcactgtccacacccgcggtgcatccctcctggcttctagtttccagttaacttaagcaaagctgcacagacatctcactgtacatctctctagatttatacctcccctctctaccttcccggtcttgctgcccacacctgtcctcaagtaaaaactgattcacacttaccctgtctctcaaacattcaatgttattttcattttgaaaaaaggctgtgaccctgtgtgtactcgtacttcatccgtctgtgtaatatttaaagtttgtagttaaaatagtgaggacactgagtgaaatggggctgggagcagacttggatcggctttgggagatggtgtaggcagcgatggggacaggtggaggtgcggaccggagtgccgccctctagctgcgagcttacatcctcatgcttgggtgtctgtccttcagtttcttctccagtgccacgtcacctacctgagctgcctcaggtttgctccctgctgctgtgcacacgtaaatcagtgtctggcgggaaacaggcagacgcctttacaagaactagttgccatttatctttttattgttagacctcccagtaatgtgtgaagtctagtaattgcctgtgtgtcagactaactcagttgtaagctctacattatggtgctattaatctcttcaatgtaggcaaaatggggacagtggctcccacagcaagcccatctgctctacccatgtaagttgggagggatgtggtaccgtgtggcttctacttctccatccactttacggttgatgttcatgcttattgtaaaagccctgcaagacctagagatgctgtgagtcctcacgaaggaaaatgcagtgttccgtggggttgtgctgtccactacaggctcttgacttctgaactttctgaagtttgtatatttatccgggaactcatacttaccaagctgtattttaagtttctttcctgagtcaggcaccctccaagctaagtgctgtggctgcagaggcccctgccctgatggagcttgcctgttacttgggagacttgtagcaaacagaggaacaaagaaacaaaataatctgatgacagtaacacatcctgtgacagagacgaacaaggtgacatgggttggaggggtttgcacattagaggtaagaagactcctgtgaggaagagatggatgaaccgaagtgtgtaagatgcagccggaagagccaggagaagagagtttcaggtggagaggccagcacatgcgaaggccaggcacccaggaaactgagggaaaacacaggccaggccagcatggtggagcgagtgaccaacagagcagaggtgtgcacggtgaacaaagcctacagtgctttgccggccataatactaagaggatgagtgtggacctgaaaccccccagcagcttcctaccacactaaccagtggctggctgctggctgagggacggactgtgatgactcccactgggtcccaggcagggagataacctcaccttccactagcatagctcagcggagccaagaaggggagaggacagattcaggacactccagtgcagaatgtcagcggacgtgcatgtgtcctgccaggggagtgaaggtgtggcatgtgagcacggagtgggagggaggtgtgacttatggagactacaggctagaagagagacgagatgccatggttgggtgggtggaggtctctgctgtgggcgtgttgcgtttgagatgctgcttggaccttcaagtggccaagtcatgcagtccctgcagggataggtgaggagctatggaggttgggggctggagacatctgggatgtagacctggagactagattcgttcactggagagacccatggcggtgtagtcagcgaggggcactcaaaggtcgggaagatgcctttcagaaactcagggtgcccaaagcatttccaaaatcatttaacacctccttgcattttcacagggacttggaacctcttaggagataagaatatagggaaccagccatctggagacttctgcagagaatatacattaatatcactgtcttattctcactgactccccacctttttaaaataagggagatggcctagactaggaattttgcttaacttctatcctcctgtcctttttttctgactctgcagttttcatctgaggtagagagaaatgatgcactctgctaaattagacctgaatatctgttgtttttcttagacttgtgaagtttttactaacaaccacaagcacagtcctgaacatcgtataacagcatcatttgttaattttttgaatgaattttgtgattaaccttgatttaacaagaacacccagcccatttcccaacgacacaaattaatacaaatttaatgaaccgaagtgtgcccttctgctgccacgtagctcagttctccagggatggaagctggcctgagaatttctaagtttgacgaacattcagatgttccagaaactatcaagattctgagactgtttctaggaaaggccacaactctactggaaagtatatcagaatgacatttttgaatctgaaaagaaaaaagtcctgtacatttttaattttagttaagagtttgaatctggcttaatatattcttaacttgctagtttgaaaacaaactggtcgatgctcattttcactctcataactgtttcgatatttctgattttttttttttctttaaccaacagaggggtctttggaagacatatgtgcttttaagtttcaattttcattgcaattttgtttgtggtaaaatgcacataacattacatttaccattgtaagcatacagttcagtggcattaagtacagtcaccatctacctccagaactttttcatcttcctgcactgattctccatcccccatctccacacccccggaaaaccaccatcccactttctagctcttgttttgactactctggtgacttcatatagtggaatcatacattaattgtcctttcatatcgggcatatttcacttagtgtagcgtcttcaaggttcacacacctgtgtcagaatttcattctttttttttgtttttgaaactaagtctcactctatcacccaggctggagtgcagtggtacaatttcagctcagtgcaacctccgcctctcaggttcaagcaattctcctgcctcagcctcctgagtagctaggattacaggtgcgcgccaccacaccctgctaatttttttgtgttttttgtttgcttgtttgtttgtttctttgtttgttttttgtatttttagtagagatggggttttgccatgttggccaggctggtctcgaactcctggtctcaagtgatctgctcaccttggcctcccaaagtgctgggattacaggcgtgtgccactgtgcctgaacagaatttcattccatttaaaggccaaatatgtcattgttcgtataaacagcatgttgtttatccactcatccgttcatagacatttgggttgctattccaaaatagcttttggctattgtgaatgatgctgctgtgaacattgaggaacaagtgtctgtttgagtctctgcttccagttcctttgcatatacctagaagtggacttgctggatcacatggtaattctgtttactcttttgagggcctgccatactgtttttctgaaggtttaagtttttgtgagatgtgataaaggtagggtccaaccgtgactcctatgatttgatgcaaaggttaacccactgtatcctgcaagccaaatttagcccttgctaattttgtacaggcaacatgctaaggatatttttaatattttcagatggctaaaaaaattgaaggataatatgtcattatccatggaaattcaatgaaattcagatttcactttacatagttgaagtttcattggaacacggttatacccattgtctgttgtctatggagcagactttgtatggcccatggagtgggatttgctatggcccttcgagaacaaatttgcaggcctggcatggtggctcatgcctgtaatcccagcactttgggagggtgaagtgggaggatcatttgagcccaggagttcgagaccggcctaggcatcatggagaaaccctgtctctacaaaaagtacaaaaattagcggggcatagtggtgcatgcttgtagtcccagctacttgggaggttgaggtggcaggatcacttgagcttgggagatggaggctgcagtgagccgtgattgcaccactgcactccagcctaggcaacagagtgagaccctgtctcaaacaaacaaacaaacaaaacacatttgcaaacctggttaaaatgataaggagttcgacaaagcttacttacgtctgttgactgctctgcccaactccgtgggcttttccaagggtctgagtaggtgcatcaagctgtccacctaattactcacaccatcctacacattatttgtcacttttttgcatgtaagcaccaatcccagttgcttaagcctgcagggggcatttccttcagtaggagatgcagagtgtaaaaactccaacccatttgcatcttgcttatttcaggtacatttcctttcctgtttataattccaaagtgtggcttcctatcatgccttttaaggaactatctattcccattgactaggagataaatctctgtatagtggaggaaccaaactgaggaagacttctcaaaattgttctttttatcatacacttttttggaacgaagtttatagccaactaagaggcagtcttctatttttaatctgtgatatttctgtaaagtcatgtaaatgtcataactgcagtgttttcaagttgttgttgtttttgcaaagagctgttctctgcagtgagggctgagtgtgacttgttaaaaatgaaattcacatagcatccgtttcctccgttagcttctttcacttaaaggacatcttcaacatatcatttaagggcaacacttggttcatagtgtttaatttgttgtcaggaatgtcagcctcagaacttcttaatatacacacccaactctactgtaggtgcctatataatttacatttaacctattattttattttattttattcatgagggtgatcttaggacctgagataaatttgaacaggatcaatacaaatcaggctatgtttaaaccaggaagcagaattaaattctatttttcttgtatttgggttttgcaggaaatggggcatcgtgttttctcttttgaaattgtgtttgaagtgatatttgcatgaagaagcagcctgttttctattagactggtaaagtgggaatagtagaaaagagaaaggcgggatttgggaaatgtgacatgaagacgttgttaaataaggtatgcgtataactaaatgtggcaagaacaatgctacttagatacggaagctgctaaagtattttaatgttctctttacaaaaaaaaatttaagaattttaacatctgctagagctcaatctagtctgaattttttttctcatctgacctttttcatttttcctttctcaaacacacttgctcatttaaaaaattcagttggagaaccaagtaatatgtttccatttaagaaagccacagataaatattgttccatttgaaactacagcttcactcacttgatacttgtatgactattttaagttccttttaaaaaaatggctcaaatttatccttttgggagggactggtgaaaacgtctgcaggttcatcttggtttttaaatttttatgtgtttaattgtggtaaaaacacataaaagtttcatcttgctttcatgtttgcttttaaggtctgagaatattaatagaacaaaaggaacacaacagcattccaatgaccagtgagtgtagctgttcccactgtgtggttatattgtttttttacaagcctacatatgtggctttacctatattttaatatgtgaattcatacagtgtaactataaagcattgtgctcacttagtggcacagagaggttaagttactgactgggggacatgcagccctcagcacgaaattctgggatttagccgagaacagcctcactccaggatcatgctgcttctcagagtttgctagcttgcattgttagagtgtaatttctggaaaacaaggccatactggaatccggaggagagaaagatggcttacactgggtatgagtacagtgtagttgagatgtgcaaacaagatgtaggtaagataaaagaaaatgcaaactaggccgagtgcggtggctcacgcctgtaatcccagcactttgggagactgaggcaggtggatcacgaggtcaggagttcaagaccagcctggccaaggtggtgaaacccccgtctctactaaaaatacaaaaaattagctgggcacggtggcaggcgcctgtaatcccagctactcgggaggccgaggcaggagaatcgcttgaacccggcgggggggcggaggttacagtgagccgagatcatgccactgcactccagcctgggcggttacccttttttggttgtttttattttttattttaagataggtcatgtggtgtaacgggaagctgatgggacttagggtcagacgacctgggatcattcctggattccaatctccctggcaatgtagtaaaaggtctccttgtctttgagatgtcgggacggtgatgcagtgaggggcagggtgttagggaagactaaactcatgtaacacgaagcatgacacgtgtcgcgtgtgtctctttgtaccacaatatccttggacatacatattcctgacctggtaagatgagattctgtatgttttttgagacctcagcatcccatgcccagacactaaagtcacaggggaccatcagagtcccctagtagtttggaaattctgatcaccagtcagcaaagatatttgactgttggaaattttttaaatggtgagctctctttttctgtttcaagattcggtcatcctttctaatagtagacacggaagtctttttgacaaaggtaatgctaggccctgcactggctgacactccatgcagtgtactgtccttccatagcctgtgccgttagtttacagaggtcagtagtacctgcccgccccacagggtttgtgtccaagtgcttcatcgtggtagaagtggtttttaatgaaacaatagatttcttggtcttgcttcaagtgaaatccctgaagtgtttgctttcccgatgatttcatgctgtaaactgcctatttgtggccatggcccatgagcataaagcagcatcattgctattcaggcacataaaagccagatagaagaaaacctcactatttagccatcgtgtcagagagagccaaactacatgtctttctgggccctggtttttaggggattgaatgtcacccagaccttgagtcttagttatcagtgtcgcatatcaagaaaggacactgaggaatcagaattcttacaagggtggcaacttttattttatgaattgaaaaatattcctattcagcggctgtagtcacacaaaactaggcctgatgtaaggttccacacttttaaaaagcattgtatatatttaactaggattctgtagtcatttatattaggaatattgttgctagttgttttgcaagtttccagtagctgtaatgcaactagggaagcatttacatattgaaggcaggagccaccaataatgtacggattttaacagtaattagggtatctgggaattgcacaggtttcattctcgaaaagttaactgaattgcacagatcaaaagtgaaattgattcactcatctaaacatgcactctgttgctttcttggtgagaggaatgacccacctacttggtcttcatggagctcggtctcctcatctataaataatatattaagtgttgatctaagaatctatgaatctgaattttacataatgagagagatgtacatgtgagtgaaaagcaaaaccctgtgataactcatttttgttccagctacaatattgtggactctgtggactaactatagccaagacttatctgagtcaggaaaaaagtatcatagaaaatccaaaaattaattgaaggcagttgtttgtaggtacagcccaagtgactgcataaatttcacaccaactaaaagtgttaaagagtaacaagatgaaggggttagaatgatttgtgatggatacattgtgcattggaaattgtttgtaagacttccccaataattgtgtttcagttgcccaattcctgtttattctcattgtgcagaagtaagttactactcccttcaatataaattagtgtaaattgtgaattgctttcgtctaaaacaatgagagcacccaacatgaagccaggacttggggttcaaatcctactacttgttacctgtgaagccagcctagattgttcacttacactcttcagaaagcagcctctttatctacaaaatgagaataaacagggctgatgtgatggttcagttatataatggacataatattaaatagactctttctttctgaatgggaaagtgaggagttactgtatttagaagatgcataaccagccttgctgttcaagaatgttaggaatgaaaacagttgatatgtggttctcatgactcaattaaaagatgctatgtttgtgtaaaaattaagaatacatttctgctgaacttgtggaagaagcttagagcagaggctgcctgtgcattaagactgagaggacttggaaagagaagatttttaatgttttccttttacattagggtttcctaactgtggcactgttgacatgtagggctggagaactatctgtgggaggtccttcctgtgcactgtaggaggttcagcagcatccctgggcgtcccccactggatgccagcagcaccctctccgtatggtgaccaccataagtgtctccagacattgtccaatgtcccctggggggcaaaatcacgcctgcttgagaaccactgaaaatttccccaatataaacatgcattacttctgtaattttaatagcaacttaaaaaaaaagatgtcatttccaaactgacaaggctagtctgtacagcttcacatattgaagactcagaagagttggactttttttttctttttcttttcttttttttttgagacggagtcttgctctgttgcccaggctggagtgcaatggcgtgatctcagctcactggcaacctctgcctcctggattcaaataattatcctgcctcagcctcccaagtagctgggattacaggtgtgtgccaccatgcccagctaatttttgtatttttagtagagacagggtttctccgtgttggccaggctggtctcaaactcctgacctcaggtgatcctcccaccttggcctcccaaagtgctgggattacaggcatgaggcactgcgcctggcagacttggatgtttttacgaggcgttttgggcttgtgttctgtaagcatcagcttaacagaaagtgatgttgcatgactgccccaaagactcctggtggcagctgtgaaagcatccagggaccaaaacctgtgctgaggttgccctcaggcacctgtgggcctgtcagtggggccattctaagtaaccaagacaaacctgctctacttgtggaatacggatcttcttcttctgcatgttagttgtctagggtcaccttgatgatattagtaggttatctgttctactttagtaatgtgttaggagtgcacagcttaatcaatctaatatgatactgctctaaggtagggctcagcaaactactgcacacaggccaactggcttgcagcctgcttttgtaggtagttttattggaacacatacacatctgtttgcataaacacacccatttgtttacagattgccagtggcttccaggtacacgtgactacgatggctgcaaagtccaagatccttgctatttggccctttagagaaaatgtgtacctaccactgctccatggttctggaactttctccccttctgttgccatatctaggtatatctcccatctgttaatctcagtttcagaaagggggaggatagtaaacagcatagccaaacaagacaaattatgatagagagcactgtgaatatttcaactttattcagtgcttttagtgagtatgcgtgtgtttctctgcatatcagatgcatgtaacgtgtaccagagtgtatttattaaaatgcctggctcatgtacttgttcatgaaagaagcaaaacaccatcgttttccttgatttaaaaaaacggtagcagcatttgtgctggagaactttgatagaacatggcagttgcgtgtaggatattggaccagacaggctgttggggccagagttttaagagggtttctctagaaacagaccgtactaggattacatgggaagtgagtgtggaatacttcgggatcgctgatcgccggttgtatgggagtgaggagcaggacggggctcagtggggagctttctggaatgccagtcccgctctttcctgcatgtctactacccccgtccaagcacttccttggctctagtatgtcctcatgagcagggcccatgacttcccggtgttatcttctggataatttaatacagggttcaggatatttgttaagtcccataaaggtgttttaagtgaacagctgaatggcaacctcagtttgatgatgctctgtctcctggaggggcctaatgtctggctgtctccagtctccttctaacagaccggcatcatcgtgtcgtgttaagttcgcttattaattctctaccaaaggcatctgcatttagtgtccaggaatcactcgatgtttcgtttctttttatgttttctttgcctccgaaatatcttccacagattccctaaggacgtgaggaatggaggaagttgtgaaggaggagaactgtaagctgaatagaatacagtcatccctcggtatctgtggggtattggttccaggacccctgtatataccaaaatccagggaggcgcaagtctctgatataaaatagtgtcctatttgcatataaactatgcacatcttcctgtaaactttaaatcgtagattacttggaatacctaatacattgtaaatactatgtaaataattgttatattgtttttaaaattgtttttattgtattgtttttattttttaaaaatattttttttctttctttttttgacacagggtcttgctaagctcactgcagccccttcctcccgggctcaggtgatcctcccacctcagcctcccaagtagctgggactacaggcgtgagctaccacgcccagctaatttttgtattttttgtagagactgggtttcacaatgttgtccagactggtctcgaactcctggcctcaatcagtcctctcgccttggcctcccaaagtgccgggattagaggcgtgagccaccacacctggccttaaaaatattttcaatccgtagatgcagaacttgtggatacagagggctggctgttcatattttcaaagactatatatcaacaacatataatcaatatataacatatatgagatatatggataatatatatatatatattcagtaacgatatacatgtattcaaagtagtaggtttgttatagacagcatagagaagactctggctttttaaatccagtttcacaatctcggcctcttatttattttgctttgatttttattttatttttgaactttttaggttcaggggtacatgtgcaggtttgttacacaggtaaactcgtgtcatggggggtttgttgtacagattattttgtcacccccagtattcagcctggtacccaatagttatcgtctctgttcctctccttcctcgcactcttcacccggcagtagcccacagtgtctgctgttcgtgtctcagccttttcgctggagtggttataccatttaccacttgctctttgttttctctttgtaccacttactctgtgtttcctttttcctcggttcctgtgtgcttttgcataaattgcggcttttttgtgactatacttcacagtaagcttattagcaataactcattgctttattttttagggtgttgctctagtgttgacaattttcatgtttaaccttatcacaatctatgtttgaaagatattttacttcacatataagagccttacaacaacaatgtgctttcattctccttccattcttagtgctttgtgctacatttgccgtatgttttacttttatacatgttacaaacaccataatacgttgttattaattttgtactaagaagtcaattatatggaaaaggattcttttaaagagaagaaaatatttttatgtttatatttactatttctgccacttatcatttctttgtgggaatccacattttccatccgaagtttttcttccccttcatggactcccttcagtctgtcttgtaatgcaggtctacaagaagtgaattctctctgcttttgtttctttggtaaagtctttattttgccatcattctttgaaagatatttcatctgagtgtagagttttgcattgatacatcctctcagttctttaaagatttcattgtcttctgccttgcatagcttttgacaagaaatttgcagtttttactatcatttttcccctggatataacttttgggttgttttctggctgcttttaagagtttgtcactgattttcaagaaattgattgtgtcttgttggggttttctatgctgtttatcctgcttggagtttgtttagggttttgaatctgttttactttccttaactgagagttttacaacttgatttgatcttggaatccttaaaatgcgtttttggtttttgtggtttttttgagacagtctggctctgtcacccaggctggagtgcagtggccgcgatcttagcttaccgcaacctccgcctcccgagttcaagcgattctcgtgcctcagcctcctgagtagctgggactgcgggcgcatgccacaacacccagctaacttttttgtatttttagtagagatgggatttcgctatgttcgccaggctggtctcggactcctggcctcaagtaatctctccacctcggcctcccaaagtgctgggattacaggtgtgagccactgcgcccagccaaaatgtgttttaagtaacatattttatcatctcagtactagtgttttattaatgaacactaaaaccagttagagaaacactgatgaaaaccagtgtttattatttttacatatttttataactccatattggctccttggaccttttagagttgggttacgagaaagcaattgggcatttgcctggtattatgtagagggtatgcaaacacggttagcttgtggaaaagatatcagtaacaattgcctgtgtaaccgccagctttatgggagtgctccagtagtaacatttttgcttgtttcagctataaaagctattaccacaatctgtctctctcattttgtacagtaatgatccatgaacatactaaagggaaattgatggcatacccagggttaccatttacagatggcagtactgaaatgttaatttcaaaaacattcaaactgtagttttcttctgtagacatgggacaagcaatttttatcatttaatcatgcagacttggttttaaaagaaaactcttttaagatgttctttgcttttaatttatagccttctagtttgcttataacatatatgcttatttttaaagaacattaaaggttaggcctaaggaatttgtgtgcaaaattggtcattgattattaagaaaataatatagaacctttttttatgtcataaatacaactttaaaaggaaggggactcttcagagttgcctctgaggagcacatatgaaaaagaagggcagaggtttactgcagtggtaaaaaataatccacctagatcaagactattccaaaagtgaatttaaaaagaaaaaaagatgagatggtaagatatgaggaaataatgaatgcattgtgactttccacctccccatacccattttcatagtttggtgagtagaaagagaaatgaggatgctggcccaattttgattcccagtggatgaggctcacacagaactgccctgcttcttgacactattatgatattaaaagtaacttgtatttttataagttattaccatcttggcacacttgcattcattttagtcaagtactgtcacctttagatttcaagcttgcagagtcttaaaaaaatacacattggagaacacatagtcttttaacagtaaaatctcagcttattagaatgtttagtgactgaggtattcagagtcagtcagaaaagtatctttaggatttcagcatgtggagatgtctttcatagagaaaccggggagagtcaggcaaaccctagcacgttgagcatggcgtatcctcatctgcacgggcacttagacacctggacaagtccattagcagtaaggcaggatagaggggttcacaggatacgtgctgcccaggatacgtacgtgcagcccagagctgggaggaaatcatgaggaccgactagacatttattgtacagatgcatgactggctggtatggcctgggatatgtcagtgaagatacaccgtgaggttgtgggaggtaggattcacagtaaatcctaaattcttcatctttgcactcacgacgcacaatagctgatcaaagcttttagcaaactgcagcaaatgaaaaggcggcagaacctcatggtgacaaatgcaaaccctggagtcggactgcaagcattcacaccccagctccaccagtccccagccctaggacctagacatggagctgcatgtcagtgtgtccgttccctctgtgtgagaacgggatagtaacagcgctccctcacacgctcctgtacacatggaaaccaccactgccgtcggacacagtgtatgctgtagaagcacttatggtactaagcacattaaatatttaaaattattaattagattatttaatccaagctcaaagctctcagaacagagccaggcatgtaacaggtacaatatacatgttagctattattattattatttaatagagatggggtcttgctatgttgcccagactggtcctgaactcctggcctcaagtgatcttcccacctcggcctcccaaagtgctgcaattacaggcatgagccactgcgcccagcctattattttttaataactttatgtaacccggtgttgccaattgttttgaagtgtggagccgtttttcagatgacacatactaaacatctactaaacagcctgagaaacggcactctgaagagcatgccttggcaaacactcccctacttactctaaaactccagtcgattggcttccaagttcacttggttctcatttttcctggcaacaactctgcaaattattacccccatttgatgaggtgctggctgagaaggccccttgcccaggtatgtttccgacctgcctgtgacaaagtgttagattctgaaagccgggagtgctggcctcggttagctgagtgataccagcgtggggtctttcgaggctgcaggcaagatgtccgcccacctaaaggcaggatgggggctggaggggccgtgtcccggcgcctccttcctgtggctgctgagttggtatggctgtaggcagggggcctcagtcagtgttgtaccgtgctggcctcgccacgagcacccgaaggaattttatcatacaaatttgattctgttttatcaagagatgccagtagcacctccacttccagttgggacaccccaaaatatctccagacattgcctaatatcccctgggagatggcggggggtgtggggagggggcggcagcgggcactgtctcccctgctccagaacactgtattgaaatacagaaacgtgatgccaatcccatgcttttatttgggattaaatgtgtaatccatatgcttctgagtgggaaaaaaaaaaacttggctccaagcagaaaatggtgcatcctttgttgtcattgggcaaatgcttggtagggatttgatctgtgtagaggaatgctcagtctgcagtggcagccaggtagtgagcatgtgcggccctgcacacagcatgagcttgtcagacagacagtgcttgccaagcagggctctggcatgcgcttgttgttggctatggctcttccatgggcaggctcccggctcctccttgtgcatccatcccctttgttggccaccctgcctgctggccttaggccttctgctcctttccccaggtcctggctctctccagcttggcctccctccgcccatcctgtgcacctttcattcctgggtaggaggagactcaggtaaagaaggataaaggcagaacgatgccaggcaattccactgctagccattgccccaaggacatgaatgttcatagcagcatggttgacccaagccaggttcctgtcagctgctgcctggaaaaacacaacgtggttcagccacgcagtagcatagtattcagccataaaaggagtgaagccctggaacgtgctacaacatggatgctctgggaaaacatgctcagtgaaagaagccagatgcaagaggtcacatattgtatgatctcatttagtgccccaaatagggaaattcatagagccagaaagcattctgtggtcaccaggcctgggggaggagggaatgggagtgactgcttagtgggcaccagaactcctttccaagtgattgaaaatggtttggaacttgacataggtggtggttgcataacatctgaacgtaccactaaattgtacactttaatttggccaggctcagtggctcacacctgtaatcccagcactttggaaggctgaggcaggagcatcacttgaagccaggagttcaagaccagcctgggcaacatatcaagacctccatctctatatttaaaaaaaataagaatttttttaaaagaaaaataataaaatggttaattttatgttgttacttttattccaactgaaaacaaagcaaaacaacaacaacaacaacaacaacaacaacaacaacaacaaccatgtatggtccaggggaatgtctatgttgggcctgaggtgtgctgttctggtttttcttaggtgaatgggttctgaaggctgcatcaaaagaggagtctttaaagttgctaattctttcctgataggaaaagaatataatttctcaaaatgactgctttcgaggaatgcccctttctgaatttgaaaacatagtattaaaaagaagagtctctcagtgctttagattattatttcttgtattcgatgtaaaaatcccttacagtggttttacaagtctgcagaggaattcacaaagcacgattgaaaagtgatgtacaggatttatagttgaatgggaacaaaccagctgatctgcatataggatgaaatttagctgagggtgctattgagtttggacaacatttggctggacctttgtaactcttcagctctatgaaacaatagttgtgtgaagaattaaaaggtggaaaatgaactgtaggtggctggctcacatatgcctaggtctatttccagacacagcgaacagtgaaatgacagtgtcggtgaggcaccagttcaaggaaatacacaaagactgcctactcataaatacagacacaatggggtgataactggtgcttgcacttggagatctagaattctaaaacatcggaaaacaatagcagaccattctgtgtccttttctttaaaactatctcttgaaattttcgtgcttcccccaagaacatcctcaaagatgccagtaaaaataactccacaggaatctttctgaattccaatatccatgtgaaaaggctgcattttattctgatttttcacaatagaattaaggcagacatgatgaagaaatgaatgtgtagaggacttccgaaatctgtattaacgtgtgtgatcagcaactgtaatgttttgattgattatatatggtacatctttcattcattaagctaactttaatcaagtatgtgttatgtgtcaagcctggactgtagaaatgaacttgaagaagaaaggactcttcctcctgttcgggtagaaaaggtataatgcgtgttatggatggtgtgaccgaaggaaacaccggataccatgaggaaaattgagatcatcacccagggattctgtattctacttagggaataggctaaacatcaaaatacagcaatttgagacaaaggcaggcggtagtcccagaagggtaggtgtcaaatccccaagagcatcggcggatccaggttcctgttgtgttactatcctgccttcctaagggtcagacaggctctcaagcaacccccatgaccacaagttgtgcacatcctttcccagctcctctcacctaccattggcaagaactcagtagtggaacacctggggtctcttaatgaggtgtgcttgtgtgactaaaagaaaaagaaattttgggggaggagcaggctggtggatgtgcagtttctaaattatcttgtattttatttgattacagtgtttgaattcagtgttttgaagagatgtatgtagcactgcaagctctattctaacctactttctttggagaagcaggtacatgctgtgttgtgtcagcttagagagccccttcaaaacctctccatgttcaatgtggagggactgtcactatacatgcatggcacaccacaccaagaacagagggctaccagaaaattagaatcccttttatatttgtcacatatcagcatttatttagctgtaaaaataaacagcatatggcatttgttaaaatcgtttgtatttcacacaaatatttggcaatatgtaaactttcttgccagggctgtttattgtggttctatttgcatactaataatggggaaatcagtaatgaccaggtgttggaaggtctgatttctcatttaaatgtattgtttctagcaataaactaattatttttgacatgtttcataaccagaagaatgttattaaccaaagtcataattcctatttttgtgttgatcacacacagatgataagttaattatacttattgaatttaacaacatatataagagataatctcaaatttcaagactctcatttgtgggttaccatctgttttggaccaaagaataggaatttgattgcaagctttcttctgaacagcttgtaataagagctgtttgtatattaattacttattgaattattgtggattttaatgttttaatttacaagcaatttggaacttattgtggtgacagctgctcatattttgatactttatggtatttagcaatttcatcataaggctattttttcccctggtaatttataacccaatcctgaaaacagtaatttggtctctccagctcactataaggagtattgtcctgtttcatccccactgcagatttttttcatagttaaaagtatattttataagcaaaatcaagattcctttgtgcctgcttccctggtgccctttcatttctattcagagttacagatgaatttagtttcactctcattattttacttcagtggtagattttttacaaattgccctggttattactttcatcttgaatatccttatggtttttgttttcaatgtactgtaatgcactttaggggcctgtgaacctgcttgtaggtttttttttaatctccttcctttaaacaacataactataaacatgactcagtgggaataatttgcttgaatttccttaaaacacttgagtttctatataaactccctaataagaaacaccttcactcatagcttcacttgtggacttcaattatattaaacctggtacctttttattatcactgaagactattaaataagaatttagagaaaatggtggacatttaatttccttagttcttgaattcgtagatgatagaggataattgatactctctaggaggcaggaatcattcacaaccaaagaaattttataaggtaaatatcattaggtaaatggtttactgattagtgtttatagtgactgagaaataaaaacaatttttgatataaaggattatcattttatgagccataaacctggcttcctcataaatcagtgcaaatggaacacttgtgaaacagaaatgtctgaagagtaaatgaaaagttgagacgttagtgggtgcctttggttttcttgattttagaggagccggaggagaaaggattctgacccgtttgtgtgtttttatgagcacagtacatgaggatgcatatatgcacacaaatgtgcctggtagagttattggaaagctagcccaagcgatggggaatgtttagctaaagcgtgttgtcttctcccgagggtgtgcacaggttcatgtatcagctgaataaggccctgttccaaaaactgatatttcaagggaaccttaatttatctttaaatttaatgtaatttaaaattaatttaaatctttaaattatctttaaataatagcagtagcaatagctgagctaacattaattttatctattttgagactcttttatttcagaacttctacatgcataatgcctgaccggccacttttaatttctcctttctttcactttgcaaacaaaaccttacaatctgtgctatggactaagacagaaattaagaaccaataaaatgtgttaagttttaattaggaagaagaaaaaacctaaaggaacgggatggttgagaggtaaacacaccccaatgatttttaagtcttttgtttcaaacctttccctttctccctaggctggtccctgcagacggcttcccatttttatgaccggatgctgggaagcctgctggtccacaggtccatacatgaagtcaccataaggtaagcagcccagcatgccattggatccttgcccttgtacctgaaatccgtttgaggagcagaactgcattttcccaaaatggaaccccttctgttttaaatgatgttgtcaggggaagtgcccggtctttctccttactgaaggttgaaggtagtagacagacaatcattaaatcattgcgagctgcatagtcaattccaaatgagaaatttgcctttttactgacttctgagaattttgggttgtgtttttgttttgttttgttttgtttttgtttgtttgttttgagacagagtctttgctctgtcacccaggctggagtgcagtggtgcaatctcggctcactgcaacccccgcctcccaggttcaagcgattctcctgcctcagcctctcaagtagctgggattacaggcacctgccaccacacctggctaatttttaaaatagtttcagtagagacagggtttcaccatgttgtccaggctggtctcgaactgagctcaagtgatccgcccaccttggcttcccaaagtgctgggattacaagtgtgagccattgcatctggcctgccttctgagaattttggatcctgaaggagctataacaaatttttctgggtcttaccaggcgaggatgacaccttctaaaatcaacctctcttgtcaacattatcaattacaattatgcagacaagttaattataattgggtgcatgagtatagattttatttggctcctatatcttaattctatgctttatcagtttcttaatatgatttgtgtctgtctccaaattgatttgctagttaactttgaaacttattagaaaatcatggagattactatgtgtaaatctggtgagatgctaaggtttcctgactagcacaccaaacaattgtatgtgcacaggtgtcaagagttgagaagcccgtagcccaaactaaaactgagacccatgccccaaaagttctgtaaaagttatcttactacctttcggtacgtgtgattttaatttcactttacttaattgttatttaattttctgtttctttctctaatgcctttttagttaaaaaaacaaacaaacaaacctgtagaacttgggcagttttaaagtgtaaagatagaattttgaggaagctttttgatttactattttaagagaaccaactagaactaaaatgatagacttaaatttaattaaaataagcagcttactgtttgaggtacttttgtttaaagccagacatatgcatatgtaggttgttttaacaagttaaatatgtataagtattttaatgaaaggtgtagtctgtttataaaaacaaaatttgtaatgtattagtgaatttgaattttctgactggctttttcactcagtataatgttttcaaggttcgtgtgcattgtggcatgtgtcatttctttttatgtcagaatattccattgtgtggctagaccatggatagaacatatttgattcatgcatcagttgatggaaattggagttgtatttcccttttggttattattaaaaatgatgtcatgaacacacatatacaagtttttttgtgtggacatatgtttcatttctctgtggcatttacttaggagtgggtcatatggtacctctgttgaacattttgaggaactgaatttttccaaagtggctgttacaccagtcaatatttttcgaaatgccattgaaccatattttaaatgtcagagggaagcagggaggggatctttctcttatcaatgttttgagtgggtattagttcagtactttgggaacataagcttcaatttcattgaatccagcacacattggatttctcctctgcgtgaggtatctgtgtttggctttatacctcagtcatttatacatgactgagtgtttttgtagcctttgataacttgtatggtttatacatgcagatagtcatttggcattatcctcaaaaatggtactctattgctgtagttcattagtaaggttgggaataacctacataacatactctttctgcctatgctgcgtgctgcgtctcagaaagtgagggcttctaacggtttccttgaggtgtgtgtggtttcaacacatgtcctcctttcaaaggcatccatcgcagaccctggtgatagtgttttttgtatctcagtcttaaaggggttggtatggttatgaggaatgttcacattcaggggcgttcactgttgaagttctcaggcaggaagattccaagccgagaagggactaggcagtccgttctcggatgtagaggtgggaaaatctgtggtagagcaggaaggactgagagcaggctcagcaagcatgttctgtgatgggcccgatagttaggggcttaggcttcgcgggccaggcggtctgtgcggcagctgctgtactctgccattgcagtgtgaaagcagtgtaggccctacagaaatgtatgaacatggctgagtgccaagaaaaccctatttatagacactgatactgggttgcagtttgctgaccctaacctagaggaacacaactgttttctttccaccttttctaattgtggccttttgagttggaggccacctggaggtgaggctccgagaggcccacccaagggccatgatgtgatgaagacagactctaaattgtgattacgtagcgaaggcactgcagatatttgggggtcaggacttttacgtaaggaatttgagggcctttctgccacataagagggagtggctctgggcctgtgtaactgccctaacttgggttctcaccctgggggagtctccacccccaagataacctgggaatgtgtggagacatgtctggttgtcaccactgggggagtgggtgctactggcatctagtgggtagaggcccgggatgctgtcaaatgtcccgcagttcacaggacatcctccccaacccctaaatgtcaaacgtgaggagattgaggagtcctgctcaccgctgcttctgtcagccctttattttgtacttgttgtcagtcatatggctgtggaattataggctatggggcattaaattacaaaatttagtacctgtgtttgctgacataagtgtaaggatggttggactctgatctaatatttgggttcatgatgcttttagttttttccttttttaaaaacgtctttgtcattcatttaaatataagcctccaaaattgatataggccaggcacggtggctcacactttgtactccctgcactttagaaggccaaagcaggaggatcacttgaggccggaagtttgagaccatcctgggcaacatagtgacacccccatctttacaaaaaaagtaaaaacataataattagccagaggtggtaacacatacctgtagtcccaactgctcaagaggttgaggcaggagaatcacttgggcctgggaggttgagccttcagcaggctatgattgcaccactgcactccagcctgggcaacacagtgagaccctgtcactaaaacaaaacaaaatgctgatataacactaagatttatatgagatccaggccacattgggggatggggcaccgcctgcctttcgaactgtagggtacgcttcagagtttatttttcacaacttcacaggccacatcatatgtgtaggtgaacccactgctgactccatctactgccagaaagagactcatcatggtcaaattaaattcttcatatgtcagtgaaaaatcagtgtcttagagatatcatgaccagagtgcatgtattcctgaaatttgtttgaaggcccggtgcacattgtgtagaaactgtgttcagtctatctaaaagataattaaaatccataaattaatttctggctggaaaataggtcataatggatctggatatcagaagtgctaggttaaagaccacggtcatcaggaaaataggatgagctcctgctccgtggaagcagtagcatcagtgccttccaaggcagtctgctctgaaatcttgggcacgtgcatctgtgttgaactgtggccagaggaggagaggatgaaagggaggcagtgctctttttcttacatgcattgtccggctcatgtgatgtgggtttccctggtagtggcttgctcttgctaggtggagcattttcaagagggcttccttcctgtcaccatagcatctgccgttgacgtgcatgtgggctttggatgaaagccccagccagccactaattaacccagaagggtggcagggcacagaaaggaccttttctgaatgcctcatcatggggattttttcttttcttttctttttttttttttttagatggaggctcgctctgtcatcctggctgcagtgcagtggcacaatcttgggtcgctgcaacctccatttcccaggttcaagtgattctcctgcttcagcctcctgagtagctgggattacaggcgtgcgccacaacgcccagttaatttttttgtatttttagtagacatggggttttgctatgttggccagtctggtctcaaactcctggcctcaagtaatcagcccgcctcagcctcccaaagtgctgggattaacaggcgtgagccaccatgtcccgtcagggatgattttattctgtgaaaagcggcattccttttctaacacaaaacctctcctctgctctgccctcccaaccctgtagcctcatttcctatatagttgttttcatactgattatctctgaagacattgccaggtcgtttttgtttgttttgagacaaggtcttgctctgttacccaggctggagtacagtggcacgatgtcggctcactgcagcctccacctcccagggtcaagcgattgtcgtgcctcagactcccaaatagctgggaatacaggggcatgcctccacacctagctaatttttgtattttttgtagagatgggtttcactgtgttgcccaggctggtctcaaactcctggactcaagtgagcgaccacgcccagccgacattcccaggttttctttacgttttaataaatatgagtagtccatgttcagagtagaaactatacaacgtgtagaaagatacacatgcaattgggagccgtgcttttcccacacagtcccctgtcatggacattgcccctgcctgaaatgctgttttcctggccgcatcttatgccactagtttattccatatttaaatggaggcgtcactgctcggcattggaactctagtaacgaagaaataattctttgattatatttaccatttcagaccattgactccaagtaaataaatataaccgtaaaactaatgggaaattttttactttgcggggaatattttcgtactgaaagtattgtatatctgattgtgggtaaatggagagaagtgtatgaaagaaagcaagcaacataaaatatttttatgcatttctccccaaacttttcctctgtatgtgttttcctacaggtttgggtcaaactgtaaccttgttggccctcttttctgttttgttgtcgccccctgccacccaatttgggacatatcataaatatctttccattaacctagctttgaaatttttaacttgcactggaagaccacagcgtttaatgtcaaacaacgtaactttaaatcctagcttcgctgggatttaagttggttatcttccctaagcctttatttgttaaacctataaaatggtaataagagtaatggtcatatttatctcttggagttatgactggtgagatcgatcgtatcgtgcacatagcactcacacctgatagctagcatacaatccatgccgtgtattggtttctaaaatcatcttcatggcggcctgatagttcccatatgtgttcactgcaatttatttcatcgtgctgtcactggacaatgagattgtttcgagaaccacacattgtcttctttacaattacataggatgaaaagatgtgcaaagtggtaaaacaagcctgtgtcagcccccaaataagctgctccccaggcagatgttagaaaaggtgtattgggatttatatgtaaactttatacatacatttaaaattctgtcttaagctggttactgattgtgaaatgaaaataaactcagtttacatctgagcagagaaaagagccgctgcctccaaatgggcagagtttgctcgtttccatgaagcaacttggagaaagaggtgccctttagaggctgaggtcagttcaagcagatcttccagtgaccctggctcggtccagtctgcatggagacaagccccaaagacctgagccttgtccaggccatccctccaagcaatggattcttccagcacagacgccaacagcctgactaatagcagcctaactaatgacactcactttctcaggtgccttcagaaaccaagggctgctttagaagatctttaagatgtttacataacagggcaaatggctgaaagataaagcttcccctccagtgatgtcagaggagctctgtgcgctgcccttcctacaatacacgcccccttcatcagctcgtgcttccttcgctgtttcagaacacggctggcctcttggcaagaaacgaacttgccctttctgtccttaactaccagcaccagctctccagcaggccccatgtgattctactttttaagataattaaaacagcaattaagattttgtttggggccagtgttctcccacagaatgatggcatattgagtgctctaactacatactcaatgaaatgaaactcttaaacagccatttctcctgggaccgaatgctgaactgttttgtgaagggaactgcgaattaataggacttttggccaccttgaaaccaaggcttaaaaaaaaatactataaataatctccccttcagcttcttgacggctctaaaccccaaattatcacttatattgaattacttatctttagcagagaaacttcaaaaatgccatcagcccatgctcgtttgttcttctttgccttctttaagcagcacagtgagagaatgttgtggctttaacccaaagtggaaggtggttatttcgtttttgcgcaatcacaactccaaacacctcaaatcaacctaattgaaggtgtctttaatcaaagctgggtcaggcaagaaaataaacacagttgctctaattaagactcccctctcatccccctcctgtttggggccaaggaggagctgtgagtgctgccaaaactctcctttattttagaactggagaaattggaaaacatccacaggagttctcagaactcgaaggctggaagcggatgctgttcgggaaaccggttaggtgttagaatgcggcttgtgtctccagctgtacatactagaaaagaatgcccaaacacaggcctctggtggtagttctttttggttgggctttatgtgtgccaccttgcctgcttgacattgctgatgagccaggacgaggagtcgagccctgagtggtcatgggcgaggcaggtgtgtgtttccctgatcctctcctactgacctttcaggtctctcttggggaattgctggaggagctaaaataccagctcccacatactggatattttctgtgcatcgggctctgcataaaagcattgactcctcacactctcccctttacataggggctatttgatactcagtttagagataaggaaacagccatataactgaccctccaatcccagggctagatagtggtgcagctgcccctagaagtcagggtctctggcgcttggccaaaggctccctgaatcccacatctttacctgttctctgtggctctcaggacgtgagctaccttatctctagccaataagcctatacggatggggactctcaccctgatttaccctaactttattgtaataaagtcataactgtcataagaagtaatagttgcaataaaaagtagtaattgtaataaagcatgaacattccaaactccatgttatttgtccacaaaaatagttcttggcacagaagacaaaggcggactttttcccacagaatacatagctgtcgatggcactttgctttgaaccttggtgtagagggcagtcctcatgccctgggctgaggggtgcatgtgacacatcattaaaagtcaaaaatcattttcatagagcaggtcctccccacatgtacacccagagctcctgtgcttctctcctctttctctgacttcttccaaaatcgtgggtcttgtctccatcagtcaagaatttaacttttcttccaaaacatccccctcctcttctgtgaaggaaggtgcttgtggactggccttaggaaatgtcgcccagacaggaacggcacaccagtgtgccatcactcaagccagaaatgaggtttgcagtgaccttctctgtgcttgagagttctgctacactacgaataccactataataacagcacatttatttgtgggaaattaaacagcaaagccctgggtgggagatccataatttaccatcttcctgtgaaatttagttctggtcttagaaaaaagaggaggaggaggaatttttattcccagccttgtgtgtggtgaggtttgtctggaacagtggttcttgcagaggaatactggccaggagactcacttgagtcaaaaaactgaagaagatccatgaaaacaaccaccaccttcaagtgagccacttagagataagcgcagctaaacgccgggacacccagctgatggatggtttctcttgattttggtgtgatgaagcccacagagctgaagggcattaaatacagctgttagggttaggagtccattcagagaatattctcatgcttgtatctaataatctaagaatatatatgtagattctacaatttttggaattaggttttaaaagaaaaataatcatttaaaagctagcaaagtaagtgtttgttgggggagaaaagtttgatccaaatattaaatcagtcttaaaaaattaaaatatgtacttgagatggagcagtcagtcttaccaaacattacatcctggctcgattgcaggccatggatagtttttgttttgttttctcttctgcttagaaatcaaaaccctttagaaagttaacaatgtattggggaaagcattccaatccttggaccctaacttatacatttaaaaacaatgaatctgtgatcagaaagcagaaagccagagctgaagcagaagtttttctagttggaagaaagaaagatgtataatgcaaattagaggaacagataattaaaaatggcccgtaatccccatctcctcaggatcttatattctcattctccatagttctatataaacacatgcagagacacctgtatttatcacagatgctcctggggtggggaatattaaccaggctgtgtatacaggtgtttcatctccacgaatcagagtatctgctcttattttgaggcaagatctcactctgtcacccaagatctcactccactcactggagtgcagtggcataatcatggctcactgcagcctcagcctcctgggctcaagcaaacctcttgccttagcctcctgagtagctaagaccacaggcatgtgctaccatactttgctaatttttaaaatttttttgtagagagggcatctccctatgttgccaaggctggcctctaactcctaagctgaagcaatcctcccatctcagcctcttagagtgctgggattacaggcatgagccattgcgcccagctggtaccttttcagtggtcaggtcaccaagcagcgtctgagcctgcaccagttgccttactttataaatggagttcatttcaaacacaaaatgcttattttccctctaaagagcaatggttctcggccagctgcagttttgcaatgtgggacatttggcaatgtgtgcaggcatttttggttgtcaccactgcaaggaggttgggggagtccaaggatgctgcagaacatcgtgctgtgcctggaacaggcttgcttttttttttcccccagagtaaaagaggaaaggagctaggcatggcaaacaagaagggcagctgggaagctggggtgtttgccaggtcctgccagacatagtttcctctctgtgcctcagtttcctcatctgtaacatgcagagatgagatgccctccaagattggtcctttccagctgccctcactgggagggggcaccgtgccctgcctcccaggctgactcgtcctttgtaattctcttcctttccacgggactccagattcatgccggtcccactagccctgttgccctgttcctaagcctgtccagaaatccttgggactaagtgaggctgaagctatagcgctctgctcttcctacctttttaagaggtcttacattgtaaaacttcaatttttcaaacactcactggctcacagaagaaaataaaataaaaagctgcaattgtgaaaatgtaattgctcaactttagctcatgctccagatcagtgattttctcttttagccaaacttctttataattatttcctttatttttataatagattcttcaaaattaatttcaaaattccttatctaccgtctttcacaaatgtatgtatagcctagagaattttggtaataattttgtgatacatttatattgggatttgtagctgccagcctttttttttttttttttttttttttttttttttttgagaaagggtctcacttccgttgcccaggctggagtgcagtggtgatcgcggctcactgcagcctcgacttcccaggctcagatgattctcccacctcagtctcctgagtagctgggactacaggcgtgcaccaccacactcagctagttttttcgtttgtttgttttgttttgtttttgtagagacagagttttgctgtgttgcccaggcaggtctcaaactcctgggctcaagcgatccgcctgcctcggcctcccaaattgctgggatgataggtgtgtgccactgtgcccggcccaagccattttttcagtccattctttttgctcctcctagtaacccttcgtagcaaccagccttccattgttcagtcaccagaagttaatgatagaaaaccagagatttctagctgtgcaagatgtagagagaaacctaaactctatacatttgctattggcactgtgttgccatagtcactgcagcactcagcatcaccaaaagcctgcccagtgctgcaacattctttagatagatttttgttgttttattttgtctccttaaataatatttaatttttcattaggtcatgctatgatttcatagcttattttgtctctaatattttcttctgcatgctgtcttttgagagacctctccagagttcaagcacaaatcctaggacagacttgtattttgactgtcaaattttcattgcagtatgtgcaaaagtacagaaatgtcatcaaattaagcaaagaagataagaatttttgaatggcagtgttctggcaactataaaataaagtctattaagagtgcaaagtgagaggtggaatgtcgccagggcagctgcattcattatctcttgctggataacagacgaccacacgtttagcagcttgaaacaacacacattcattctctcaccgtggctgcgggtcacgggtccaggcacagcacagctggggccagtgctcagcgtcccacaaggcttggtccgggtgtcagccaggctgcgctctcctttaagctcaggggttttcttccaagcacaggttgttggtagaattcagttcctgtggctgcaggactgagaccctcagctccctgcaggctgcctgccattgcctggacagatcatgcaatgtggtgttaataatcacaggagagaaatgtggtcaaccttgccatgtaatgtaacctaacctagggagtggtgccccatctccttgacgcattctggaagcaagtgacagatcttgcccatactcaagggtcgggagtataccagggcaggactttgtgggggtaaggtatgtccctggcagtaaccattactttgaatcctcccattaaatgtaaaatatcttccaacttgaacatatactttgtacttttctccccctaaacaaacaaaaactcaatcctcattcaacaatgaaagttttgctgcctgtaaagatacttgcaaatgtgtgatatagacaccaaagacagttcccaaacagcctaaagatgtttagtgctggccgggcgtggcggctcacgcctgaaatcccaccactttggaagtctgaggcaggtggatcgcttgagttcagaagctgaacaccagcctgggtaaaaccttgtctctacaaaaagaaccaaaaaattagctgggcgtgctgatgcccacctttggtcacagctacccgggaggctgaggtgagaggattgcttgagcccgggaggtggaggttgcagtaagcccagatcatgccactgctctccagcctgggcaacactgcaagactctgtctcaaaaaaaaaaaaaaaagaaagaaagaaaaaaagaggccaggtgtggtggctcacgcccgtaatcccagcactttgggaggctgaggcgggtgggtcacgaggtcaggagatcgagaccatcctggccaacatggtgaaaccccgtctctacaaaaaatacaaaaattagccgggcgtattggcgggcgcctgtagtcccagctactcgggaggctgaggcaggagaatcccttgaacccaggaggcggaggatgcagtgagctgagatcgcaccactgcactccggcctggcaacagagcgagactccgtctcaaaagaaaaaagatgtttagtgttggtgacatcattgacgttagttgcagcctttctggggctgcccagctgtttggagtgagcagctcttactgatgtatgaattctggtttgttcatggacaacagagttctttccttgcttgttccctttgggctggtttgctcttgtgtctaaccgggtggtgtctaagaaaaccagactctgtcttggctgtctcacacagaagcccctgaacgttttcctgcccatcctccctccccagatttctgcctgccttctgggcaccagaagtcttagccagacggatgcagcggattctgtggtgaaacacaaatgacagaggtgctccctgccttctgtgttctggttttccaccaggagccctggcctccttgcagaaacatcgaggtgacatgtagcatgaccgagctcgctggcgcctcttcatcgtgctgccaccgccctgcaggaagaggggccatgcagtcagtcttgcaccactttcaacgtttgcgagggagaggtactgcggttcctcatgtggccaggaccgtgtggtcactctttgggggtgttgacatggccgcgggtgtactcggtcacctctccatgtgtccagaaaagtgctcagtgttgaatccctccacgtctgcctgagtgcactttgggattccattcctgccgcttatggggcgcgctgcggatccctgcatgcacagagctttattgaacgcaaagtcagttgtttgttgtcgtgctctgttgcccctgcttctggcttcattcatgtggtttttgctcaattcttccccggccttaggaaataggccaactcttgtttttttggaaaacatttcacctgggcatatttttctatctataattacggaatttttatgtaatcacataattataaaatataacacaatcagatattaattaccttcatgtgtataatagcatggatattattttctttagtcatctcaaaaaaaaaaaagagaaaaatacaagcagtgtttcaaaactctcttctctttttgaacagagggtggttcccacttcatcaacacctcatcgccgcgaggtgaggctaagatgagcataaccagtgacgaggtgaactttctggtgtatcggtatctccaggagtcaggtaagaggcttggttttctgtcggtaggaaattcatctacagcatcttacaagcagaaggatcaacgcttaattcaaaaccaggctgtagaagaagaagaagaagagctaagaaggttcttagtgctgatggggagaagagaaggttctggagctgtgccatccccgggtggaaagagggaatgtgttctttcttcccttgacacttctgtgcagatgaatcaggcaggaatcaagagcggttgtggtgaatgtggaaaggacggaagcagtgcggggctcttggcctccacctcggcgagggcatgcatgagctggtgtgtgtgtttgaacctcttcgattttgctccagagatttattcagctccccagcctcccctactccccgccccctaaatgggctgctaggcaattttctaaaacttaggaatcgtcgtagcatcttccaacatttttgattaccactgagacattactttatggttagtaagtaaacagccaatcacatgtgttcgttgttgacaagacagactttgagctgagcagctgccctcctccgccagcagggaagtagtgggaagaagccacggagcccagggcttgggttctaacttagaagatatgtaatttaagacctacaaaatgatattggtgaaaaacgtcctgatacccacctacctgttcaacttaaacaaacctctcaggtgcattggaaaccccgcccatgtttgcctccccgccttcctcgatgatgatgaccctggtggacttgctgtttgttatctccacgtgtttattacacacagccgttttcctaagcgacatacggtgcaggtggattcgtttcctagggctgctataatgacgtaccgcaaactggggtggcttaaaaagaaatatgttgtctcctagttcctgaggacagaagtccaagatgaaggtgtaggcgggtcggttccttctgaggggaagtctctcctgtgcccctgcctggctcctggggccttgctgcagtctttgaactccttggctcgtaggcacatcaccctcatctctgtgttcagatttgtccacatttccccacggtaaagacagattggattcggaatttaccctcctccaagacaatctcattttaactattgtttttgaatacagcaataattacatctgcagtgaccctgtttctaaatagtgtcacattctgaggtgcgctgttggtgaacactgcaacctgtgaatttgtggaggagggggcacacttcaactcataacagtcggtttgggattttaagttgggttttaagcttcgtgcccttgatatcagattgtatatattctggaacttgattatttgaaaaggaaaccccagttcctaggccccgtcctcccagagatgcatgtattcgattggagggaaaaccagtctacgatcctctaggcttgagttctctcacagctggcctggtagggtagactgtacgcattggagccacacagaatggctcgagctctgatcctcgaacaagtctgagtgaggcctgttcatttgagcctgggtttccttgcccaggcaaatgtgctcaaatacgtcaggcacgtagcacattgtaagtgcgtgccttccccatccaagcctgggtctctgtcccttgcgctcccagctagtgttattcatggaaagtacacattcttttctgcatatatattagatgcctgtgattggctgttgccagaacatagtataggaagttggtatacaaaacaaaatatgtactgcctcactctggaaatcagggaaatgataaccgctctgctaatacctcaacctcggctcttagaggagcacaggtgatctcctgcctcagagcccatagctttccagaggtgcctgcaaatggaaatccatgtaccaaaccctgcttccctgtcgacttgtggcatggaatttgagattctttccatttagcaacacctctgcacaaggacacgatgaaggccaaagagactcacagctcttgtgtaaacaagtcccaggctggaactgtccggtgtgaaggaccacgtgctccggtaacctggagacagagccatgctgctggctggtccccagggggccacggagcatgagctttgctggcttcttgaaataaacacagaaacccccatccctccccagaaaggtcggcttccttattcagtgtttgtttatgaagcttctgtaaccaggcagctgagagggagagttggagcacaacaatgcatagaccttggcaaatgtcaactttgtgtaacatctgtgagctccattcctgattcatcagtgtcactgaagtataataacacttcttaggcagagttgatattgaagagagagactattacaccttcttcagctcactgtgtgtattgtggaactttttagagcaccctacaaggttgtattcaaaggaagaagggagcaaagaaatacttaatgttgaaatgttcattctggggttattttctatgttcgtctcaagtcctaaagttttggttaggtcaatagtcattgagcccccatcaagaaagcacaccttctcagcctatcgctgtctcccttctaccttaaataaaaaggaaaacatttccctgatcatgcttcctcctcaagcacctgtactcttactcctgcaccccaccaaactcattaaaaacaggttctgcatctcagaagatgattcattcctcagctccctccactctggctttctccactagaagttgtcagtaaattctgggttcccagatccactgatcttactgcaactggcattcctccttccctggtcatccctccttacctgtgtgtggcaggaagcgggtgggggtgggcagtgaggcagggagtaggtgtttccctgcagtgcggcaggacagctgcttccctggaaggtctgctggaacactcaaccccaccttccaggtacagtgacggacaagttttccagagtcaccaagcatgtggcctgagccctgcttctctgccctggacccagcagaccaggttgccgctcctgtccatccattcatctccttcaccagtgcctctcttcctcccctctgccagtatccatggtgtcagttaggatgtattaggctgcaaggaggaatcttcagtggagcactgatggcctcagacagccgggaagcagggtgttgaagaaggatccaagacacatctcttcaaactcggaaaagaacctcaaaaacagatgtgttttgttctctgcccacaacaggcagaagtcaggtcatctggcttttagcaaaccacatatatttccctacctgtgtggattagtggattttcattgttgcccttgttacttgtccaaagcaagggctttgcccatcagaagcactcaatagctgttacccacaggcgacatctcatagcagcagactcatggcagtctgaaagaggaaactggttaaagcaagaatgttaagtagtagggaacttttgcattaccaagctctagtgccaaaatggatttgttggtttttgcatgagttcagcagtctggctttgacgagtgatatggtttggccatatctcatcttgaattgtagctcccgtaattcccacatgtcatggggagggacccagtgggaagtaaatgaatcatgggagcaggttttcccgtgctgttctcgtgaaaagtgaataggtctcacgagacctgatggttgtataaaggggagttcccttgcacaccttctctttcctgcagccatgtaagatgtgactttgttcctcattcaccttctgccatgattgtgaggcctccccagccatgtggaactgtgagtccattaaacctctttcctttgtaaattacccagtctcaggtatgtctgtattagcagcatgataatggactaatacagtgtgtgagtccattggcctctgtcttacgggatccattgcctggtcacttgtgctatctgggcagtttttaagaatcacatggtggccatgtgcctttcccgtgagctcgtgttaccatcccaggaggagagaagcaagggagcgagcccctagaaatgtgcacagcctgcacctgctgtagtgagcagctcccccaaatgctgggggagtcgtgagttgtgtgcccccgcatatttctgaatacagccagggaagtggaagtccattttccacttagtatggaaagagagaaaatttggcaagtgagtccctgtaaacatattatttcctctgggacttcatcccaaaatccaaactataaagaaaacatgttctcccagacccacatttttggcataaattaaataattcacaggaacttgcaaaacggtatgaggaatacagggggacagaaccacagattcaaactgaatttaactgagaaagagctgcctgcaagataatcgggtgatacattcaggggaaagggaggtactatgaaaaattttgttttttgagactcactcatgctgagggtctcactctgttgcccaggctggagtgcagtggcacgatcacggctcactgcagcctctacctcccaagctcaattgatcgtcccacctcagtcgcccaagcagctgggactataggcttgtgccacaagaaattatgcccagctaatttcttattttctgttttattttatttgtagagacagggtctcactgtgttgcccaatctggtctcaaactcctgggttcaagagatcctcccccccggcctcataaagtgctggcattacaggcatgagccactgcgttacctggccaaaaatattttttaaagaagtagaagatactgtctgaagaggaaagaaggaaggaatgcgcggagctggcttgagcatagtcaacacacaggacagttctgtcaccctcaaaattgccttgtatccctttgtactcagctcctcttccacccccaccctgccccggcaaccaccactgctctgtccctagagttttgcccttgcaagaatggcatagagatggcatcacatattgtgtggtcctgagagtgtgacgtctttcactcaaccttatgcatttgagattcatgcatgctgttgtgtgcaccagccattcattcttgaatagctaagtggtgttccattttgaatgctgtttctgcgatttgtttatgcatcctcttgtggagggacatttgcgttctttccaggttttggtgattccaacataaagctacaaaaaagattttcatacaggtcatttgtatgaacgcaggttttcatttctcttgggtaaatatcttggagtggggttgctgggtcgtgtgacaagtgtaggtttcactttaccagaaaccagtgcattcttttccatctaaggcagaggcaggacacgtcgtaaacatgactggttttatagacgtgagttgagtcacagaactcctctgcctgtcgcacaaggcatactggaaagtatgtaaagggacgttagctctggcgtatatatctgcaggacgctcatgaagtgtgattcttcctttgaggatttgcagctagccttctggactaatttcatgaacctgtcagggtcacagtttccatgggccgacatgaatgtagcccaggtcggctgaatgacagagcgtccttgtttgcataccttcccctccttaagcagtgccgttggtctaaccttctgcttaaaaatagaaaactctatacagcctcatcagccctccggtggataagcccaggcatctgggcaaggcaaaggccaggcttccagatagcaggattccgcaggctgggccctgtggcggccacgaaagctctctgtgcatttgcccacatacccatggtatcaaagtcatcgaaaacccagcgaagtatttccctacctggagctttgtgactgacgtccacacaccaccaggaacaggcagacaagttaataaaaaccatgtgatgatggtggtggcgacagtactgaagaaaaagaaacacaagtagaaatggaatttcactaacgttgtgtccggcacagggatgttaccaagttccgtgtccatgacggcagtaattttaaacactgtagctactaaaaggagcttgtcaccataataaatggtaaaaatccacttctcacacacgctgaattcccagagtgaggaacttctggcttagctctaaagatttaaagaccctagaggatggttgaaatctccttattcagtggaacttatgttctgatttgccctgattcgtagctgagaggccaatttattatacatttttcttgcctccattaacgtcaccaaacatgggttattcagagtgagagtatcactagttatcaaaagtgagcatctacactctgggcactcttgttttcctaaagagcccatttctgcacacctgactagctgggtagaagtaggcatgcttcttttatttacataacgtatatatggctctgtgttatatgtcatccttgctcataaggaggatagttgctatggtcccaatgtttctgttcccccgaattcctatgttgaaatcctaacccccaaggggatggtatttgggggtggggcctttaggaggtgatgaagtcatgaggagagctcctttgccccttctaccatgtgggaacacggtgagaaggcaccatctatgaatcgggaagcgggttctcaccagacacccaatctgccacatgttgatcgtggactcccagcctccagaactgtgaaacacacatgttgtttataagccacctactctatgtattttggtagagcagcccgaacagagtaagataatagtgaagtagtacatccacatgcccagactttcagggttgtgaatataacttagtgacatttgtcattcatttcgtgaagcttccatgccaagaaaatcattaataagaaagatttctacccagtgtggaggcccacgcctataatcccagcactttgggaggttgaggtgggtggattgctttgagcccaggagttcaagaccaacctgggcaataaatacaaaaattagccgggtgtggtggttcatgcctgtagtcccaactactcaggaggctgaggcgggaggactgcctgagcctgggaggtcaaggctgcagtgagccataattgtgctattgcactccagagtgggtgacagagtgagaccctgtctgaaaaaaaaagaaagagtcttgctgggtgacacacttcacctgcagtgcttctctctggtggcgatgccattcaggtgagttagcctcagaggagtgcatggaagagtgagtgagacctcagcggcctcctctttccacaacaaacccaagcacagagataaaaggctgtgctgagcgcccaccaacacgcagcgaggttatactgtccaaaaagagtacctggcagatgacccagcaagttcacagcgggtaagctggcgtgggtctcggttagagtgaggtggagcggaggggaaggttccctgttcttcaacactttctacagaaacataagactgagggtgaagtgagatcccctctgaaaaagcaccaggtgtcttgtgggggcctgatgctgagggatgggttgtagctcatgccctgtagaagagaacactgttcaaagccaaccagtctggattcaagaggggtcctgggagcttcagtctgtccgtgaaagaagcacttccctgaggcttccctgtgttccaatgcccttcatatcctaggcctctgaacagggtgctgtcagtcgagtgggattcatcatcctcaagtttttgccggagtggaggccaggctgtgtgctgggctgatctcctcctgttgcatctgtgagctgctgttgtgaggacagtggcttgagagagctgaacagaaagacatgccccctccttccaagactgacctcacactttaggggagcagtacagtgtcctttagaacacctcagcggaagcaacccagatgtccattgacagaggaaattccatcaacagaacgtgtccatccatacagtggaatatcatgactcagctttgaaaaggaaggaaattctgacacaggctccagcacggatgacacttgaagacactatgccaagtgaaattagccagccacaaaaggcaaatactgtaggattccacttagaagggatacctcgaggagtctaatccaaaaagacaggcagtggaagggtggttgctgggggatggggagaagcaggggacgtggagttgctatttaatgggtacagtttccattttgcaaaatgaataacgttctggggatggttgatggtgatggttgcacagtagtgtgaatgcacctaatgccactgaactgtgcacttaaaaatggttaagatggaggccaaggtgggaggatcactggaggccaggagtttaagacaagcttggacaacgtagcaagaccctgtctcaataacaaaaaaaattttcaaaaattagccaggcatgggctcacacctgcagtcccagctattcagaaggctgaggtggggggatcacttgaggctgggaggtgaaggctgcagtgagttatgatcacaccattgcattccagcctggacaaaagagtgagaccctgtctcttaaaaattttttttaaaaatggttagcatgatatattttatgttatatatattttaccacgattttagggggaggtcatggtattataggtgagaagttccatgtgtagattgtttttcagagtttagaaaattagtctcaaagggaagagagaaccacctgtattcacagtaatattaatattactaatattacatgataagggctttttcatagtcccatataagtgtttggggcaaatccctggcacagctagtatcatttgtaagctacattggtgtctgacaaaatccagttatttaaaaaacagaaaacagtggcttatttataatagcaatattctggacatatggccagtgtccatcagtgggcgtagttgaagcaagctgtggcatgcctgtgccgtggagcaccactcagctgtgaaaaggaaggagttgtgggtaggcacagcaagctggaggaacccccagagaaatgtgccgagtagaacaggccacgtcagaagattgcagactgggccaggtgcggtggctcatgcctgtaatcccggcactttaggaagcctaggtgggcagatcacttgagatcaggagtttgagaccagcctggccaatatggtgaaaccccatctctactaaaaatacaaaaaaattagccaggcgtggtggcacatgccagtagtcccagctactctggaggctgaggcaggagaaacgctggaacccaggaggtggaggttgctgtgagccgaaattgcacagctgcactccagcctgggcgacagagcgagattctgtctcaaaaaaaaaaaaaaaaaaaaggaagaagattgcagactatatgattccatttataggacctgcttaaagtgctgaaaatatacaggtggacaccagatcagtggctgctacagatctggagtagggatgggagcacgtgcgtacaaaggaaggttataggagagttcttttgtgttgaatgaagagtttggtaccttgaccagagacacagttccacagatctacacgtaggatcaaactgcatagattatacgtacacaaccagtgaatgcagtgcagaaaggatgacgatagtttgtgttccagtgagcatttccgtcctgcctcctacttagtggtgttgatcctctttgacagtagtgtaagatgcctagatgggaggagacaggatgaaaggtgcacagcacttcactagttttgcagtttcccctgagtccatagtaattgcagaattatttaattgtaaaaaagactataccaaaaatgtaattcaatgtttctattgtctgcaaagctttgtgtgtgtgatagatggtggtccataatgcaaaggcagccaagacatttttattatatttcgcaggtcattagccatattgcaggcctagggctgggtgggggtactctcttgtgtaatggattcgagtggcagccctattaactgagaaatggatggccacacagacactgtggggccgttggaaacagaagaatcagctggaagcaaacagcatttgtcatacggacattgcttgaatgtttgcagactggggactgtcgtttctgggtgggctgcatttttactgggggaaaaagtcggtgcatggcttcttccctgctcatttaccagtgagtcttagaatgcttttacaatatccacttagaaccttcagtgtggaggattctgttagatttatgtgttcagcctgagagaagtgggcagatttgagggtcttaacttctgaagatgttgtgaatggccacaacatataatgcattaactcaacattttcagcccattcattgagatcagggtttcttggccttggcactattgacaatggcggctggattgttcttcatcttggggggactgtcctgaatactataggatgttcagcagcatccctaacatttgcccactctctattacaatggagagagagtgggaagacatttgtcaaatgtcccctggtgggtaaaatcaatgtcagttaagaagcactgattcatatcctttagttgtaggatttttttttccttccaactggtttttcttgggaaatggagttttaatggcattctgatttctttgcccttcatcttgtgttctccttgggcttcattttgattcccttacctgcagaactcaaatagacgttcacggcaagcaaaatgcagtccttgttattattaaaattttgcaggtattttttcccttgaggaaggagaaagtctgccaaaagcattctctggcagataataaaataattgagagtagcagactttccatttgatttttcttttttggcttggctcctggtgagtaagttagttaacccggaaaagggtgttactgaaactgcctttgcaaatattgtaacggaagaaattatgacagtgagagaaatctgacatggctgactccatcttgtctctagcttcacaggctggctgtctttgctcattcctggttaaaatcaacttaattaaaaactgatattcaagctatatatatatatatatatatatatatatatatatatatatatatatataaaaggccttggtgctttttcgcttcttggatcttgtttaagaaaaatttttctttgtttttcttcttagtcagctgaattatttccccagtctgttttcttgccactcttgatgcccacatgagaggacctaaagtaatttctgacagcccgggactccttgggaaaaacacaggaggtgccacataccctgttttgagaaaaacctacgttttcctcatggaaccccaggaattgaaggaggctagatccctctcaaaatctaaggctctgttccgtgttacctgatgtattttgactttgggaggtatcagaaattactttgcaggaagaagagcttttagcctgtgtgtgtaataactaggtaggaaatatactttaagggatggctaatggagttatggaaggatactcagctctttgcacttttggattagagaagcatgctgtcagccacctagaaggtatggaaatatttctaccccacactgagagatgagactcccttgggggatgggctgattggctttggattgccttgcagtggaatgcagggtaaaagcattgcactctcttctcccattgcattcccctctttttggggatccaagatgtcatataaaaatgggacccttaatttgggggatctgtttttgccttccagctatgcctgcttattaggccctagaaactacatgctctcctggctctgtttctataagggctccaccctgaagccagtaatccaatgaagaaacttaaaaattgaaagataaaaaaatcatataactaccggatccccttctgtctgtgtatttatatgtgttgtgtgtgtgatgtttatataaaacatgttaatgttcctattagttgacttttaaagaaaaaaagtgctaaaaaaaaattgtcagaaaaatagaaacattaatgcatttaggtcacgtgactctaatctttgaaaaataaaggcaatttaaaatattattggtaaagtaaaatgtcttcaacatttatacatttggtctaaattaggcaggtcagatactgtttgctagatgctttaagcccataaactgcttctgtgatttttaataattgtttgacttgtctgttttacagccattggattctagataaggcctggggacacgtggaattagccaggtgccctagctaggctgggaagagtcagacattgtctgcagctctgtctttgtcctgggctctataatctaatacatggttaaaattgcttacctatcagatattacaccacaaattaaagctactgagaattaacattgtaatatactggagaaacaattttacttataaggtatacaaggaaaatagaatgtatttttggtaaaatgttataagaaggtatggaaatacggtttttgttaaagggaaggtaatgttgtctagttcaggggattttaaggatcgtcttaacctaaaagagcgataagacaaaactgcaagtttaaacaagcgggaggatcacaaggtcaggagatggagaccatcctggctaacatggtgaaacctcgcctctactaaaaatacaaaaattagctgggcgtggtggcgggcgcctgtagttccagctacttgggaggctgaggcaggagaatggtgtgaacccgggaggaggagcttgcagtgagctgagatcggccactgcactccagcctgggtgacagagcgagactccgttcccccctacccccaaaaagaacaagctataaagggtttgtgaaggattgatcttgtaaaggaagttctgtgtgtatgaggaagttggctaagatttgaaggagattatttcagtttttggtaaattaaacattaaaataaaagcacactgatacagggctcaaatctgggcccatgtgtctgaataatggttttcttaggaaattaatcagctgtttaacagaaaattataaagggttttaaaaggtttttgaaaattttacctgatggtcaaacgaattaagattatatagatttgtttataaggttttattaagaattgggtttaacattaatagtacacaaatgcaaaggtgaaattttgctttttcttttaaacaagattttcgtgtaatattaagggatacaaaaggtttttgtttgcccctttgagtaaatggcagggaaaaggaagaggggaaaggaaagagattcagttggcttcatgctgtcttcattgggtcctgttgtttggaaagctgaggctcctatcaaagtaaagattttttccttcgtaaaatttttgagttatcattttggctaaatgaatgacttaggtatggtgacctgggattctattttgtaatatctaatgttttaaacctttgatatttgacaaacttgccaagatcaaattctaggttatgttttaaaaaaaaattaggacacctaaagtccaaaagagatatatttggcttattcaatatattaaaaccatgcaggaagcattgtcaaatataaaatggtgtttaactttctttgggttatattcatataaatatgttattagtatgtgttacaaacttgtgtaagattcctataattctgatgtttcagtgtatgttatcattaataattataattgttatgttaaattgttgtgtgtcacagagacgaccagaattccttgttgattgcatctttatggctgtcctgagacttgtgtcatccatagacaattattgtcttgtgttgctccttttcagaaggcagttgttatattcagctataggactctgacaggtactcttgaatgcgggtctctgataagtttagaaattgtgccattggaataggaaaaaaaaaaaaaaacttttgggactctcgtggagagctgatgtgttaaacattgctaatccctttgttattcagaatcaagaaaatgttttctttttagctgtttaccacttttagcaattgaataagataaacttgtgcaaaatttactgtgagcaaaatttggagcatgttactttttctctacctgatttctgcagaatttatagaaactatttgagtattctcaacttatggcagtatagttatttgcataagtgcagtaagaatctgttctcttttgtaacagaacagaattagaaacactggttattttaccaaggctttgactggaatggcatgcattcaaatataaacagactgctttaaggaatcaaagttgacttacagagccaacaaaagcccctcaggaaaacgcctcataccttgtgcggtttctgtacagggttcctgacttgtggtaagtaaagaatgtcattttctggcgggcctagggagccccaagttatcttgagaccttgggtggaggaaagagcctattatggcaaataattcttcttgctgcactttatacaaataatcagtccaagcataataagactaagacttattttgcaagtaaatttgtcttactatgatttgtctttaataaaaatggggactagagagagaaaaattatgtttcaaaaaactataaacttcttgagttttcattatcttctgttaacactgaattctttgtgggctacaagtccccaaactaatgctttcaaatttttcttccacttttctaacttggactcagtaaaatgctactaccttgttcctgaggccctgcaagctgaagcttattcctcgtaatataggcgacaaaaacgtttcagattttcactgcctgcctcatctataacgaaagaggcctaacccacctgcattgccacctcctgatatgggaaacagctgtttaattaaacatctagtctcaggactaggaaactgacctaaaaagaatatgggatgatatatgtaaaatgtgttctttcctgtccatcccaatctgtctgtctaacaaccactggcccaaatctctctgctagccgccccatgtctgattggttctcagagatgttcacctgggtccctcagagcttaaggtccagtctacaaaggcttcggaagctaggacttccactctttatcctaggaccttatagctcactgttcacttcaatgctgtgccaaaactacagatgaccatcctaatgcctttgtcatgcaagccctgaaaccccaaccaggcacatgtgagtacatgcagacagctgcaaaggggttccactccttttaccttggggtctgcagctacacccactatgcccactgtcagcaggaagaagttagggcagtcgtctcttctttttccatcttcatagcccacaccttaagaataaggtgttataaaacccaaagggagggattgaaaccacctttgcaaaaattataactgagaacatgttgacagtgagagaaaactgacctggctgactgtcttgcttctagctcacaggttgactgtctttgctcattcctggccaagctaacctgggggaaaaatttagtttatagtttcaatgataatagtccttcccccaaactaaatgttgttgtaaaactaatgaaaggctaccaaattaggatgagaggggcttgaattctaaataatttaccattatgccattatgccataataatttgccattatgccggcagtcaagatttgcatcttccccttgaagatagcatcactgttgtagaacctaagattggcctttgagatgtcttttcaggtgttcgcatttctgacaaccagattgccccacttggacctgcgaacaaccggtcctgtggccccccctactgaggaatgactcagcataagaggacagctacaattccctatgatttcatctccaacccaaccagtcaggatgctccctaccccaccccactgctcaccaaactatctttaaaaaccctaatctctaagccttcggagagacttgatttgagtactaataaaactccagtctcccgtacagccggctctgcatgaattaaactctttattacaattcccctgtcttgataaatcagctctgtctaggcagcaggcaaggggaatccattgggtggttacattactcttaatatttgtgaataattgcatctacaaaaatgattaagtggctttgcccactgtaatcctagcagctgacaaattactctgtagactccactgtgtttcctagggccatggaatgccttcttatgcaagacacgtttccatggattcaggaaatcattttaatggttcagctatcttaatttaaacaaaagttcagggcttattgttcagctgagtctctaaaaatattttttgactgcagcggctcttttacattgctaatgtgtatccatgtttaaaaaaagaatctttatgaaacagtgaaggccagcatttctttgaggtgttggcagtctttgctttaggaataataaaggaaaacattagtttcatcaaataataaaataaggaagacctgaataaaatgtccacattagtagaggatgaaagtaccctgaaactctgcaaaacagtaatgtctcatgctttgatgtgatctcattaagtgagagcagcacattttgctggtatgttgggaccccccaagaccaccctcaggcccagtggtttgctggaagggctcacaggactcagtacctgccacacttacggtttattacagtgaaataatacagatgaaaatcagcaaggggaaaaggcataaggcacgaagtccaggtgaaactaggcacaaccttgcaggtggccacccccagtggagttacagagaagctgttaattctcccagaagaatatatgattggccatgtgcgggagagtggccagccagggaagctcacctgaaccttggcgctcagggtttttatttgggggccattcctgtgggcatgcggcccatgccgaggggttcagaaggaaaataggagaatacaaggctatccacaccacttcaggcccaggccacatggaaatctgggtgaggttctgtatctgtcgttggtgcatttatgcatttgttagatgtcaatgataaaaactaatttctaagaatgtgtaggagtgggtaagtagctggagaacgtgatacccaggcctttcatatagaaaagaatagcacatcaccctggccagctgtgtggcatgaacaattgatcctcctccaccaagtatgtccattctccctttgctaaatacagtggtgtaggtttgcagagcctctgctcacatgggaggttatgaaggggctaattgttcaattaccaaccctctcataactgtgctagttgcaaacaaactgtttgaaaagactgttttgctaaactgttctcttggtgtgattataaccatttacagtagcaaaatgcaggaatccagaagttcttacattccagatgttcataaccattccactctcctggttccagtgcagtttcagttgtacgatcttttctaagtttattgttctaaattaagacttgccattcttatgctcattaatttgttacagggagaaaaagcaattagaatgaaaatcagttgagtatttataaattacagttgtttaagtatacatcttgttcagtgtagtcaaaaattctccattggtattgacacccacaaaaatggtcagattctgttgaagatgcacataagccttaaatttcacttcctactttaaaaattggtgacgatgtgaaaatgtctaagagagtccacatttcctgttttagataagatgaaatagccactcaccaaggtgcctgtcttccgagtttattcaccgttacattcaagacttgcctgctctgaaattctactgtgaccttaaaagtgcccagcattgatatgttttatgccaaattctattccctttcttgctttccagaccgaacagcaagcgagttgtctggactgtcagacacaacactgtccctcttccccgaagtctctgtacatccctttgctggtgcctccttctccgttcacttctcaactactactgtcctcaagatgatgttctttttaccctcccacatctgtgcctgtagtaatatgtcactctcttcctcctgaagtctgagtcccatccccagtctctctgctgatcccccaagtctgagtgtccactcccaatctctccagtgactcctcccctccaagtcacggtgtgtatccccaacttctccattgccatccatactgatattttgaatgacacttcacgagcactctttaatgtaaacccacacttggtaccatcaccatttccctaccacagtctgtccacttcaaagacaagcttcctctatcctgtgattatgtcactctttgccttagtccattcgagctgctatgacaaaataccataaacaacagagatttttttctcacatttctgcaggctgggagtccaacatcaaggtgtgggagattcagtgtctggtggggacccgcttcctggttcatagatggcgccttctccctgtgtcctcacgtggtggaagaggcaagggagctctctggggtctcttgtataaggacactcatcccattcatgagggctccaccctcatcacctcccaaaggccccacctcctaatgccatccccttgggggttagatttcaatatatgaatttagaagggcggagagaagcattcagaattagcactgtttagtagaaaaacatcaggattgtgttcaaacatttttttccatgttatctttcctactgcctccttgtcttcagttccctccccaccacctggcacccagatatcctacccttgtcagtgttacctctatccccccatcactgttttgttgtagtaacaatatctcacatttgtcaagcacttgctgtgtgccaggcatgattctaaatattgacagatgaaactgtttattcctaccaatccctaggaagtagaaacagctccatcctcatttacagatgagaaacccaaggtactgagaaggtcctggcctacccaagtcacttcaaggaggtcatacagctgggattcagaacaccatccatctggctttggaatctttctcattttttcatttattcaacattcattgaaaataatgtaataaaaattatatatgtgtatctatatctacctatagatgcatatgtatatatgtatatatagctatcatgtgctacgtgatgctttcaaatacagttggccctccatatcctcaggttccccatccacaaattcaaccaactgtgactcaaaaataaattgggggctaggtgcggtggctcacgcctgtagtaatcccagcactttgggaggccgaggtgggtggatcacctgaggtcaggagtttgagaccagcctgtccaacatagtgaaaccccatctctactaaaactacaaaattagctgggcatagtggtgcatgcctgtaatcccagttacttgggaggctgaggcaggagaatcacttgaacccgggaggcagaggttgcagtgagctgagatcgtgcacttgcactccagcctgggcaatgagcgaaattctttctcagaaataataataataataaattggaaaaataatacattggaaaaaacaaaaataacaatacaacaattaagataatacatatatttttaatttttaaaagtggcagttttattagagcaagtatgaaaatatgaattaaggttgcaatgagcagcgcagcagagaaggggctgcctgccctcctccccccgcccgatatatatttcatgtgtgggacagggtctcactgcattgcccaggctggaatgcagtggcatgatcttgcctcactgcagcctcagcctcctgggctcaagcagtcctcccacctcagtctccccaagtagctgggaccacaggaatgtgctaccacacccagctaatttttcgtagtttttatagtggcagtgtttcaccatgttgcccagactagtctcgaactcctgggctcaagcgattcacccaccttcgcctccaaaaaagtgctgggattacaagtgtgagtcactgcgcctgacctatttattgttttttaaagacagagtctctctctgttggccaggctggagtgcagtggcacaatcatggctcaccgtagcctcagcctcctgggcacaaatgatcctcccgcctcagccccccccccccccccccccccccagtagctgtgagtgcaggcacgggccaccacactcaactaattatttttattttttgtaaagatggggtctcattttgttgcccagtctggtgttgaacccctggcttcaaatgatccttccacctcgaccttgcaaagtgctgggattacaggcataagccaccacacccagtgccaatcttagttctttgctcgttatctgaattttcaccatatttgcatacacctggagtattttcttaaattgaaacagttgctttttattagatataccaatacctgttagtttacgagtttcatttagttctattgttcgcataacatacatttaaatagctattaaatttcaaacatttgccctcacgctacttaaaattattttgagtaccgtcagaaatgtggaggccacaagagagtacttgaatgcagcagttgtcaccttttctccagcagcttgagaaagggcatagagtgctatctgagctggatttgaaccagaagtttttaggcaaagtaagaagagcacttcaagaaaaataaagagcaaaccccagcatttttgaggagaatgcgccatcttggtgatgcggacctaggacacatgatggcaggaaggaggaaaagatgctggcaagtagggttagtggcacattaacaccagctgagacacgggaacctgtccagttagaagccgttgattcattgttgaaagataaaactggatgtagtgtgagtaaaggatgacctgcctgcttggtgaaaaattagtaaccacagaggtggctgtcaaaaccaaccagcaaccagggaaaatgcttatagtgtgctaggtaaaagagaacagggatacaatattctgtgaccatgatgattatacatagaaattaagacgcacaggccaggcgcggtagctcacgcccagcaagtaatcccagcactttgggaggccgaggcaggtggatcacctgaggtcaggagttcgagaccagcctggctaacatgaaatgaaaccccatttctactaaaaatacaaaaattacctgggcgtggtggcatgcgcctgtaatcccagctattcgagaggctgaggcaggagaatcgcttgaacctgcgaggcggaggttgcagtgagccgagatcatgccattgcactccagcctgggtgacaagaatgcaactctgtctcaaaaaaaaaaaaaaaaagaagaaagtaattaagatacatagagaaaagggactggaagaaatcccccaatgtgagaacaggagttgtgttgattgtttaacaatgtgagttaatttctccatcttccaaattgctttctcttatattcccaaagtcatatcttgacttttgtttgagtgtgatttgcaatggtgctatccgtcgtaaatctctggtttagcattcatgctgtcttccaatttccaaatattgaatccagaattcatgagtgttccaaggtgctggagaccacactgtagggctggaggacatgagcgtctctgcacctagctcttcctagtagctgacttgcagcaggagctgaggcttctcctggcatcacctccactacaattctctgtgagcatttccaggaagcagcaccccctaccctagccgaggcccgtccaaggttgtctcgttgtcctagcccgccattgccctgggaggaagtagccacatgagtttatggcctgagtaatgcttttccctcctggatgctccccacatctagaggatatgaaaatagtcttggcaagggtgcctggtctgcgcttgtcagcggcctgagctgtattcagccaccacccttggggtccaggccagatgttatggcaaaaccgtattttaacgagatccttctggtatttcttttggacgccgtccgaggcagcttcattttacgctaaattccatgttatggtgggtcatctcaaacaggtctgcagcgcataaaaatgttctcactgcactctgttttctgtagcaaaatgttgttggaggttaggatgggagttgaggactgggccttgagggtttttttcatataaacacattaaaatggaaagctgatatgaacacgttcagtgatatagactgcaaaggcaaaaagaattctccccagcatatttttttttctttttaccatggatgtaattggagtttacatatgataagaactgcttcttgggcagaaaatgtaatcctctggtgagactaatccatcattgttgaagtgaagggaactggtagtgaattcgccccacagatgaagataggatttctaattccctcgccttttctgtttactgttcctaactccgtgagagtgtgcgtgtgtgtctgtgttttcttcaccatttgatttttcatcccggctcccacttcctcatccttggcctctctcgcatctttatttttatcacaccctccccacctccaccaccttgtcccagcactgagaggaaagtgggcagctttccaggcagctgcagtcctgctggagaaacctttatgatccaggaaatattgactgaggagaagctgtgctgactccgctatgaataaggaggttggaaaactgtcagcatttgcagaaacaaaaggaagtgctacatatacgttttggtttcataatgactgtattgtaaaaccccttctctttagcctactagattggacaagtgtgttaaccagtggctgtttggtatccattgatcatagagctagaccaacaaccaaagttgtttacctctcataaggtggcttttgcaggcgtgccaaaatcatattatgaaactcccagccacaaattctgacatgtattttcacttcctatccaataagggatatccccacccctttactccccgactactgtagtcataaaggtacactcctagttcctccctctctctttctcagcttctcggtccctgtgtgtgataaggtttcttgttgccctgtgtggcatggtgtggcacgccccagcatactcccttccttgggaactgagtaataaattctttcaatggcattagcctctttgtgttgtcactcagtcacctccataaattaaaacccttcaggttttgttggcactgtaaggtaatttattttctctacataggattttagaattgaaagggaccttgtagatcattgaattccacctgtccatgggtcagaaaagggagctggggaaactgttagggggcagatccaggccttggagcacctggttaaatgtgttctccccataagcctaagaaatggtaccaaattcttatgtcattgcatccaatatggtccttccttctttcttctcttctgtttctttcctttgctctcaagactggtgtatcactttgtctcccaggctgaagtaaagtgtgtttgttatattgcagtggttttttattcgtattattatcatcatattgttttttgttgtttttttctggatatttttgatctgtggttggttgatttggtggacgcagaactatcggatatggagagtcaactgtatataaaatcaggtcagcacacttttcctgtagaggagcagatagtaaatatcctcagctttatgagccatgtggtctctgttgcacctactcaactctcccattgtagtgtgaaaatagccatagacaacacatcaactcatgggtgtggttgtatctcaataaaactttatttacacacactggcagtgagccagacttggtctgtgggcctcagtttgcaagcccatgatctaggcaatgcacagatagcagatggtgtccctcagctttggatagctgtaagtattacaagtatgtgagtctgttaaatacttaataaaaattccagttttaatgttacaaattgatacccttggtatttgttttagctgaagatgcaaaaccaactccacagctgcctgagtattaaattctacttttctctgccaaataagcagtatttctaaaggccagtgattgataacttagcagattttgctgatgaatcaggccaacattagctgagcatagtagtacactgtataactcaaatggtttgtgaagtcatttgtgaggggtgtggtttagcagtgtcataattgcaagaaacgcaatacatgtacttggtttgttttaaatgtttatgttgcctagttagatgagacaaattcttatacagactgtttcctctcttgtgagactattacacgttttattccaaatggacaggactttacatggaagatcctaccatcctttataaaatgtcatcctttgtgtaagcctttcagtttatcatgattatactcttttttttctccctgggaataattttacctcatctggttatgctctgttactgtgtgttatgttatctaaggtctatgaccaattgcatgcagagggtggcttgcttttcaatagcaacaaccaagaaccaagcagaaatgtaaggagagtagagctgggggtagtggcctttcagggtgtcaattccccaaccatggtggggttgatgggacaatattggaaacatttttggttgttacaatgggagtgtgctactggcatctagtgggtagaggccgggggtgctgctcaacatcgtacaatgcatgggactgtgtcccccacagcaaggaatgagccagcctaaaagtcagccatgctgtgcttgagaagccctgctgtcaagagattcatcaggaatacgcctcctaagtaggtggcaagcctagcgtcttcaggaatgtctctaggctagcctactggtgacaccaaggacactaacccatcaccctcacacgatctttcatcgaggtaccaccaagctctttgttctcctgccctttaactacttctgcacctgccgcaggggcagtccttggtgcttcgtttatcattgacattctggtctttgttcctacggatgtcttgttgggcagaagagatgtgttcagagatgcgggaaagctgaggaggcacaaggcaccgaagtctcaccactctggcagactgcatatgaatgtgcccattagccctggagtccaagtgggaggggtgagatgctggcaggtgtggaggcaggcattaccttccgcagcaccctggcacctggttctggcaactgtggcctaagaggaagtggtcaagcagcctctagtacatagtccttgggcattgtcttagttagtatgggctataaccaacaccttagactgggtaatttatatacaaccaaagtgtattgctcacagtcctggaggctgggaagtccaagatcaagacgccagcagatttggtgtctggtgaggtcctgtttcacatggatggctccttctgtgtcttcacatggtggaaggtgcaggggagcttgcttgagcctcttttatagggacactgatcccattcacgagagtggatccctcatgatttaattgcttcctgaaggccccaccccttaataccgtcactttggggatttgtctcccacatacaaatctgggggggacacaaacattcagaacgtagcaggcatcttcctgtcccagaatgaatatcagaactagcaaatatcctagcagccatttcatctgacatccttattgttccaacaaggaaagctgggacagcaacctttccactcactgtggtctcctctccatcaaatgtgttgggggtctggctgctgtcccatctatgtgtctcatcagcacctcaaggtactttttatccctatatcacagaggaggaaatgcaggcccagccaaatgaagcgacatgggccaggcaccagtggcagaacgaggacagaacccagccatcctgcctgctgctgacattttctccatccagccctcctgcttgccttcatgagaccacatggccagaaatcagtaagaaaatcttgcaagcaaatggactgaaaaaccattgctctagaggccatgtagagatccattcagagaaatgcagctagtgaaaatttcagcaaataggaggacttctgttaaccatggcatggaatgcacatctcccaggtctttatgaaggtgcctaatttccagtcatgacctaccctctccaaaagaggacccaagctgatgaaagaccttcgaggtacccctgtagaactttatcctgcacatttgtcattgtgcatctgcacaggatattcctttcggcagacgactttcagctctttgcagaagtctcagacgccacatccttagtccatctttactggttcatctctttgttccaagaagacttaattgaatgtggatactgttgtccacacgatctagaaatgaaatctgtgttggagagcataatcatgtagagagataaagttatacagccaaaacatgtactcaacattaaaaacccagatgagagagaaatcaagggcacactccctccgtgggttagactgagctttgcacaccgttctttgtgagttgcctgagctgcacccacgctggctgctgtccagagctgccagtggtctagctgagcagccaggtggaaatggagtctgtgtccatgcagggaattcaagaattttggttcctgtgcttgtgggtgggtcttggagtgtaaagtaaaaagcggaatctcggagtcacatagtctacggttcacagtttagttcagcgtcatatcacatgatccttgggcgggttacctgatgtctccaatgtttgtccttatgtgtgaaacaaaaacagtaccaactccaaacagctgctacaaagactgaggtagtggacagagtgcccaggtttggttgaagatggtaatgtggtcagaatcggctctgtttcacagagcatgtgactgcaagtaccagttctgtggcccagtgctgcttgcgggaatgaatgagtcagagtggatgaatgaaatgtcccaggagcacgagactttccttccacaattgctccatcagccatgaggtttgcttgtcaggtgccgtcatcagcacataatgctgcattctggtgcattcagtagatgtttctagatactgtttcatggtggctaagagtggtttctggcacccaggcttagatctcagccccacccctacaaactgagcaacaggaggctgtcagttaccctcaaaagatctcagagactgattgatcaaggggaaagcggcagtgacagaatgatgctgagaagcttgaagccatttagtaggagccacgtgagtggcccccatcagccgtgagagtcatgatgtctatgagagaggaatcactgtggcccagagtagataaggaagattccatgtagtggatcgtcaagccaagaatgcagtgaggtcccgctttatccattgactggggtttttctcttccacactttgccaaagacctcaatgataaaagcttgcaggtaaaactctgtatagcattggcagagaatagagtcgttggtgaacccaagggtgggttgcttcattttggtaggagtgggtaggagaaaaggaaggtggatagagagaaagcaagttagaaggaaaaggtaaggttgttgtaaacagccttggcttatatcctccaaaaacacaggggcggaggaacccttggggataggggaacctggaagggcgtcctttggaacctaatgtaggcagttatagttctgtaaagaaatatgcaaggctctgtgcaattgattgtaaaattaatagcagctaccctattactctgttagataaatctcaactacacatttgatatgttctttacaacctggcggtggggacagaacagagggtggattgaggaggagggagagtagacagagaaaagtgaagtgtaagaaagcagcaaggagagcacagcgcagagctcgtctcctggaggaacattcccatctggtgagcgttttgtttattgcaaggtcagtttgcatttggataaggcgaggcagaagggcactgatacggaagcagagggaagccggctgccactgcccctcattggctgaatgaaaggcggcggaagaggagcacctgtccagcaaggctgacagtcctgcctcctgggataagcagattctcagcctgcagagtggtctaaccagggaggtagagtggctgctttccgaactccctgcttcctgctcatttgcctcatgcatggaagttgtaaacagtgtgagagttgaaagccacaccatgggaatgccttggtgtccaccccacctgttgccaggaaccgagcactgggggtccatgttcctcacacgagatccccccatgatgtccacctcccaaggatttcaagctcctgtgcaccctcaggccgcctctgcaccaagcaaagtgacccagccctgccaggcggggttgcctgttttaggaaactccctgcagcagcctaggcttgctggcagtgggatgccacctccctctctctccttgatgaagggctgtcgcagcttcctcatcacccccagacctccacatagatgccctgcatcattgccttctttccttgaagcaggcgccatccacaagagcaaggcatggctttctgtgtattcggtcctgacccccttcccaacagcttcattcaagagccttcatccaaagctgatctgaaaacacctttaaattgccaagcatcattgatagcagcttcctagagcggcagtgaaagagatgcactgggggaggagaggaaaagagccagcatcaattagcaaagagaaaattcccagtgttttgagaaaatgactcagtgccacaccagtcagtccaggacggcctcttctccgtcttcagttgttgagttgtgatacacttgccccgcgtgccaggaggactcagggtcagcgtttgctgttccctcatcttgggctgaagaaaggtgccctgtgtgctttcagggggtgacacagagaggcttcagcatgagcttctgcacagtcttacgaaccacggagttttggtggggagcctggagccaaatttgagtaacagaaatgtccaaccggggcatgcagggcaaactattgtctgttctgctttgttcttaataacactgaaacggttctaccatttaagtcccttgtttcatcacataccaatcctggtcttcctgggtctgaagtccctccctctctccctgccctttcccaccttactgaacccaaatcagaagcatccctgggcattctgcagccgtgtctgtccctgcaaattaagtgtgtttgaagtctgcgggccaccttcagatctcaatggctgcacctccctccttcaattcgggtctcactcaacctcagctttcccctcttgccacaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggtacgtagctgctgggcccggcccccaaacagcagagccctgggaagctgcaggagcttggaacacattggaagctaacatgcatttccctcaggcatttgggattaattccgcggcagggtgcagtggctcatgcctgtaatcccaggactttgggaggccgaggcaggaagtctacttgaccccaggagtttgagaccagcctggacaacatggtgtaacagcatttctacaaaaaacaattttttaattagcccagtgtggtggtacgcacctgtagccccagctctcgggaggctgaggtgagaggatcagatcacttaagcctgagaggttgaggctgcagtaagctataattgcaccagtacactccagcctgggcaatgcagtgagactccatctctaaaattaaaaaaaaaaaaaaaaaaggaagaagaagaaagtaagttgggttcttttccactttgtgttaataccggttgtgtggacacacagcagcaagcttccagtgcccctcccacatggctctgtgtttttgacttaaatgtagaatcactggctgttagttgatgtaaacacttacaccgccacatctgaaaaagatacggcagatcttcagctgctctgggcttcggagtggacgtttgccttgcacttaatgcagacttgctgtctcttcttgatttctggagcaggttggttagagaggggccccacacatggtcaggtggaatctgtatttcagcagaacccggcagagggcatcaccagaggctgcgtcagggcagagaggtgatggctctggtgttaatgaggatctcaagggatgccttcattaccgggctcgttgtagagcagatggggtaggaggatggaaaaataaatgcacattaaaactgtgcacttggcttggaacccctcccactttttacattggtccacagtgaggagttgtgccaattttataccaattttggttttaaaccacacacctcaccctctcttgtcccctcctattctggtctcatgattctgcagtgaagatccccttgacttctggggaataatgggatccacaacctttcttgccgccttcacctgagtccctattttatttttagagactgagtctcacactgttgcccaggctagggtgcagtggcacagtcatggcttactgcagcctcgacctcctgggctcaagtgatcctcctgtctcagcctcccaaagcactgggaccacagacagtccctgttactgatttctcagtcccctgcagcttcctccctctgcttctctttctcctactctgacccaggcgcgtgattctactgaacttttccatactgtaccgtcatccatcccacctggcagtcacattcttccaggattccctctgtcccgtctttctgggaactggtcttgcccttacaaacctttctccttcacagcatgttacactgctttaaaaaactcttttagaaaatcacaaagtaataatatcctgttctctttttcttttcttttctttttttttttttttttttttttaagacagggtctctctctgtcacccaggtgggagtacagtggtacaatcatagctcactacagcctcaacctcctggctcaaaagatcctcctgcctcagcctcctgagcagctggaacttataggtacacaccaccacgtccagataatttttttattttttgtagagatgaggtctcgctggtcttgaactcctgggctcaagcgatcctcccgcgatcctcccgccttggcctcccaaagtgctgggagtacaggcgtgagccactgtacccagtccctgttttctttcttgcacttctgcctgccatttttcgcaaagctgtggctttcgaaactccggtgttttttcctctcttgtgctcctttttccctggcaaaccccttcacactgtgtgcccgggatcttccactgactccttctggccctgtctagtttcctcactgcaaaacacacacgtgtgtatctaagaggacatgtctccaaggtccagccagccatcagatctcaaggcgcctgtgactctgtttttctctgctcattgccttctacctctcatctgttgagaagccttcatagttgccttccctcggcactccagattccagcactctaggggctaatgaaagactgtcccatttgtcacaatggtttctaatcattaaaaagtgagacgccaggggcggtagcacacatctgtaatcgcagcactttgggaagccaaggcaggagggttgcctgaggccagaagttctagaccagcctggccaatataatgagaccctatctctacataaaataaaaaaaattagccaggtgcagtggcacatgctcgtaaccccagctactcggaggctaaggcaggaagatcagtttggtccaggagtttgaggctgcagtgagccatgactgtgcccctgcactccagcctggatgacagagcgagaccccgtctctaaggaaaaaagagagacagtgtgcccgcggagtttaaatgaggacatgttgttactactttggacagttaccgcgttttgtcatgggcttgttcatttgggtgtgaacatatgaaggaggaagggggtgtgggagcgtcttgacccatcggtcaccattgtccactccatggccagaatcaagggccaagagtgcctgaggaggtgatgcagctagttctttacataggttgtattgttttctttattttgaatattgtcttgtaatcagaaatcatctggagtgatgtttcatttagttattcttcagctgaaacctgagcctttcagttcttcctcacttctgaagtaattcaggttcagagcatataaacatgtgtttgcacatccagatacaaccccaaggcttactgaggttcacctgattcgaatatctggcgtgtttcacaaggaaagaacctcctgctgtatttttaaacgtgtgtggaaagttttccatggtaaacggaaatcagagaatcaaagaatggtcaaaaaaacatgaatcaaaacaaaatgatgtcaattgtgtcatggctatggttagtctaaccctgaacccaaggagtcatttcaagtagcagcaagtgcctattttattaaatcccctggacagatggacttggaatccaggcctaaatgctgtgtgcatctcatttgggctctgcttctgaagcgttaccctcccatataatggatggtcatttgcagagattttgcacagtcgcgatagcacgtgggcaggtcttctccaccgcagcactcagtatttggggctgcgtgtttctctgtggtggggccatcctgggcactgttggatgttgagcagcgtccctgggctccacccaccagatgccaggagcacctctcctcccttagttgtaacagccaaaaaagtctccagacgttgcctaatgccccccaaggagtcacagtcaccccccgcccccgccacgttgagaattgtgccatcagggatagcactttctgtcaagaataaatggcctttttgtcctcaatgccccaattgggtttgacactcagaacaaccatcacacttagttcttaccaacagtttgtcgtgtccccttccctgcccaccgtgggatcccttcaccccaggctccaggtccatgccgcttcccccgtggccccctggttgctgggagccagctgtttacgccccacttccctgcgcttctcctgcccagagagcagaggccattcccagagccctcacccccgtgagctgacagctgtaccttggcttgcttccccaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcagtgagtgcaggggctctgggagttcggtgggcctctctgggttcattgttttcttcttgggcaaatccgaatgccttcttaaaaacctgcctgctataaatgtcttagaagctgctctctagtgtttgcttacgatctggccggaagaacttcccgttccattttttccatcacaacccttggacctgagcttcttcaccctcatcttcaactttaggaaatcgtgctgcgcctgctaatctgagaactctcatgtaacacatgattattgcccgtgataaacaaaagtgtttcattcatggacacctttagtctcagcctccagccttccatgttgagggtttttggccaaattatggtataattattgagcttgcagttcctgccaagggcactgggccccagagactgggcataggcttatttggtctttgcaaaaccccaggacatcagtccctgttaggtgattgcctgtgagtatgtggccagtcagagagcccaaaattctacccagagaacctgctccacttagacatactgctctatacacccgtagggacgccacttcagggtgcaagttcagagcgagcatatgtgccgtgcatggcgcaccgtgtgcgcgcatgcacttgcatgcacaggtatgcatgggtgcatatgtatgttgtacatgtgtatatctgcatgtgtatgtgcctgtgtctgtgtgcaagtgtgtatgcatgcgtgtgcgtgtatgtgtgcgtgtgtgcgtgtgtgcgtgcacgcgtatatgcgtgtgcgcacctgtgttcctgtgcgtgtgtgtgcacaagtttgtgtgcgtgtgtgtgcgcacgcacgcacacctgtgcatggtgtagtgtatgtgtgtgtgttcttccttatttgaaagttgttgccctcggagcagccatgcagcccagcagtccttgaagatcgagctgactatgacgttgctgtcttacctggtacgtcttggctccacaacttcctggtgtgtagagagccagccggctgcctctgatgaggctgcagcccgagccaagccctgtgacaagttaccatccacaggcaccagctaaaaaattcttggagaagcagatccagcatttaatggaaggttcacagattgttaataacgtttctattgcaatagggtgacagaaaggccacctgcctcaggtaaaaggaaaagacctcttaccagccttctattgataaggtccacaattgtggggcaggaaaagaagagtctggccctcctcctctgtgcatgtggccagagttcaccctggttgaacttctggaacagccaccccaacccccttctcaaaccctgcatcttgtgcctgacccacagcccagtctatggagacaggagcattggaaggccgcattttgataagaatgaaaatactggctgtcactcctgcctggagttaccaggccccctgccactgcgtggctggctaagatgccagtttccctcttgccatcaccagggacagtgggtctgccacatgcagaaagatgtttttcctctcttccagccagatgacactttcagagcatggaagaaacaccaacattgaagagtcccattgttgtttgaatcttttgtatcaggcttctcgagctaagcaggaccaccaggcgttttcttattttttacataaacagcactcctactcagtgacacgtaacctaagatcacattgcttctgtttcctgggttttccaccagagcacctttacgaaagacatatgacaaagcatgctcaattcctcaccgtattgtgaaactgttaaccatggctaattgtttgatgatcaggctatattgctcctttctcaggagcataaaccagggtctagcaaactttctttacagggacagacagtaaatgtcccaggctttgagggtcatgcagtctctgtcacagctgctgaagtctgtcagagtgcaaaaacagctgtgagagtcagctcaggctgccgtaacaaaaggccacacaccaggctgtttaagaatttgctctcacagttctggaggctggaggaccaagatcaaggtgtgggcagggctggttcctttgcgaggcctctctccttggcttgtagagactgtcttctctccatgtcttcacgtgctcgttcctctggttgtgtctgtgtcctgatctcctcttctcataaggacaccagtcccactgggttagggcccacccttgtgacctccttttaccctgctcaccttttcaaaagccctatctccaaatacagccacattctgaggcccctggaaattggggcttcaagatatgaattttagggggacatagtttagcccataacagtagccatagacaatttgaaaacatgggcagtggctgtgtgccagtcacactttatttatgcagaagcagccagggactaggtttggatcatgggctgtagttagctggccccagttacaaaaaataactgtcacccaggctggggtacagtggcacaatcatagctcactacagcctcaatctcttgggctcaagtgatcctcccaccgcagcctcctgagtagctgggactacaggtgtgcaccaccagggctggctaacttcttgttgttgttgttgttgttgtttttatagagatggggtcttgctatgttgcccaggctgctgttgaactcctggtctcaagcagtcctccctcctcagcctcctgaggcactgggattttaggtgtgagccactgcacttagcaaactgtttttattcctcaatgaaatttagagactgtcaaaatgtaaagaaacctaaaatatttactaaattgcactaaagccacgatttcgttagaatcatcagaggtaggccgggcgtggtggctcacgcctgtaattccagcattttgggaggctggggcaggtggatcacttgaggccaggagtttgagaccgaccctggcaacatggtgaaaccccgcctctactaaaaatacaaaaattagcctggtgtggtggcacatgcctgtaatcccagctgcttgagaggctgaggcatgagaattgcttgaacctgggagacggaggttgcagtgagccgaggtcgtgccactgcactccagcctgggcgacagagcaagattccgtctcaaaaaaaaaaaaaaaaaaagaaaaggaatcatcagaggtagtatttagtacataaaaaaaatgtttctggaaacaaaagagccctttaagtgtgtttctcttgtattggtaagccacttgtctctttgtgtttgctgtgacagataatcacgcgaagccaatggaaatagatggagaggttgagattccatccagcaaagccacagtccttcggggccatgagtctgaggtgttcatttgtgcctggaatcctgtcagtgatttgctagcctccgggtaaggatgtcagggtggggggcgctccagagttggggagatgggagatgcaagctgctcgcccttctctggagttctgcctaaaggaacacacactccccttcttaccccggtgtgtgggcagaccaaggaatgggtggctctatgagccacttctctacatgtctcatattgtggagaagccatagttccaagtcgttttctccatgtggtggtgaggaacacagcagcacttaaattaccaaatgcaaagatggcaaagagggaaacagggatccagagggatgaaaaagacagaagagcatgtgctgaagatgccctctggccagagagcaagctgtggagagcttcttatcccatttgaaccaaacaccagaggctcctgtgtttttattctgtagatctggagactcaactgcaaggatatggaacctgaatgagaatagcaacgggggctccacccagctcgtgttgaggcactgtatacgagaggggggccatgacgtcccgagtaacaaagacgtcacctcactggactggaatgtaagcatcttccaccccctgggcactttgaaattggtaaaatcggccagccaccaggcaggggctgcagcaatggagcccatgcagacataggaggcaggtggtcctgtgtgctcagcccccactctgatgggctgccagagaggtgttcttggcttctttttttattttgagacggagtcttgctctgttgcccaggctggaatgcagtggtgtgatctcagctcactgcaacttctgcctcctgggttcaagcgattctctttcctcagcttcccgaatagctgggattacaggctcatgccaccacacctggctaatttttgtatttttagtagagatggggtttcaccatgtcggccaggctgctctcgcactcctgacccaatgtgatccgcctgcctcagcctcccaaagtgctgggattataggcgtgagccactgcccccggccagtcttggcttctaagagctattaacaaggctgcatttggcaggcagtgagctgtgtattcagtagccgtatctttgcacgtgagcatgccttagcaaaatgagcctgtggcctcatggtgggaaggtaggctgggagccccaaggtagttcttctggagagatacgtcgtgcagcccaggaaaggtgattctccaccttgggatttcagcaccaggtgttctgtgcattgacacatgggatgcacacagtttgactgctttttattttctgcaaggtcttacgatagctttcagcatggtattttcaattctgtcattaaagaacacgcagtggcaaatggttccagtgtacctggatcctcggagaggctctccgagctgcttcggtgctgccgctcctaagttgtttttgtggggttttgtctctttctggccctcagaccaatggaacactcttggctacgggttcatatgacggttttgcaagaatatggacggaagatggtgagttctgtgtccctcgtgctggggtcgggtaagaggagctgccgaacttaacccttgagtgaacagaccatgacattgaggtcaacatgtttgtttttactaacaggtaacctggccagcaccttaggccaacataaaggccccatctttgccttgaaatggaaccgaaaggggaattacattttgagtgctggtgtagacaaagtgagtattagctgaaaatacatccctttgatctataggtggttatatatttttaatctcaaaataacatcgtggtttcttggaactcgtaggctttgtgcttccccttaagaaatgaaaatgatttgtttaggctttgtttttgtggttttgatctttctgttcatttgtgacacatcatctcttaatatattctgctgttctgcagaccctcgtgcaaagcttccctttatttgaggtacatggttcagtggtagagagaggacaatctccacattgcatttgtcagttgctggaaggagccacgtggtatggggcgtgccctgcctgaacttgcacccactgaggggtgagtggcacaggctgtgtgtgttcttcaggcttcggctttcctcatttgataaactgctgcttcccaccgtagaccgcagatttctctgagtaggagtcaagcaacctggctacaagggcacgctcttccgatggcccacagagccaggttagaattgacttgctctgcacctgggcagggctgcagggagacacggtagtgttaactccaggtgcatgtaaaagccatcaatggggtgggaacccaagggcaaagagtaaggggacgcagactccatcctgggcccgagtctgatccagccagcaacctcggcctctgtgcatttcactttcctcacttgtccagcgacaaggctggctggagtcatgagcggagacagccttcatggaacagttgtgcgttcccgagactcagcaggaattctaagtcatggctttggaaaagaagcattatctagaattgagaaaaaaaaaaaaaaaaagacgtgttttcacatgaatttgtgtttctacaacaactggaaaccatgcctgaatactggaggatgctcgggcctccacaaagctttgcattttgtggtgatttcaggataacttgaaaacttactaggtcttgaagttcgagaccagcctcgccaacacagtgaaacccagtctctactaaaaatgcaaaacttagctgggcatggtgtcgggtgcctgtaatcccagctacttagagactgaggcgcgagaatctcttgaaccagcgaggcagaggaggttgcagtgagccgagattgcgcctctgcactccagcctggatctggaagaagagtgagactctgtctcaaaacaaaacaagacaaaacaatacaaaacaaaacctgagtcagagctctctgttctttctagttctgaaagttataaaatgatagagttggccggtcgtggtggctcacgcctgtaatcccagcactttgggaggccacggcaggcagatcacctgaggtcgggagttcgagaccagcctgaccaacatggagaaaccctgtctctactaaaaatacaaaattagctgggcgtggtgggggatgcctgtaatcccagctactcaggaggctgaggcaggggaatcatttgaacctggggtgagcccagatcgcgccactgcactccagcctgggcaacaagagcaaaacttcatctcaaataaataaataaataaataaataaataaataaataaaatgatagacttgacctctgaacatcatcccactttgggagaaattgctaaatgaaataattgaatttggcaaactgtggcccacataggccaagtctggctcctcacctgtttcttaaatttaaataaagttgtattgggacacagccacacccctttgttgagacttctccatggttgctttcatgctacaatggcagagatgagcagttgcaagagagaccagatggccctcaaagcctaaaattctactacctggcccttcacagaaaaagtttgcggactcttgcactagggtataactaggtcaacaaatcattcattcataattgctctccctctcttttaagccaagaaacctttcagacttagtagcctggtttatgatattttaaaagctgagttgctgtggttgacacataaacgttctcatgtagctactatcagatctttgccaagatgttctaattcaagtaacatgcatacgcagcactttgctgtgcattcagtaggctctcagtaattgctgcttgagttattaaaatcactcatgaaaatgacagcacttttctttatcaagcagttcactactgcatgtgttaatccatccggtactgccaagataggaggcaggcacaagtatgatcactcccattctatagaggacgaactggaggcctggagagggttattaatttgcctagggacacacagctggtgcagagtacagagggatgggaactcagaccctggtcaccagtaactactgccctttaacttccgtagaattctaaatagctgtttgtttcctggcctccttcctacctggagactgttaacatttgtgattgtttttctcactgattatcagtcttaactccaccaggtgatggactatgtgatcagtgaaaatgcatatgtggaattatgttagtctcttgggctgggtacgatccaccatcattacttagtcaaccacagcaggagtgaaaataacatccttgtacataacactcagggagaaaatgtaacttaggggatgctggtgttgaccaacacagagtgactaaaatatatgtcacattcttcaaatgtttgcataactgttttcttttgtccaatgtacatttaacataaacatcaactaagagaccagtcgctgatgtaatatgtgaaatggtatcagaactgtgaaagagtttatatattctctgcagtgttagatttgtttttgcatggctaaattaagaagagttataccccaacaaagaaatgttaattggtctagaactgacccaaaacccaggagtaccaagtttcaaagacactcactgcttgctttcctctgaaaatgtctacagtcaacacaaaatagaactctttcttcttaaagcaaaatcttgactgagcgtcagtaacagagaggtgtaaagtttccaattaagttgaaaattccagttgatgaagacgtaactccaatgctattcattgagctggttctctatcttcctagcgtcagtaaattcataaaaattcgtgatttcctttgctttccaagggagaactcaacctttctacttactgttagaccagtacattggtgcctggccccagtgcaagccaatggctctgccatgtctagtgcccccatttcatggagggatgggcagaggcattttcagaaatgctcgtctctgcagcccttcacttggaacaaatgccacaaagatctctggagatgctttgttccaggtttttcaacagtttctgcatttggggatgaggaggaattcctaccaattttggtagttcttgcaagtattggttagggatgctctgtccttaaacccatttatgcctagtttccattatcggaatgctgagcatgtgggagttatttatatcctgctgctcagggtcatcgccaaggtctgattgcagaaattcaaaaagttgcaacctcaggcataaatgagttaagggagatgccagcatatgtggctgataggttcatcaaatgtggccgtccagattgctgagtttaaaacatgctgtactttaatgatgtggtatgggagaaaaagaaggcaaatatcccagtaaggttttgatactgattacatgttgaaatggtaatatttgggggcatgttggagttaaatataatagattgctaatgaattttaccagtttctttcttcttaatgtggatcccagaaaattgaaactagcccataaggctcactctctatctctattggacagtgccggtttataaggagaagggctgtcttttcttgtatgataaatgtttccagagaaaactttgccagaatagttactaactttttcctttgtttgcggaacacagacaacaataatttgggatgcccacacaggagaagccaaacagcagtttccttttcattcaggtgagttttttgttgttgttgttgttgtttgtttttttgtaattcaaaaataataattcaggtcgagcccagtggcttacgcctgtaatcccagcactttgggaagccgaagcaggtggattgcatgaggtcaggagttcaagaccagcctgggcaacatggcaaaacccatcactacaaaaaatacgataactagccaggcgtggtggtccacacctgtagtcccagccacttgggaggttgaggtaggaggatggcttgagcccaggagatggagtttgcggtgagccaagattgcgctactgcactccatcctgggcgacagagccagaccgtgtctcaaaaactactaataataataatccaaaattaggctgggcactgtggctgatgcctgtaattccagcacttcggaaggctgagacaggagggtcacttgagcccaggggttctagaccagcctggacaacaaagcaagaccccgtttctacaaaaaatataaaacattagtcgggtgttgtggtacacacctctagttttagctacccaggaagctgaggcaggaggattgcttgagccaggaaatcaaggttgcagtgagctgtgattgcaccactgtattccagcctaggtgacagaatgagatcctgagatgccccttaaagtaactgaatgcgccgagtatggagcccaggaggcctcattggtcagaaggagacccattttgtggcaagcattgattgctcttaaggtttgcaagatagagatgacctcggcacccacctgctcagagctctgaaacacagcagtgagccagccacagaagcagtgcgggctcctttctcttgctgttctaaagggatgctgttttgggggctccctgaaaccactcccaggattggtggtttgctgcgaggacccccaggactcaacatactcacagctaagatttctaacagcacaagaatttagtgcaacattagcaaagggaaacggtgcacacggccaaatccagagcttcgaaggctcctctcccagtggactctcacaggccatgctgaattcttccaggaataagttgtaactatgcctgtgaagtgttttataccagggaagctccatagagtctcagtgcccagagtttttattgggggttggccgtgtaagcacccagtgcctagtacaagccaaaactgcagacccccagaaggaaagcaggggcacagcataaacacactgtttgcacaaacaagtgttagcagagtgagccgcttgcgtctgttaggggagggtgggaactctccggaaatctaaaatctcagtcgctagccaagggccggccttgcaagcaagcctctgtagggagatcagcctcgggcctgtggtgttagcaccttcctacacagatgtgtggccgctgctctggagccaactacatccctttgtgcactggagccaggccaggccacatgcgttacccagggctctggagtctgtagagattccgattttccagattcccacctgattcttcgtgggtcgttttgggtttttttgtttgtttgtttggagacagagttttactctgtcacccaggttggagtgcagtggtgcgatctcagctcattgcagcctccgcctcccatgctcaagcgattctcctgcctcagcctcccgagtagctgggattacaggcatgcaccaccaagcccagctaatttttgtatttttagtagaaacggggtttcgccatgttggccaggctggtctcaaactcctgacctcaagtgatctgcccacctcggtcttccaaaatgattcttcattttctttcccacctccctcctctgtgtaactcagtcctgatgttagacgtggcctcttaaaacaaagacagatggccacccgcagagctaatagactattggaagtctttagactggcttaaagtggacagaagtgggtaggtgccacttcccttaagggcaaatgtctgatccgtcttgaaggaatccctaaatatgtgggacgaaagttaactattctatcagctgtccctggggcattgtccaggaggagatctgagtgtctttcttgtcatgcagcttggggtgcttaaatgatgttctgaatgggagggctaactgcaacaaccatccaaggcagaacagccatcggcgcctggggagggctccaggcaggggacatgggccctgcaggaaacaagaccatgaaccgaaggtcccgtcgaggcacgattgtgttagatgcataggcacccacgtctgttatattccatgcagtacttcagcagggactcctcatacaggcagctcagagagtgagggagactcagggaggacgctgtttctgctctgctgccctggagagggagagccactcctgcacagcttgggacccacaccaaacacacctctcagggttgccggtgaaatttgttactggtgttgctttaattgacactgttgatgaaggtgctgagcatacgagagacaaaaggctcccaatgcaggtagcacgtgtactaggtcctccagaaagtgttcttcaccccaaagggaaaccctgtacccattccatctttccctggcaactccacctacagcctgtgatctgtgtgtcatctccatgccagacacttgctactctgtgctctagactgcaaatcaaagcaggtggctagtgagaatagccttcctaatggagttccgtcacgtttggcttaagtgccaaaacctacctttgtaggcaggaaggatgctatgacaggttcacagccctagacacgcagaccccggggggtgaggcagggatgtctaatgcagaaagctctggcttctgtttttcagagaaaaatatgcccgaggtaaacatcaataaggttcctctaacacttgtgtcttaagaattcatctgtaaagtatttcagcagaaaataatctttcccaaagtgtccccaggccctatggaagggtttcctacccagctgacccaggaagaccacaaaccacattgttctgaattgcgtgagcttctcacctgtgatctggctggccatgaggtagacccaattcccgtcggcaggtcagacatatctaggcgttacttgctctctttttggtgtcaatcagtgtgttaaagaacgttcaaaatgaagagaaagaagctcgctcttccaggtgaaacgcagctgggaagagctgtgaggagcgcctttctgtggctgtggcaggtttggtgtttaatggggcgataggagacattgccttgccccactagcttttccccagtaacacctcgtgggggcgcccttggtcaccgtcggcaggaagccttagctcagagcctcgtggtggagtgaaactcggccgcagaaaggaatgaactattgatgcacgacagccaggagagatctcaagggcattttgccgagtgacaaaagccagtctcagaaggttgcatgctctgtgctttcattgatgtaacgttctcataatgctaaaatgctagaaacctgggacccgtcagtgctgtgggagttgagggagcatgtgaggaggttgtgtgccgatacagtagctgagggagatcttagtggcgacggaacacttctgggtctcagttgcagcgatacacatctacccatgtgataaaatgacagcactctacaggcaaattgcaccagtgtcagcttgccagcgtcgatacaacgctacggctacgcgaaatgtaaccctcaggagaacctgggtgaaggagacacaggacctctctgtgttacctttgcagcttcctgtaaatctctaagtatttcaaaaggaaactgactggctgggcccagaagaatgagggctattgaaccaaactggcctatgcatgggagggagggcacagaggcccccagtgtagctcagccctcttaccggccattcacccacatggttccaagcattgtggctgcaggagctgactcagagtggggctaaccacctgagcacgggggagcctctctttagatcaggaatgtccagtcttttggtttccctgggccacattgaaagaagaattgtcttgggccacacataaaatacgctaacactaacaatagcttgatgagctaaaaaaaaaaaaaaaaaaaaaaaaaaagaagaagaaaaagaaaacaactcttaatgttttgagagagtttacagatttgtgttgggccacattcaaagccatcctggaccgcgggttgaaccagcttgctttagatggaggagtcatcagatgctggtcgccatctcttggaccgctcaccagattgtcacatttccaggtatattaatcacatgccgaaatgcagaggctggaccagaagtttgctgtttagctcaggcgatgttgtaaacgagaacgaagaaaatgcgtcaagaactgtggggctgtcatgaaacacgctgctggggatggaacagaagagatgatctcagatgtggaaaagaccattgctgacacccgcgtcctcccacccacaccttccgcctgcagggggagctggatggggaagcgaatggggtccctgtgcttatggaggataaacacatggaggcttgcacctcttatttgaagaccgaggaagaataggggcaattgatggttagtattcagagaaagctggattcttctcagttcagcgctgactgcctttaagaaacacacatggctgggtgcgttggctcattcctgtaatcccagcactttgggaggccaaggtgggagaatcacttgagcccaggagtttgagaccagccagggcaacacaccaaaaccccatctctgccaaaaacatctttgaaaaaatgagccaggcttggtggcgtgcacctgtcatcccagctactagggaggctgaggtgggagaatcacctgagcccaggagattgagggtacagtgagccaagattgtgccactgcactccagcttgggtgacagagtgagatcctgtctcaaaaaaaaaaaaaaaaaaactgggcatggtggcacacatgtatagtcccagctactcgagagactgaggcaggaggattgcttgagcccaggagttcgaggctgcagcgagctatgattgtgccactgcactccagcctgggcaacagcaagacttcatctccaagaaaaaaaaaaaaaaaaaactcacataagatgagtttctatattggtcgattggtaaggacatggtggccagagcctggcagaagctaaccctctctttcccctagaagcaatgcttcattattggctaattcagtgtttacagctaccttggagaacataacttggcaaataacagaatggaccatagtatctaggaaaaccaatgagagttcttggctgggcacacttgtagagttgccctaaccctgctgcctcctctcctgggggcatcatggagcccactcagtagctaaaagtaatttccatgggcttgcatgggaagcgcagggttacgagaggtggtcagatgcggacgactagctctcgaagtcccaagctctctgccccgtaaggcattacccccttaaattagcatgaaccctgggaagggaggcactgtccctccatttcacatgtaatggagcacagtacttttcacacccctaaatcattccttttgatagtcagggttccggacacggggctggttgtggaggtcctctccacacaagaagcctcatgatgatccttaataagagggtggggttgctcagaaccttcaggggaagggaagagatcaccagagaagggaagggaagagatcaccagagaagggaagggaagagatcaccagagaagggaagggaagagatcaccagagaagggaagggaagagatcaccagagaagccgcctcttcccctgtgcccttctgtctcggcatcgcatggccttttctgctgctcatcagttctctggcatgaggtgggaagaagcccagggaacatgatctgctggtgtggcccccgcagtggaaagagaccggagacctgagcacagcgcccttcctggcccctaggaaggcgggtgacccctgcagtccgtggacgcctgagaggaggtggaacagatgctcgctcccagccgcagacccactctctgctagaggacaggagtgagcagttgaagccatgcttccccagaagcagaagaggatgagagtgcacgggggcccccaccgtgggaacttccacacctccagcgcactccctgtcccgggcactgctgatctcctgagatgcctcggctctctcccccttgtctggggctgcttgcaacatccacatctgtagctgagactccaggaagccgtcaacctgcagctgcacatcagtaaagaggcagaacgaggaatgaggtccatttgctaggacttcagtgcccttgctgtcacctgtgcttccagtgcctctcagggcatggtccagccctgtggaggcagacgctctgaggacagaaccagggcctggcttttagcgagtgccttggccattttggtacattgggaagttgttggattcccagctgccatcctagaaaataaatcagaaggtagagaatgagacccatagctgtaactaaactacaaggggaggtcagctccccgttgttctgtctttgtgaccctgaaccacctggacctgagaaaggcccaaagtcagggagggtgtcggtcacaggccctgaagtgtgcgttccgtttcatcccaaaggggtttttattgaccctaattatcccctagtcaaggggatgccttaatgtgttacaggagagtttttttcatattgaggtatcttgaacataggacatgaaatctttcctctccttttttctcctctttgtccaaaattaaatcaaatgagctcactgcagagatgccgctggaagcagcaaggtacagagcaggcagggcggccctctcacctgcccttcttaactgtgccatgggagcgggagattctgcaggctgtggggtgcaagaagtgtcacggagcctctctcccaggacatcttgtcatccctgccaacgtggcaggagagggtctttaaggtcttagaaagagactgtgttcacgcttgagacgtttttatcatgttactaaatggggcttcttggctgggtgcaatggctcacgcctataaccctaacactttgggaggccgaggcgggtagatagtttgaagtcaggagttcaaggccatcctgggcaatatagcaagaactcgtctctgcaaaaaaaaaaaaaaatttaaattagctaggcgtgatggcatgcgctattcagaaggctgaggtgggtggatcccttgagcccaggaattctaggctgcgttgagccatgatcgcaccactacactccagcctgggtgacagagcaggccctgtctctagaataaataaataagtaaactaaagaggcttcttgattgtgctgttcattgttgtaaatccatggagctgtgcaacagtgagtaactccagatgtcctccctccctactgcagcccctgcccttgatgtggactggcagaacaacacgacctttgcctcctgtagcacagacatgtgtatccatgtgtgcaggctcggctgtgaccgcccagtcaaaaccttccagggacacacagtaagtgagagctcttgtcactggtctcgagtttgtgagaatgtgatgtgggagccgattcttgtgtgcctagaattaaaagctactgcagcagcagaccagctctaatgtgccccttggctatttgagctgtcatggttaccccatggtaaccatggtggttggattgactcagtttggggttggcagtgagaacagttcactcagaaatgacctagatggtggatttggcaacaaagcctttaaggtagccatgagaaacatgtagaggacatcaaggaaaggatgctcacaataaatgaatagacggggcacatctgcagtgaatagaaaaaaaaatcattaaaaaacaaatggagactaagtgtggtggcttatgcctataatcccagcactttgggagtctgaggccagaggattgcttgaggccaggagtttgaggccagcctgagcaacatagcaagactctgtctctacaaaaaattttaaaaagtagctgcgtatggtgatgcacacctgtagtcacatcccaggagctgaaggctgcagtgagttacagtagcaccactgcactccagcctaggcaacagagcaagaccttgtctctttaaaaaaaaaaaaaaaaaaaagaaaagaaattgagaactgagaaatataatgtctgaaatgaaagtcttaataggtgggtgtattaggcagttctcaattctctcattgctctaaagaaatacctgagactgggtaattgataagacaggaggtttaactggctcacagttccttaggctatacaggaagcatggcagcatctgcttctggggaggcttcaggaggcttccaaccatggcaggaggtgaagcaggagcaggcacctcacatggccagagcaggggcaagaggtgggaggagtggggggggtgtcacatacttttaaaggacaaaaactcacgaagacagcaagccacgagggatctgcccccatgatccggacacctcccacgaggccccacctctgcatcagggatgacagttccacctgagatttgggtggggacaccgatcctaaaccacatccgtggatttaccagcagatgggagattgcggaagtaaggttagagagcatagaaattggccaatttgaagaacagataaaagatcgaaaaaatgcataaaggcttaatggcttatggaacaatatcagagaccctaaacctatatgcgtgatggggagagaagaaagaatggaacagaaaaatcatttgaggcagtaacagccaagttttcctaaatttggtggaaaacatcaacatttaatccaagaagctcagcaaatttcaagcagaacaaatataaacagaaccacacaaacagaacagaccatatccacctaggcatatggccatcaaacaccagaatcaatgacagagaaaatcctaaaggcaagcagaggctgacaaatccattatataccagggaacaacaatgggaacaacagctgacttagcaaattccttagtttggcctctgaggcgcttcccggtctttcaccaaatctccctcagattagccaatttctatggtctctaaccttctgcaatctccagtctgctggtaaacccatttactagcctcgacctcctgggctagtgtccaaaaattccctgtgcctctgtcctcctaaagacacgtgcagccaagcaccttgccccgcgctgagccctgcctggaatgctccctgccttagacccccacagcagctctcggtccaaaacagaatcctccccagtctccaggcccattcacgtatcctctgcacgccctggggaggattcacggcaccccctgagctcctactgcccacatgaatgccacagccctggcagtagctgctggcctgcgtgtctgcctctcccagaaaacgcagagtgcatcaatgctgggaccatggcatcttgcctttctctcaccagcacccaggatatctctgtggtggggcagggtgggggtcccttgttaaagcaggagaggatggtcacagtccctggagatttgccattgtgccactaacttaactgatgtaaattcccttgtcctgattcccctaatgcccacctctccccacccctggcccaggggtccctgtcccaaaggaaggcgcttttagagcacaggcacctatcgtcctgttaacatctgtttggctccaaactgactctcttctcccggtctaaacttatttctcctctaaccctggactatccacaagtttttaatagagctgtacacactatctgcagttcccaggtgtcctgcccaggaccttgccaccagcacaggccttggccctttaagtgggtcttaatgtggctgatggccctgaacaaagctccagctcagtggggttgagtggagacccatgagccggctctggaggcggcccaggaaccggggcttgcattgcagagctagggatccgctcccaggaagttatttgttcctttgcatgggcttggctagggacagccagtggtgaccagctctacattcctgggcccatgagttttcctctgaacagctgcagtcagagccacccttgctggccttgcatacacattcacactcatagacacccatgcgtgtgcacactcacaaccctcagccccctctccagtcggccccctccaccctcccgggctctcgcagcagcctgcccctgggccgcgaaacttcttcctcctccctttcctgggccacgtgtgcctcatggaacacagatgtggccttgtcactgtccagttcacacccttcaaaactccatgttcttagaaagcaacctgaccatacagttaatccaaaccggagcccttaggagtatgaaatttagaaaattcattatgagtgtgtcattagttaattgttaggccgggacagcaggtgtcacatggtgggactggactggacatatggggccctatagtcacccctgagggagccccaagctggtacgccatgtcccctcatttctcctgggtaggctgttccccagctgaacctttgccacaggtggttcttttacacatgcctgtcccggtagtgtccccgtctcccttggcccctgggtacattcattcacctttatcctccagggtttagcctcgtggtccccaggtgtcctgagcctgtgcttttcgctacctggctgtgccgatcacgagcccccagccaggattttgcctgtgtcatgtgtgtttgtgccactcagcatttgcctctcacttgtgttgcacatgtgtgcctgcctgtgtgtgcatttgggtcgcccatcttccacctggatcagcccttaccccgcttgaactccgtaataggtgagggttcacttctcatgtttacccctccctccgcctccactcacctgcaggagagaaataccttctaatgggtgtggacactggaggaactgttacattaaaagtgcataagaggcctggcatggtggctcacgcctgtaatcccagcactttgggaggtcgaggtgggaggatcacttgagcccaagagttcaagaccagcttgggcaaaaatcccaaaaaaaaaaaaaaaaaaaaagggcatggtggtgcctgcctgtagtcccagctacttgggagggtgaggcaagaggattgcttgagtttaagaggtacatgctgcaaggacctgtgatcctgccactgcactccagcccgggagacagagtgagaccctgtctgaaaaagaaaagtgcataggaaagtgattttcaaaggccaatttaaaaagtaactggttttactggttttatttgctgcgttttatggtatgtgatttcttcacttgccttccttcctagcagggaaggtttttttcttaatgaagtatggatgagagtggctggtgttgtgtggtatagggctgtggttttatataaatgaaaaaggcaaagtgagaaaaagaggaaactagatggctggttgggctgtgccctttgatgtcaggctgaagccgaagaccttctgcagcgccggtggcgcgctgctgccccctgctggaaggtgacctcatctactcacaggccctgatgtctttttcacactcttctgctctctttcagaacgaggtcaacgccatcaaatgggatccgtctggaatgttgctggcatcctgctcggatgacatgacattgaaggtagagtcggcatggcaaggggtgggctgtttaatcctagacaaccccgggcacttgatgccagtctcacggtcactcttacatgaggattatttattactgaccaccctcccttcctctgtcatccggtgagctacgatttctcagtcatagtcccactgagaatcgcagcctccctgcagcctttctcaccactgtgcaccctccaccctgccctgggccccgtgtgcacccccgggaggaatgattccacatcgttcccggatgcaggaatggcttttgctcatgttgtgtctggtgtgttctgtagatctggagcatgaaacaggaggtgtgcatccatgatcttcaggctcacaataaagagatctacaccatcaagtggagccccactgggcccgccaccagcaacccaaactccaacatcatgttggcaaggtaagggcaggcaacacagctggcacagctcggtgttacacaaagacaacaggaaattctgctaaagcgcgtccatgcacgtgtgttgaagcccttcagaggaagcaaagcggtagctcactttgaaggggccaggatagaattaccgagtaacacctgcctttgaggtaaggatggttttgagtcaggcacagtggcttacgcctataatctcagcaccctgggaggccaaggcaggacgatggcttgagcccaagagttcaacatcagcctgggcaacatggtgaaaccccatctctacaaaaacttagccaggcgtggtgacgtgtgcctgtagtcccagctactcaggaggctgaggcaggaggatggcttgagcccaggagattgaggctgcagtgcgcggtgatcacaccactgcactccagcctgggtgacagagcaagaccatgtctcaaaaaaaaaaaaaaaaaaaacagaagaagaaaaaaaaccacccaacatgactgcagagccacagttgagggacagcaagccaggcagcaccaactcctgttgacggtgctcgaattaaggtcatctcttagagaggacaggatggaattcctgcatccactgagagacggaaccaaaaaaacaaagaacacataggccgtaattctcatatttcaagtaattgtcataaaatccacttaaagtactgtgatatagtgtgatatagtactacacactcgagttgttttgtgatgactcagaaggtgcttttgcgtcgcgtggtactattaggagcataaattatccttttagtcagcaagtataaaaggggcatcccggtacctaatgggtccctgttgaaagaaagcaagccagacaatagctttgtgatagatattactgttctaagtttgaaaataactaaaatttgcagctttcaataatgtgattacgtatgtggatgtgattgtattttaattcttgtttgattaaaatttattttctatttagagacagggtctccctatgttacccaggctggtcttgaactcctggcttcaagtgatcctcccaccttggcctcccaaagtactaggattacaggcatgatctactgtacctggcctaaaaagttttttaaatgtttattcacttaatttgctatttttccaaatatggctgtctgtattaatttagttggtaataatagatgtcatgttttaaattgtaggggcattttaggaaacttgataaatattctacaaaaatatttaccatttacgtctataggaaacatagaaacagggctgggcgcagtggcttacacctgtaatcccaacagtttggtagggtgaggcaggaggatctcttgagcccagaggttcaagaccagcctgggcaacacagtgaaaccccgtctctacaaaaaataaaaaaataaaaattagccgggtgtggacctatggttgcagcttctctgctgaggctgaggcgggaggatcacttgagcccaggagttcgaggctgcagtgagtcatgatcacgccactgcactccagcctgggcaacacagtaagaccccatctcaaaaaaaaaaaaaaaggtgcagaaacaaatgtagatatcaaattgtttccctaataagaccattaaagctttttttctgtttaatgactatggctttgtttttaatacttgtaagtagttacagtttagaagacaaaaagctttttagttattatcttttgaaacgtaaaagctgggaaaaacaactcctggagatctgatacacattatggagaactgtttgaaaccaccgtgtgtatgtgattttgctttctctcccaccttgctagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcaggtaagctcccgacccctacaccaaatccttttagtaagggatgcccaaatagccacgactccagtgcccttggctcagagcagtgccccggagggagttgagcaagctcaggctccccgggcagacccagtggatgctgtccacgtgcaccccacgtgggctgtcagctcttcccccaccagacacctccggcagctcccctccctgaggaagggcgtcgtgtccaccgtaatcatggctcttggccatttgattccaaaccctcaccttggcacacgttcttccttgaaggagccgctgtcttctgttcacttttctgagtccatggcacgaaaccttccacctgcctcttcctcttcttagcagttatcaccgaagtgctgctctctagatactgaggttagaaggtgggagtgggggaccagctaacggggtcaaggccacaccagctcctgcagctcccttacggagcagaccagggagtgggaaggaatgtgctcttgctgttgtcatgccacttcaatttttcttttctgttttgttttgttgttgttgttttttgtttttgtttttgtttttgagacggagtctcactctgtcacccaggctggagtgcagtggcgcgatcttggctcactgcaacctctgcctcccagattcaagcaagtctcctgcctcagcctcctgaatagctggaattacaggcacccgccatcatgcccagcttatttttgtatttttagtagagacagggtttcacatgttggccaggatggtcttgaactcctgacctcaggtgatccgcccacttttgcctcccaaagtgctgggattacaggtgtgagccaccgtgcctagcctcaatttttcaaatcaaagtaggttctgtttgaggacataaggtatgtcaatattgggttgtccttttagcagggattgaaaggacataggatttaaataaaggtggctgctgtgggtatcttgggccacacctgaggatagaagaattccagctgtaaagtgtagaaatggatgggaagtagcactgcatagcataaaggattgtatagggccatcagcacgtgattctagtctaagggaagagagaggtgataatatgctaggagctgttgaaaataaggaaggggtccctttcgcctcaggaggggaggaatcacacagccttccccctgccccctttcatctgcactgccttcttggttccttttggcttggttgacattcaggtggatttataccctcaagttcattccccctgtggactcaatggtgatgagccctgttcactggcaaggggtccactgagatcacaggcttcccagggacctcatgtgaaccacatcctctcagggaaggaagggaaatggtggaccctgcgtagagccaacccgacgccaagcccagccccacagccctagatagctctccgggaagcacgcatctcagcactagtgtccaagagtctccgttcctgaaatcctcgctagaaatagtaatgggtggatttgtaaaaagaacacatcaattatcaaaacaatgacatgatcagttaggtacagcctgttgtcaggaactcactgaactgtttcaacccttttttataaatcaaagaaatccttaggacttttcttttttttttttttttttggatcggagtttcactctcgtcacccaggctggagtacagtgatgccatctcggcccactgcgacctctgcctcccgggtttgagcgattctcctgcctcagcctcccgagtagctgggattacaggtgcgcaccaccacagccggctaacttttgtatttttagtacaaacggggtctcaccatgttggccaggctggtgttgaactcctgaccccaggcaatctacccacctcggcctcccaaagtgctgggattacaggcatgagccaccgcgcccggccaagaaatccttaggaattttcttaagagaaatcttaaagcccactttaatctttctccaagtataaaaatacttatctgtaatactgccgacacacacctttctcagttcatggaacaccaccctttaaggggcccaattgagcagaggatttgggacagccctcctggtctcggtgttcagatttctcctgcctgtcaccatagtgaatcatgagtgaaggcttattcgactctttctctcttttttattttttaaaattaatttttgtagagacgaagtctcactgtgttgcccaggctagtcttgaactcttgggctcaatccgtcctcccgcctcggcctcccaaagtgctgggattacagggtgagccacctcgcctggccttattcaactctttcaaaggcctcaacttcccctacctcttagatttgtcaagttaatgctgttttaaaccggaaaccaatggtctgtggtgttttccattacatgtatattatgcatttcttctttcaaatgtccaaaaatacgtacattttaatgtcatggcatattattacatttaatcatgaattacagtcaatttaattgctactggggtgggtgtattcattatgttgtattcattcaggtcctccaaagaacagacaccagaacaggattagatgggcgagagatttattgggggaaagagctgtgatggaaacagggaggaaggtagggggaagggagaattcagaccataaggccagtctgaccctgggaaggagacgggaagggtaggaagagtcagggatggcccttacaggtctgtagaaagttttggtcgtgctgatggagagtccatgagccacttacccaccagatgagtctgagtctcagcaggtgactgccatggtctcccgcctccatcagtcctcagctgggtgcagcctcagaatccacgcaaatgtggcagattccgcaggcataagtaatcaggttcactcctcgtggtgggaagtcctagaggcacatctccatggcccccagagtccttactgaaaacccttaaatttcaccatgcttgaaaatgttcatgacgaaacgtcagggccggaggagcgcacattccacacctgcatctgtcgcaggcgccccttgcgttgtaagtgacagctgctttgctttgcagagtggaaatcttgtccacagctaccgaggcactggcggcatcttcgaggtgtgctggaacgcccgaggagacaaagtgggtgccagcgcgtccgacggctctgtaagcaacacctctggtttgctggggagtggggtgttgggggcagctgatgcctaagtgagcttccagggcgtgtgcagcattcgtgtcctgaagggcctagcccagtgccaaaggaagcttctgggctggatcccatcggagttggtaccacatctgggaatggccttctccttgtcccttccagagtgtccttctagtcaacattttctcagtcaaattggtggttctcaaccagggtgattctgcacctctaaggacattagacaatatctggagccattttaggttgtcactacagtcatgtgtcgcttaatgacgggaacgttttgggaaatgtgtcattaggcacttttatctttgtctgaacatcatagagtgactgacacaaacctagatgataatacctgtcccacaccgaggctgtgtggtacagcctattgctcccaggctacaaacctggacagcgggtgaccatactgattcctgtaggcaaccagaacacaatggtaagcatttgtgcgtccggatctatctaaacatagaaaaggttcagcagatatatggttataatcttacaggaccactgcggtctgtgcggtgcgttgttgctggaaacgtcattatgtgacgcgtgactgtgcttagatgaggatgctgctaaacctcctactgtgcacagggtggccacaattgtcacccatgctgtggctgagaagcccgggcctctggtggccatcctgcaggtctcctgggccctcttctcttcccatggggcatctggatttcttattttcccctggacttgaggttgccctgacctctggggcaagcggccgttctggctgaacggccaagggtcagagtagtccccaaatgttgtcagaggctgtgtacttgggctcgtattgtcatctgccccacgattgcaggtgtcccttctgggacctctgccactctgttaattcctatcattacccttaacctggcctttctgctctgtgctgtttgcttcagtttgctcggtccgatgtccagatgccagtctgttatgagagcttctctgacccttcatgacgatgttccaataaactttactgacaaacatcggtggagggctagattgggcgtgggggccgtagcttgccgacttctcactctaaaggcatctttgtattgtctctcaagatgacaggtgctttatctttccttccaggtgtgtgttttggatctgcggaagtaaccacaaaatattatcg

SEQ ID NO: 2959 - DNA, 218824 bp, human
cgggggcggcccgggggcggcgcgcggctgctccggggcgccgggccctcttcggccgccgcacggccgggactcggaggctgccggctggagggaggttcggagcgcggccgggcgcgcggcgccgccacaagttgcgctgctcgcgacgaggtgagtgcgcagggctcggcgggccgggcgcggggtccgcaaacttctgcggggaggcgggtcccgcgctgaccctccagggtccggccggcggctcggggcgcccgaacgctccacccgcccctggaactcctgtaggtgcaggtcgccaactgtccccgcggcgctcggactggggtgcggcgcgctcccaggagcctgaacaataccccgaggtggccgctccccgaagtgccggcgcgccttgcggggagagacggaggtcggcggggggctcctttgttttggggagggggaagtggccggtaagtttagggaagcgctcggcttttcctccggtgcccctttgtctgccgattcaggggcttgctgggcaaacctgcgccaccgcgggctccggggaccggggtggagggcggtggcgggatttccccgctgttggggagaagagccccattcatacccgggacgcgggccggccctcccggacccgggtggaagcgcagcctcgcggagtggggcaagcggcgggcgaggtggcgcgggccccgtgtctgctcagtttctgacgcgcagaaactgtcaaggaagtcgggagccccagtcctccgcccatctccccggcctgagcgcacggctgggctgggggcacccttggcccgtcgagggtctgcagagcgccgcccggggagagcgcagacctgttgctgctcctgggctctgacggggcgggtggggtgggtctcgcagatcctgggccccggccttgctatccagggggaccttccctaacgatgggaccggtgctcggagtggagtatggggagtgcgccttcgggagtcggcgctggccggatatgtgacaactgtgggtcgctggaggcccgcctgcgctgggatagggcctggacttcacgtgcgtcgcctgtgttccgtcagaccggggccggggctcgctccctgcaaggcctcgtgttcccccagccagctgcgttggacgttccacaaaggtagggactgacgtttattctcgagtcagtgatgttctggagcaaaacctaaaaagaaacaaaaacctaccctctattgtatttgcaactgtttctgctttgcattgtcatgtgtggtttgacctgccttttggatgttttcctctcctgaaacatcgcccagtccctggtttaacctggaaggcgagggggaaggaaggcaacctccctgctaaggttccaggcagtggctttggtgttggaagtggcacttgacgattttatgaaaagtttacaagtccttcctagaaaagatgtaattaggaaaaataaaatacagaagaacgttgagtatgacgcgtttattttaaagggtagtcctgtctcaaatgtgctgcacatttttgtggaaagccaccaagctgggtaactaatgcaaacaacaaaagttgttcatcactggatcaccggcccttaaggcgattccagcccttagtagaacacacacctgtagggcaaatatggagatttgtggtgtagtgctgccaccctcgctccccaactctcaggcattttgcccctttacctcagagaacttctctctgtcagtggttttaaagaggaaacagtttgcaaaaataactttattgtagacatacttagaagtgaatgtttcaatttctggagttttcccatcaattatatcagtaccactggttctgtacaacatcatcttagttagaagattttttttcaccttttaaggtgacgaacagaggcgggaaaatggtccctgcagagggaggccatctccagcaggtcccgagggtcaggaattcagattatccgatctactcctgctggataggagcacacctccgctagaacctgggtccggccccctcccagttttctgcagggcgtccagattccggtgctctgccccgcagcagtgccctgtgggcctcctggcttagctgatcagcacagcttctctgcccagcgaggcaggaccatcctcccactgctttcctgatgccttggatttgctttttttcctcccttaggaaaagcaaaaaaacctaatatgctacatccgagaagttgttaatctttcactaccacatgcattgaaaaatcagttccacccaggaagcaacactaaaggcatattgtaaacacttttttttttttagttggaaagataaacttttttcccccataactatttttagttagccggagactggactcgagtttttacctccggtcttgccccctccactcccgccctcactttctgtggggctcgaccacatggaccatgctggccagactggcaaacatgaaacccaccagaaccaaaagaaaagctggatatgggaaggggccgaagaagtccacatgtttctaaagggcaaagagcctaggctgaggagagacgtttcagatctccaggggagaaagacagccgttaaggagtccgccgggctgctgcctgcctggccagcgggagcctgacttcagatgcctgcgcctcccaagctggccccctcccacacagccatcgccatccagtatttagggagaatccaccgcatgcctgaaggttgcagaagtgaattggaaaccgttacaaatggaattggaacaaatttaaagttaagatggaagagagaatatgttgagttttcagaggaagtcgggtactgcttccttttcttgtctaggtttgttcttgtccgatgggatcagagagatttgagatggggcatgataggcggcgggttcaggagaaagggaagctttagaaatgaaggtagaaaagatgcttgcttattggaacagtattttcaacgttgagctctggaatgttgcagccaactaatggttctcatttgggacagttttgtcccccacttttgaagggagcatttgccaatgtctggagacatttcccttcctgcaactgttaaattagcaaacaggttgagccagctgggtgtggacctgcattttcctcgtggaggccctcttccaagtgtcagtaggaaaagggctcccagagtgtggtcctgctgcgggaccttggcccccacgtccaagtgagccccagaggtgccccaagccctgcctggtcatggggaatctgggctcccgctgaacttgggcgctggggacagctatgagggaaacctggtttgcagctagcttgccgtgcactgactggagctttgggcaaatcagtgaacttctctaacattaattttctcattgagagaggaggtgggtaggagtatatatatatatatgtaattatatatataggggtcgggtagagggagagagagatttcccaggctccttgtattaaaggagatagagttattatatttctcatttagtttttatttatttgtttattttgagacagtgcaattattatagctagctgcagcctcaaccttctgggcttaagcaattctcctgcctcagcctcctaagtagctgggagtaccaaatgcgcactaccatacctggcaatttttttatttttatttttagtagacacaggctctcactgtgttgcccaggctgctctcaaactcctgggctccagtgatccttcctccttgacctccccaagtgttgagattacaggtgtgagccactttactcagtcgaccgacatagaattattataatgcttggagcctaacatgccttttttgtttgtttgtttgttttttctgagacgaagtctctctcacagcccaggctggagtgcagtggtgcgatctcggctcactctgcctcccgggttcaagcgattctcctgcctcggcctcctgagtagctgggattacaggcatgctccaccacacccggctgatttttgtatttttagtagaggtggggtttcaccatgttggccaggctgggctcgaacttctgacctcaggcgaccctcccgcctcggcctcccaaagtgctgggcttatgggcatgagccatcgcgcccggctagcctaacatgcttatagtttcctgttttctgaagttgggaattgggtctggaaaggtatcaccatcagtcacgatggtgtctagtagtttgctttgtttttttccttatcttttccctcttacattttagggctgtatctatataattttattatttaaattaccatatggtaagtttgtctctttgggtgcattatgagtcttgacacatgcatagattggtgtgaccaccatcatcatcaggagagagaacaatctcctcagcccagagatgttcatggctctgtctcccacagttcctccacagtcaccccccccagccccgaatctggggcacccagccatctgctctgctctggaagtcttggggatcccatctgaatgtaacacatggtggaatgccttaggtgaatccatccgctcttccagtaccacctttgcctcctctctctgatgacacatgaacttcatgcctttgtgtgctttggccaaccgcttttcttagaacagcacattttgcactgtagatgttatcacaagcaaggaaaaaacagctttgctccttaatgtaagaaaccacagtggaaaaacatcaggtgtgttgttgaggctgctaaagctttgctcctttttaaaattttttaaaaatttttctggatacgtaggtgtatatatttatggggtgcattagatattttgatatagtcgtgcagtgtataatcacatcatggagaatgggggtatccattccctcaagcacttattctttgtgttacaaacaatccaattatactcttttagttatttgctcttttttcttttattttgagacggagtctcactatgtcgcccagggtagagtgcggtggcgcgatctccgcccgcaagttcaagcgattctcctcctcagcctccggagaagctgggactagaggcatgtgccaccacacctggctaatttttttgtatttttagtagagatgggtttcaccatgttggtcaagctggtctcaaactcctgacctcaggtgatccacctgcttagcctcccaaagtgctgggattacaggcgtaagccagcacgctcggcctatttatttcctctttgttctatgccagttagttcttgatgcctcattgtttcagatgggacattttctaatgtcgtgtttttgtttttgtttttttgagacagaatttcattggtgtttcccaggttggagtgcagtggcatgatctctcctcactgcaacctccgcttcccgggatcaagcaattctcctgcctcagcctcccgagtagctgggattacaggcatgcaccaccatgcccggctaattttgtatttttagtagagatggcatttcaccatgttggtcaggctggtctcgaactcctgacttcagatgatccactcgcctcggcctcccaaactactggaattacaggtgtgagcaaccatgcccgacctctgatgtccttttagaggatgttaccctcacctttattgcacagtcctaccaaaaggtacttcatatgtgaaatgtatcagaaggttatagtcatggctttagtttaaaaacaggatacatgttcattaaggacctttgccgttttcccaatgggttaatcacgtaaatataaaataggctaaaaatatcaagttgtttttgcctttgttgtagaaataaaaaaatgaattcctacatctgtgtttctatggagctgctaacctgtgttttactctgggccatatgtcgctttctgtgatctcatgacgtggcatgttttctaatataatccttgtcctggcattttggtgacttttgtcctgcctgaggtggtctacctggttgtgtgaagtcacagaacctgtgcatgtcctaccgtgtagagttaaagggctggatgagtggcctcaagccttttcctccctcccaggtgtgaagatttggtttggaagatggaccctgcttcaaggtctgggaggccatgtttttttcagactggttaaggatgacggttttatgttaactaaacattgggatcaagtgacagttgtttatgtccggtgcctagagtatcagttttcccatgattaaaataagcgatattttggtaaacattgataagttagttgcgcattttagttcagaaacccacagcgagtcagaaggcgctttgtgctgctgggcgcctctgagtgattccggggagtgcggcagttctccagccccaggagaccctgtgaaagaagcacaaacaatgctcacggcaaaactcacagtgtttattcttgacctgggtgtctgccttgaattcttgtcatttttcctatcgtggtggatgtagccggaatgctttaaagaaaacatgagagttttttctgcctgtttcccttgagcctggaaccgattatgaccccagatagcctgcacagggctctttcctttctggaacacctgcccaggctagaatatgggagtagggaggaggtgaggctctctcctgcccggtaaccttcccggccagctctccaagacgctgaaaccttccttcgggtctgttgaaactgcatccccagcaccatcatgtcggagcaagaagagaagggcatgtgtcccctttaggcttgactctttccaattagggacctgcctgttgttaggatttagagtccatgtgaatgtgcagtattgttcagtgctgcgagcatttttgcttgtctgaatttcctgatagaagggaatttggacaaaaagaagcttattgtacatggtgccattttattccttaaatcaataataacaaatactttatttatgtatttttagagatggggtcttgctctgttgccctgatcatagctcactgcagccttggctttctgggctcaagtgatccttctgcctcagcctcccaagtagctgggccgacaggcacaagtcagcatgtccagctttttttttttctttctttttttttttttttttaattttcaatttttttctagagattgggtcttgctgtgttgcctaggctggtcttgagcacctggactcaagcaatcttcctgcatcggcctcccaaagtgctgcgattacagttgtgagctactgttcctggccaacatatactttaatatggcaagaccatataaaataattttaagaggccaggtgtggtggctcatgccccccagcactttgggaggctgaggggggcagatcacgaggtcaggagatcgagaccattctagctaacacggtgaaaccccgtctctactaaaaatacaaaaaattagccaggcatggtggtgggcgcctatagtcccagctccttgggaggctgagacaggagaatggcgtgaaccatggaggtggagcttgcagtgagccaagattgcgccactgcactccagcctgggtgacagagcaagactccgtctcaaaaaaaaaaacaataattttaagaactggaggaaaattcagcaggactgagtcgtgatttcagtttctggtgcactgtgggtaattgggtaattgtcagcctggatgcttgtgctcctttagttgtcactgttaccttgtcatctatgtgaagatgagaaatgaagttgagtggagaactgtcgccaaagtctgccatgtaaaaatcggtagtgccaatgtgcaaaggtaattcccaggtgctataaaagtccaggtggcttcacagtttcagattgtatttcccgaaagcgtagagaattgatatccctgaataggaaattgacgtccctgccatttggttcatttggggaacagaataaacttgtgtccttgccttcagttcttttttcaacagaatcttatcaagcatttgaatcgtacacaactgtaatgccagctccatgttgataaaaactcaagaattcaaaattataaacttgaaaacagcaattgccaacttctgacagtagcaggagagtctggaggacctgttcagaggaagtcgggtactgtttccttttcttgtctaggtttgttcttgtccgatgggatcagagagattgagatggggcatgataggcggtgggttcaggagaaagggaagctttagaaatgaaggtagaaaagatgctttcttattggaacagtgttttcaacgttgagctctggaatgttgcagccaactaatggttctcatttgggacagttctgtcccccacctttgaagggggtttggtttaattcccaatttgattatgaagaaaataccagattcagcttgcattttcaagacacagtggttctatgtcaacttcagccatttccagggatctgtcttaggatacttcaaaaagcctaacctttgagatgcactcagctcataagttcgtgaaaataagaatgaataatcttccctgtccagtacatgacagaaattattgtagaccagatgagagcaaggagagatacttgttgatattacatgtcacgggatgctctgttaaattttatgggactctgagtgtaattcctttaagccagtagtctctaaatttgggggaaggacaggggacagaaatgacttgtttcagattttaattcccaaaagggtcttagtgagtttcatgccctctggcaggtgcacagcaagatttattgggatgcaggaagaaattatgaaaatgtccattaagaaaatctctaatacttgtaaaaaatatatttcttgtccatgaaatgcatgttacttgagtattttatatatttaataaattacatgagttaggagcaccttctgaaaacttttttgctgaaaaggatatatgatgaaagaaacatttatgatgtaggtccccaaaggctggaagagggggtgataccaacgtccctgcctgcaggtaggacacagttgtactcccctttcctctgacttcagctactaaggtatgtgtgcgtttgcacgcacatgtatgtgcgttaagtaactttgagatccaccagcttaaggactggacatcgttccagaggtacaggtattagtgatttgacttagggaagaaagaatatgcaataacagggaaccatgcacatactggatctattgtattttgcgtgttgtttttaaagctgaaaaaatgcgcttgtttcggaactagatgacagtacctgtttgcaggtccacaaggaaaccttggaacaatgctatgctttttaagcgttttatgactgcattgttttcataatcactgaattctgtttataaatcagctgatttcattgacggatgccctcagggctctggagaattaggcgttttgctgcagaaatggttcagaatttcaaagacatcaacgtgagattgtactggaattgagttgtgataaaagtcctagggtgctttaaatctttaaatctggttatttgtttgtttgttttttgaggcagagtctcactctgtcgcctaggctagagtgtagtggcgtgatctcagctcactgcaacctccgcctcctgggttcaagcaattctcctgcctcagcctcccgagttgctgggattacaggcgcctgccactgcacccggctaatttttgtatttttagtagagacggggttttgccatgttggccaggctggtctcgaactcctgacctcaggtgatccgcccaccttggtctcccaaagtggtgggattaccggcgtgagccactgtgacctgctgtttttgtttttgagacatatttcatctatcatggttattaagtgttttgtttttttgcatttctcattggtgttttttgtttgtttgtttgtttttttgagatggagtctggctctgtcgcccaggctggagtgctcagctcactgcaacgtctgcctcccaagtttaagcaattctcctgcctcagcatcccgagtagctgggattacaggtgcccaccaccaccacgcctggctaattgttttatttttagtagagatgtggtttcaccatgttggccaggctggtttcgaactcctgacctcaagtgatctgcctgcctcggcctcccaaagtgctggaattacaggcgtgaaccaccacgcctggcctcattaggttttttttttttttctgagttgctgctacactactggtgttacagagtgaataaacataaaaattatattcacaactcagaccacattgtgggctgtggaggtgagaaataggaatcatctctaaatttaaggtcttctggctgagctcatttgcttagaatggctgaaggtttggttttcatgagatgaaatgccaacctcaagtggttctgggtttccagaccagtttttagtttgtttaacttgagagaattgatatgtcagctttagtttttgtgtgtaatttttggtgtttgcatctgttttcttctttgtgaatattgaattcgcaacataactttgttatatgaaatgatgctcatacacttgcgcagtgcattagaaagcctgccaggagcagtacttgtagatttccgtgtaccagcaggatgcctaatgccgaccatgattaatgctcatcagaatctatgtagacctccatttgtcctttgataagctgaaatatttgtgtctactttttaaaaaacctgttgcttctctttatggtaatactcagaaggcactcactgtgaagagaggagaaacaggaagtagaattttttactatctagattgatgcacctatctcccctctccagagaccaatgcatttaggccccagtaagaaatttagttgtaatgaaccataaagcagatgcagagtatatttgggaatataccttatctgactccacagcccaacccctttaagaggaaagagatggcacaatatattttgctttaagccttagactggtcttgacttcatattggaaccactgaattgcttcagctgtgaactggaatcctctcctgtctttgttgttgagtgatgacactcttaattaatcatttgcttatttgccatccaaatcaccctatataatctttcagaagtgtatctcagagaatgaccctaagtcggctgacctctgaagcctgtaccagaattgactttatttcttaagcgcacacttcctgtgctttcaaggggcagctgtctaggtttagtttctgggagtttgaggcacagaggtatgtaggggaatgggaaggccaaatggtaaaagcccctgggacgtggaatctgtgagtacactaaccttgaaagagattatgaaaacaaactttagagcattgttgaagcaccatctacataatttatatcaatgaagacagtaacttattaggaagacaggattattaaaattaaccattttcatctttctacaaaaataaaaatcaaatcaattttagttcagataattgtatgtgaagctttataagtgaaaatttgaagttagcaaaattatataaccttagttaattatattagtgtactcaaactaaatatagaataagattagctcatggaaacattgcatttttatctcagtcagtactgctcatatccacccagtagttagtttctagttacgttttgtaattttttgaatatcctggacatggttttagaaaagttagttgaaacaagatattgtatgctttcattatttcccagttcatctttaagcataataaaaacacagagtaagttgtcctttttgaattttctttcctttctaatatgtgtctggcacaacagaggaccaagcccagggatcattaatcccatttttctgcatggcgtttgctgtgagagaagtttgggctggattcgtagtttgctatctaagagtaaatgttcaaccttctctaatttcctgttttgtttgcttttccattcagtgttctatatttggacaacaaatatatttttctgtatgggtttctggtggcccagatgttcattggagtggaaattctttctgtccacaccactgagttgggcagttactggtgtttggctttctctatctcttggagttgacttagatacattgtgtattcaggttgggcactcatcccctttgcaagctctattactttgttccatttggctttgccataaatgtttgcccttggcttgccaagacgtcagctttaagagatatgtcatttaacttagaactcttgagtctgacttaaaattaagtcagttttcttaaacattgttattgaggtataaatgacatgccacaaaagtcacctctttgaggtgtaccattcagggatttttggtaaatttactgggttgtgtagagatcaccatgatgcagttttagaacattttcaattcccaataagatcgctcctactcggttctcacccatttctgctcccacctccagccacgggccaccatgaatatccttcgtgtctctatagattccccttttgtggatattttagagttgtgcttccaagaatgagtatctctgtgcttggtcgaacttcccggatggtgagacctgatttagtgactttgccttccgccccttcatccccaggagaggaaggtggggaaaggggaaagacggcaagtatagtagtataacaggcatcgtgcctcagtttcctcatctgtaaaatcaggataaccatggactagtttcaggctctaaatgtgaaactctgtaggaagtaattagctgggaatctggcatagaggaggagctcattgtttgcgtgttaacagtgggaaatagttaaggaggtgggaaaagagctacctgtagaaaggtggcctaagtccctggagagctgagcacaggaccccagggcacacacccccttatgcttcccctgtctttcatcttgaaagcacctgcctgtgaacctcaggcttggagggaatctggatgttttcccaggatctacctctgctctatggtcctcaatccaaggtagttttgaaaccgcctttgcaaaaattatatcaatgagaaaattataacagtatgttaagctaacccatcccccatcttgcctttcccttaatattcttgggctattgggccaggtgaactttggaggacttttaggctacggtttaaatgataataggccttgtcccaaactcaaaacttgccccaaactgtaacactaatgggaggccatcaggatgggggaggagaggagcctgattgctgctaaggcaaagacatgaaccattgccagattgtcaaatacgcagattcccagttactcccgcagataacatcactgttgtagaacctaagattggccttttgagatatcttttcaggtttttaaaattttcttttctctgaactacctttggggagattctagatcttttaaaaattccttaccaactctttggagatacctcctgcgttcatggttaatccatccccttagttaaggcttattgattgcacataggaagttccctttagtaaaaggttcaaaagctagaaatgtcctggctgaaatccggtaaaaagagattttaaaatgatttttcttttgagagctctgtagttagaaatcgacttaattaaagctgatatgtgtacagatactgttttaaagcccctgttctccctctgaaagcttctgtcaatggacttctgtcttgattcttcattcctgtctttctgtgtattcttctctgttatgtagtgtttatataaaacagctctaaataattggcgtaggccaggcgcagtggctcatgcctataatcctagcactttgggaggccagggcgaggtcaggagttcgagaccagcctgaccaacatggtgaaaccccatctctactaaaaatacaaaaattagccgggtgtggtagcacacgcctgtaatcccagctactcaggaggctgaggcaagagaatcgcttgaacctgggaggcggaggttgcagtgagctgagatcacgccactgcactccagtctgggcaactgagtgagactctgtctcaaaaataaaataaaataaaattggcttaaagaaaaataagcacttaaacattgtcagaaaaatggaaactttaatggcttttacatcacatgactctgatctttcaaaaataaggacagtttaaagattatttgtaaagtaaaataaaaatgtcttcaaagttaacacactttgtctaaattaggcaggtcagatactctttgctggatgttttaaggtcataaactgcttctgtgacttttaataattgtttgacttgtctgtcttacagccattagattctaggtaaggtctggggacacatggagttagccggctcccctggctaggctgggaagaatcatgggttctgtagttttatacatggttaaaattgcttatttaccaggtttttcaccaaaaataaaagttgctgaaagttaagattgtaacacgtataattgagactactggagaaacagttttacatgcaaggcgtagaaggaaagtagaatgtgtgtgtgtgtgtgtgtgtgtgtgtttgagatggagttttgctcttgttgcccaggctggagtgcaatggcatgatctcggctcaccgcaacctccgcctcccgggttcaagcgattcttctgcttcagcctccccccggcgtagctgagattaaggacatgcgccaccacctccggctaattttgtatttttagtagagacagggtttctccatgttggtcaagctggtctcgaactcctgacctcaggtgatctacccgcctcggcctcccaaagtgctgggattataggcgtgagccactgcacctggcgggaaagtagaatgtgtcttgtgggaggctataagaaagcatgggaatatggtttttgtaaaagggaatataattttgtctggttcggaggattttaaggatcatcttaaaagagtaatgggacaaaactgaaagtttaagcaagttgaaaaaggtttgtaaagggttcatcttgtaaaggaagttctgtgggtatgagcaagttggctaagacttgaaggggattatttagtttttctgtaggttgaatattttttgtttgacttttgaatgaatgacagaaaaacgaggagagaggagcctcatactgtctttattttgtcctgtttggaaagttgagtttcccctctatcagtgagtgaagatttttgccttttaaaaattcttgagttattatggctaaataaatgacttctagtgacttgggattttattttgtaatatcaagggtctaaacatttgatatttgacaaaactttccaaagtcaaaatctaaattaagccacccccccccccgcccttattttaatctggttaaccttccagatattaaatactgtaaagtccaaaagagacatatttggcttatttgatatattaaaactataacagtaagcattgtcaggtatgcaatagtgtttggctttctttggactgtatttgtatgaatgtgttgttagtatgtgtttcagaattgtataagatttcctgtaattctgatatgttttagtatatgttatcagtaataattatgattgttaagttattgtatgccacagagatgatcagaccttaactgtggctgttctgaaacttttgtcatccacaattgttttactttggttattttcagggtggttttataatcagctataggactgtgacagttttctgataactttggagattgtgacattaaaatagacgaaaaagcttccaaggctcccattaagagctaatgtattcatggatatcgagcagaacaggagttaattacatggactgaagtaatggaagaccgaaataaactttttctggcttttcgtttgaaacattgctcattcttttgtttttcagagtccagaaaaccttttttttcttttgagctatttatagcttttaacaattggataaagtatgctcttgtgaacaaaatctgaagcacatttctctctctacctgatttctctagaatttgaaaactgtttgcaagtatacttaatttatgatgttatagttgtttgttaaatacaaatctgttttcttttgtagcaggacacaattggagacactggttattttaccaaagctttgattggaatggcatactttcagattgctttaaggaatcaaagttgacttacagagccaataaaagccccttgggtaagctggcctcataccttgtctacacagtccctggacaggttcctaagtaaagaatgtcactttctgacaggtccaggagctccaagttatcttgagcccttgaggtgaggaattcacccaattaatacaagtatttgcaggcacagataaatccgtggctgggctaaatgctttgaagtctaatgtgagatttcttagggaataaagttgcagcaaagccaattttaaaaaggagcatatatggcaaataattgttctagctgaccttatgcaaacactcgggccaggtatagtaagaataaaacttattttgcacataaattagtcctaatgtgatttgtctttagtaaaaatagggactggagagagaaattatgtttcagaaaaaaactatagaacacctgttgttagaatctagtcttgttcactatttttgaatttttattattttctgtcatttggactgaatcgtgaattctttctggactacaagtcccaaactaatgctttcaaatttttctttcatttctaacttggcctcaataaaattgctactacctctttcctgaggtcctataagctgaagcttattatgagagaaaaacatgtcagattgccaccaccttcctcgtctataactaaagatgttttgagtctaatgtctggataaattgtgcccagtgttaatctttgttttttttccgtgtctatggaaatgcctcttacagaagcttagcccatctgcagtgccacctcctgatatgggaaacagctgtttaactgatctagtcttaggacttggacactgactaaaaagatatgggacaatatatttaaattcactctttcctgtttatcccagtctctctttctaacaacatatagtctactgttgacttaagtgttgtactagaactgtgagtaagaacattaacatctttgtcatacacccgtgagtacatgcaggtagctgcacggtggtgagctcactcctattcccctgggaccaacccctgcaactatgccccctgtcagcaggaagaagccagagtgatggtcaccctttttctatctctatagccagcaccttaagaataaggtgtatgaaagccaaagggggtattgaaaccacctttgcaaaagttatatcagtgagagaatgatgacagtgaaagagatctgagctaatccaccccccatcttgcctttctcttaattattcatttcccttaattattgcatttcccttagttattccatctcccatgtggtgtggctggccttgtgtctgttaaactctttctctactaaaatgcccatggtctttatgcagccggcaggaagaacccctcaggcggttacagttttgctcccaggggacagttttggttgttataaatgaggaaggtgtgctcttggcatctagcaggtagaggccagggctggcctcctgaagtgcagaggaaggtcccctcctctttcaagagagttatccagccccaaaaggtcagcattgcagaaattaagaaaccctgacttagaagctttgcacctcgtggtagctgtaaatgaggtatttacatcctccatgaagacgtaaggaagttgaaggaataaaaatctcatggggctttgaaagcaatgcaagcatcttttagttttcatacattccatggaagtagggatttttttctaaagcaaaaagaccaacaagactttggagctcagtttagaagaaaaaagtgactttcaaaccctttagaagtattcatttacaaatgaacaatgaaatgactgtgtagatggagaaaccctgagcgccccttggctttgatctggtggtcacgttcatccgtgtctgttccctgaagaaccagtgcccacatttgcctgccttctttacctaactccccccaacaagagctgaccctcctcccatcttctcgcctggttggtctttttcctccctccccctgaagcctgcctgcctctgctttccaccctccgacaagccctgatctgtgctctgaacaaactcctatgcgggtctctttgaagtctttttgcctgcccctaagtgcatccctcccacccccacccaggtgatactgaatctatgtgaatttgtggagttctcccttccttcccctctggcagaatcaccaggattcagtctagagtacaacattatagatgttttctagcacttttcagctgtccatacgctaatatgtagtcttgggtctttatccgaatggagtcctattatatttgtttcacaccatctgctttccttatttttgtatctttactgaggtatattgaagtacagtaagctagacttgtatgaagtgtgcagttttaatctgttttttcttttttatttctttgtttgtttacatacattttttagagacaaggtctcactatgttgcccaggctggtctcaatctcctgggctcaagcaatcttcctgcctcagcctcctgagtagttgggactataggcgcatgccaccacacccggttaattttttattttttgtagagatgagggctccctatgttgcccaggctggtctcaaactcctgggctcaagtgatcctcctgccttggccttccaaagtgctaggattactacgggtgtgagccaccgtgcctggctcgttttttcatacacacacacacacacacccatatttgtgaaaccagcaccacagtcaaagaatatttccatcactctccaaagtttacttgtgcttttttgtaatgtctctccccctccctctacccctttcccaggcagccattggtgggcagtctgtgactattgcattttctagcaatttatattactgaaatcatatggtatgtactcattattttgcctggcgtctctccctcagcatcatgattttggggcttcatgttgttgcacatgtcactaactcattcctctattgctgcgtaggattccttcctgtatggatgcactatggtttgtgtatccattcaccagttgttgaatgtttgggttgtttgttttttattgtgacaattatgaataatgctgctgtaaatgtttacatggctgtacagtggttctcaaacttcatcatgcatcggaaccacctgcagagcttgttaaaacacagagcatccaggcacggtggctcatgcctggaattccagcaccttggaaggctgaggcaggaggatagcttgaaccgagaagttcgagaccagcctgggcaatgtagagagaccctggcactaaaaaaaaaaaaaaaaaaaaaaaaattagccaggtattgtgtgcacttgtagtcccagcttctcgagaggctgcagtgggacaatcacttgagtccaggagtttgaggctgcagtgagctgtgattgtgccactgcactccagcctgggtgatagagcacaagaccctgttgcataaatactccccccaaaaccccagaaaaaccaacacacagagtggcaggccccatccccagagtttgtgattcattgaattaggggctgggttaagactctgcctttctaatgggctctcagctgatgctggtgccaatggttcaaggaccacatagacttcgagggctgctgccttaaaggaagtctttgtaaattatgatagttaatcgtttgttagttgttccaggtatttctcttctagaccattccttgccatgtaatgttgcttatggtttgaagcatcaagctcgcatttttgtgtagtcgaacatgtcagtcttttctttgggcttctgggcatggcttccttccagcaaggggcagataccaagaataacttggagtaggtgaggcaggttttgatgttagcaaaactcaaaccatgacactcccccaaatgggagtctgccctcattgggcctaattgtgccctctgctgcagatgctgggatggccttctgatgggatggccgggctgtgttgtcagcacccgcccacatgagacgagtttgtagctgtgcctggtgccaagagctctgaggtgctactatgccccctggaacctttgggcaaagcatagctagtcatcaggcttgcctttcacaggcaaaccaaatccatcctttcttcatccccctgccctgccaaaatcaaccagtctcaaatcaattcacgaaagggggccaatttgcctttcgggtgtctgatctaacaagccttggagcagctaggaagctaccagaagatgtgtatgatcaatgtatttgttatttattttattttatttttttaagtttggggaaaggtaatacttttggtcaaccatctgaagggactccctcctctaggccagggcactccatagttaacctgaaaaactggttcagggcatgacaggaagggggtttgaacatgcttcattatgccctcctcccttttggaattcatgaacagccgacagcatttaacacagaccttaagtctgataagaaacagttacaatctattttctctgaagcctgctacctggaggcatcatctgcgtgataaaacctaggtctctacaaccccttatggtacctggacatttttttctattgataatagcttttttttttttattattgagacaagtgctgttgcccaggttggagtgtgatggcatgatcacagctcactgtagccttgacctcctgggctcaagcgatcctcccacctccgcctctctagcagctaggactacaggtgtgtgccaccacacctggttaatttttgtattttttgtaaagacggtgttttgccatgttgcctaggctggtctcgagctcctggactcaagcaatctgcctgccttggcctctcagagtacagcgattataagcatgagctaccaggccttgccgataataactctttcaaccagttgccaatcagaagaattttatcccagaacacacaccccccccccacgcccccgccgcctcaagtcttcccacctttctggaccaaaccaatctatatcttaaatgtattttgatatctcatgtctccctaaaatgtataaaaccaagctatgccccaaccgccttgggtacatgttctcaggatctcctgagggccatgtcacgggccatggtcactcatattcagctcagaataaatctcttcaaatgttttgcagtttgacttttttcattgacagagagcagctttaaattactgtggactctttgttgcaaaagcatcttcttgaatttgataataaagccctactcttccagtttgtccctgagtgcattctgcaggtacctccggtcaccgcttcttatctttgctgttgacctcagttcattcctttcagattcttcactcaggagaagtcgtggaacagattcctggaggattccaggctctgtaaggaggcttatctccttaggatggttaaattttggatttgcagtgacttgtaatcattggctaatatcctagtttcttcttctcttttttaatgacaactttactgagcatacacacaactcattcctctaaagtgtgtaattcaggaatttcctagtatttttacaaagttgcacaaccatcaccactgtctaatttttgaacattttcatcactcccaaaggagaccctgtacctgttaagacatcactgccccttccccttctccccagcccccctggcaaccctgaatctggtttctgcctctatggatttatctattctggacatttcatagatacagaatcatgtgatgtgtgaccttttgcgcctggattcttacttcatatttctgagtttcatccatgttgtagtatgtgttgttctagtttcttgtaaatgttctgtcaaaaccccaggtgattaaggaaggtggaacaatgttctgagataagtcagccagagacacaggctgctcctccctccaattacatttaaaatggaaaatcgttcacaaatggaacattgttcataaaattgtttatagttcagcttctattctagcatgaacggtaattttctctttcgcatttgctgtagttcctccaaatttctcccactttcctatacctaaaggtcaacgtagaaaacaattttcgtcagctagagctgggcctgcaggtctctcttgtgttgcatcttttgggtggagtcagaaggtcctttcttggtgtaagagttaggaagcttgcatttcccaaaggggttgtgtggtgttccttccagagctgaggttgtgggattccaagcagcaagacttaggctgttttctacggcgtccccaaagtcacaaccctgactgatgcaggaacagaatcataaggttgtttacttttctgaatttatcaaaccttttgtctgtgtttgaccaaaattacttttcccgggttgggttggagaatatggagggtgattttctgaaaccattcatgggacatgattttctggggcatctgtacctgcaatgaagggcttactgataagactgaaggccattgtactttactggttggtgttataattgatcatattcatttcttgtcctactgtgacaagtgactgcacatttactggcttaaacaaaaactattatcttacggttctgaaggccagaagtctgaaatgggtctcactgtgctaaaatcaaggtttagcagagccacaactttcctggaagctctaggggagaattggcttccttgccttttccagctcctggagactggccgcattcctgagcttgtggccccttcctccatctgcagaggagcagcgtagcacctctctgactgtccttccataggcatatctctctgagaccatagctgggaaaggctgtccacttttccgggctcctgtgattacattgggcccatccggaagatccagaataatccccacatctcaagagacttaatttaatcacatttgtaaagtcccttttaccatataaggaaacatattctcaggtcccagggattcaggcatgagcatctttgggggccattattctgcctactacattgtcagtcttcaaggacagacttacttcctttgtttctgtctcttaatttgctcctctgaagcctgcaagattcataggcttatgtaacgtttgtgttttgtctctcgaataattgagaaatctggtactgttgagccatttggtttgtattgctcactcactgagtcgattgattggttggttgattgagtgattaatagagacagtctcattttgttgcccaggctggtctcaaactcctggtctcaagcgatcctccctccttggcctcccaaagtgctgggattgcaggtttgagccaccatgcttgccctcagtattgattccctctgaatgagccaggatttgctttccattttggagagcccctagattgctgaacagctcagagacacacttgtgtattgaggtcctctttcctgccactcttggttttggactttatcagggactctgccagagctacttttctggacttggagtctcagagtctgtgtcagctgtgggtaaggaatgagaccaccatgaagcaagcagaggtagcgggtggggcctggcttccaggactttgcagatgctgtgtgtggatttctggggcctgaatcaagagcccctgggtttgtggcttcacagaatggtggaggaagactggtggagttaagggacagaagactcaacaataattagcttgttaatcagcattttggctcaaaaatagtttgggagtatactggtcagctttctgccatgctaatgttgcataacaaacagcccccaaattcagaggcttaaatcgtttctttcttgctcactagtcatggttagctgtgtctctcctgggcttatatgggaataggaaggcctggtcaggttctgggctaggcttagggttgaaatgatgtgtctcctcatcaggggaccctggggcatgttgtttgtgcctctcccatcaggtataggaagccaagataaatcatgcaggcacatttaaagtctctgtttgtcactacccctaacatcccattgaccaaaacaagtcccatggtgaggtccagcctccacgggttggggagggctattctagtctgaaagccctgaaaagtcacatggcaaagggagcagccatagacttccactatgggaggatggaagagttagcattgcagtgcctctgccatgtttgtgggtggaagggaaggtgatccctgtggaagagactgtggatacatccagtcataccctagaaaatcagctctataggtggatttttgaagcactgtgtgcttgttatctttttattattactttatttttgagacaggatctcactgtcacccaaactcgagtgcaatggtgagatcatggctcactggtgcttctttcttctgggctcaagtctcctcccgcctcagcctcccaagtagctgggaatacaggtgcacactcaccacattcagctactttttaaacattttttttgtagagacagagtctcatcatgttgtccagactagtcttgaactcctgggctcaagcagtcctcccacctcggcctcccaaagtgcagggattacaggtgtgagccactgcacctagccagggtgcttgttaaacctgcagcttccttgattccatcttagagccctgttctcacctgaggagaggggattgtgccccttggggaacatttgacaatgtcgggaaacacttttgcgtttcacagctgggtgggggttgctcctggcatcttgtgggcagaccccaggggttccactaagcactgtaatgtgcacaggacagcccccctcaaagaattatctggcccaacaaatgtcagttctgctgaggccaagaaaccctgcacaaacaggcaattttaggtgattttcatgcactttatagtttgagaaccatgtcttgcaagactgttccaactgggaaggggaattggtgattctttccatataagtagacacggacacatctaggaaggaaggtttgatatctcgcagatagttgtgtggagaggcgaattcaaacccaagggtcttagttagatctattacttctgtaattaaaaaatatgttctgctcatattgtattaattctttgttgtattaagtatttactcttgctgtttattagtagcttaataaatggaccgtttatttggtgtgggaagaaatctatgttttattagatttctattatgagcttattttttttctaagtggccttttgccagctgtttcttctgtcctgttattcctgctcaccagcaagattataaattcttaaaaaatttgtttttaattttttttttgagaggggatctcactctatcacccaggctggagtgcagtggctcaatcatagctcattgcagccttgaacttctgggctaaagcaatcctcctgcctcagcctcttgagtagcttgggactataggtgcatgccaccatgctctgctagtttttaaattgtttttgtagagatggggtctcactgttgttgcgcaggctggtcttgaactctagggctcaagcaatcctcctgcctaggccttccaaagtattgggattacaggtgtgtgccactgcaccaccgcatcaccgcacttggccagtatatttatatatatatatatatatatatatatatatattttttttttttttttctttgagacagagtctcactgtgtcatgcaggctggagtgtagtggcatgatctcggctcactgcagcctcgacctcccaggctcaagtgattttcccgcctcagccacccgagtagctgagactacaggtgcataccaccacacccagctagtggccagtaagttcttaatagcagtgatcacgctttatattttgtttctactctgcacagtactcagcatacgataatgatcagtcagttgctaatggtatcaattgcaatgtgagttgcgctctgtggttaaagactcatttatgaggtatccgtggaccagccttttatactttgctataaatcctgtttctaggcttttggggctgaatggttggcatattgatgctcggtttctgtgtggcaattaggagaaaaggtccttgtcactggcaagctgacagcctcctttcttctcctaccctcaagttgttttggtgattgaaatgtttcagatattaaaaaaaaatcaagaattgcttgctgataggacaacagaagtacagttcagggagttaaagcttctccattccccacctcaattgtacacagcaagcatggacagatttccttgtagaaagcatgcaagcagcatttctatggaggatgctgtgtcacctgaaatttgctatgctcagatcagccaagtattgcctctgggggctaccagcaagttatagaaataactttgttatgaaatacttctttaagggggtgttagtattgattcactgaagtggttctccttgtgtacatggagtagttgtgagacgaaggtttcttttcttcctggctccccatgtgggaaggacgcttagtggtttgtgggatgcagggagaggaacagagtccatccttcagttgctctttttactaatttattaacttgcctctcatccccttggctgttaagacactaagctggtgtgtctgacaagcagatgacctaaaaattcacgcgtagtaaaagggaagatgaaaatagaagtatatgaactaaattaggaggaggacttggcttcattaaaaaaatgagaaagccatgttgtgctttttttaactgccacttttccaagtgcaggactaacagtttcagatgtcattatgctaccagtcttggtaatttctaatcatgttttgtctaaagaatatttacattaaaatgagccagcctctttaaagtcacattttagtagtgagaaaaccaatgtccgtttttggaaagggagcccttacctcagctggtgtgagcgttttgtggaggtctgcggtgtttgtgacttgtgccagaggccttgagctagaggcaacataagaaggaatcaaacttccctttctgttcggtatgcctctgtaccaagacgttttgttgattgattcatggcacggtgatacagggtgcatggtatcagatgcagggagtggaatattgttgagattggggctagagggtgtgtgtgtgtgtgtgtgtgtgtgtgtgtgtgtgtgtgtgtgtgtgtgtgtgtgtgtgtaggggaggaaggaatggaaggatgaaaccatttgggaatgtgctggaagacatgcttttgaggacaagcaatgcgattttggcattggctgggtttctgagccagtgatgaatgtagtgcattgctatgtgactgggagtgtgatagagagatattccgctggttatttccctccacctgcttcttatcagtgccatagggcagagtctcaattccacttgccagaatgctttctaggaactctttatgctcaatggaggtgatgttttcccacttgctatgctgtgccttagggaacaggaactggtattatcacataagcaatctctaagtcccttggaagattgtctcattcatcaagagggagaggattctgattttcctgcctggctcctccaggaagtctaacttcttgcaggggacctgttctctcggcccacttgtacagcatgtataaaaggaaatgaagacttttggggatttgttgattcacttgtttggaaattggggttatgtaagcccaatttgagttccaggactcatctatgattgcctggattaaatcaaaggacacccatgtaggctggacgtgatggctcatgcctataacccaagcactttgggaagctgaggcgggcggattgcttggacccgtgagttggagaccagcctgggcaagatggtgacattccatctctactaaaaatacagaaaattagccaggcgtggtggtatgttcctggtcccagctacttgggaggctggggtgggaggatcacctgaacctgggaagtcgaggctgcagtgagctgatatcctgagatcatgccactgcacttcagcctgggcaactggagtgagatcttgtctcaaaaacaaaacaaaacaaaaaaaaccaaaaaacaacctgcgtaattgtagatttttgttgttgtttgatatactgtctcttttcctggaaagaaccctctcgtgggaacagaaatgttgaatttagtcctgatgctgtccctaaccaccccgtgacactggtcccaggaaaatataggaattgtctctctttttctgtcatctcagagcttgagacaaatgttctctgaggttgttttagcaccacactgtgattcatcttcgagactgttcacagcccttgatctgaattgatggagctgtgggggatcataccgccactgccagtgctgagagctgcatgtggtgcggtccagtggctacagcgttgtctttgggatcttcacttggcaccacagcggatttgtataattattatgttgactggaacttagagtgactcaactgccttgaacaggaaccaagaaagagaggaaccaaattccagaagagaatttgccagaacattccagcatattccatactctagggttgtcttatagggtctgagggtacttcttggttatctactcatgtgcgtctgacataattaaaggccgacttagaccctatcagagaaaatcaagttcagacacttagtctaaatggaagtaaggaaaacgattacctttatctcattatcttagttctctttggaagatatataagcttgaaccatggtgacaggtgttgcctttaaacatggtgacaggtgttttcctttaaagtccttggcaaatcaactcatagacttcttcaacttcaaaaaaaaagtttttttaaaaaatattttaaaaatatttaacttgaggatcttcattgaaaattggtcatctttcgtgaatttgcttaagtaggctttgatctctttttaaaggattccttcctgcctgatacatttggtccttttagaattcgggctagaacaattctccatgaaggtggacgtgttaaaatctatttggttcattgttaggatcactcacattacaagagaaatttcggtcttgagtttttgtttttgcttatttgctttcttggaaatgtttccacatcaggtcttagaggagttgtaaaacaggaaggaggagttgacatgctgtttcataaccaatgcttgcttctcgccttggatactaacattttttccatccatttcccacataaaacatggagacaaacaccagagctgctcctgagaggtgctgagtcataggaattgaagggggctgttgggccctcgtgtgtgggatgggctcaagagctatcagtctacagagggaaaggttcatctctgtccctcattgcctgcagtttctctttggccctggctttttccgttcacagctgccctcgacgttcattttaatcaaatttcacctgcataaaagggctatgggcagagagtcttctctgtgatggagcgcagctatcctacaagtatgtagccctgatttagtagagaagaggcaggaattgtcgagggcggaggagcaggagaaatggtgcacaagggagaggggataatgacaggtcattcagggatgtctacggaatgtgaaaatgcagcaagatgggtttcggtttctttttttttaggtccgacagagattcctgggatagctgcatcttcatgttgtacacgcatacacttgattcccattattcactggagctatgttctgtaaagtcgctgagactttatagaaagcatcaccccagggaaaatacacagtgaggcttctgcgaacctctggtcacaatgttgttgtcaagcagtcagtgcataactttgttgtatgtatttctattgtgtgtttctgttggttcctttacattgcactcacgccaacagcactgtgactcacgcctggccgaacctcatctaacgcacgtattttccccataagacgcatcccagccttgtgcttcaggacatgagacagcactgcagcatctgggggccattttaagcagcaaagtcacccagaaactacaacatttcaaaaaactggcactgtgaatagactgcgaaaaggacacttgtttacggagtgagagccttgttcaccctcagctgggaacatgtgcatttggtgacacagccacacgctgcatgtttgagaatgaccatgaaagcgctgcaggtactgattttggagctacaaataaatgttagccaataggcaaattcacagacacggaatccgtaaataacaaggcttggctgtgtgtgtatacatagtgtagtgttgatagtgtgtatacacaatacacattgatattttgggagagattttgaagaagtcaccatgaaagccagtgtgtccgtttggccctctggaaagcgtgcggtgaggaggagtcagggtacaagtgtttaaattggggacatggcctgaggagatgaaagagaggtggggactgagtagggaaagctccacaccacaatgcataactgataaggttttggccaacaagccagagaaccctagagcaaagagtgccccttgcttacagccagagggccttgctcagtgaatatagggggctaggagtggggaggcatctccaaaggagcatcgtggatttgcaactctgtctttctggaaaggatatgagagtcttgccctctcccccagggctgacacagttgtaaaccaaacttttgacttcagttgtacatatcaattattttgcacccacattagattgaaccaaatgacactggctcttttaaattaaaagtggtcaaatgctggcagcctcttagggttcaattcaatggaatcttttaaaggtgcaataatgctgtttgaaatgaggagaacgcctgtgttttgtttgctgagagaaatccactatctctcatccagaagatgattagacccataatggaagccagtcagtggcatgaggaatcatggagatgattctcacctggttgattggatcagacgttcctagcccgaatgagggtggaaagggaaccaagagatgaagtggattgttgggtttatgagaggacggtggttgtctgtctatagttaaggttgtttaaactcatgaccatgagaatgagctttttctggataactctttccttttccttctgatttttgagagtgctgaaaactcaagtcctgtatttaaaaattccatcgttgaaaacatgtttcaaggacagatgacacacttatgattatagcatctgaagtgatgggaatattaaataacctttggttggacatgtaaccatcagggctccacttggtcttaaaaccaaacacacacagttcttgtcgttaaagatatccatggcctggcacagtggctcacgcctgtaatcctaacactttggaaagccgaggcgaggggttaacttgagcccaggggtttgagaccagcctgggcaacatggtgaaaccttgtctctacaaaaaatacaaaaattagctgggtgtggtgttgtgtgcctgtagtcccagctactagggaggctgaggcaggaaaatcacctgaacccaggaggtggaggttgcagtcaggcaccatcctgcgattgcactccagcctgggagacacagccagactccatctcaaaaaaaaaaaaaaaaaaaaaaagacttacacagagaaagcctgaagcccacaagagcaattagcaaaaggaaccctgacataacaaatacggtggtgtcattagcaaccaggtagttaagctcaggggttgctatgtgtcataaacttgaaagctacattggccacgagtaacacaaatgtaggtgctaatcacagatagttggtgggcatttcaaactttctcttcatatctatggatacccaaaacagtgtgcttccatttagaaggcttccattgggaggctgagacaggaggattgcttgagtccaggagatcgagattagcgtgttcctccctccctccctccctccctccctccctccctctctctctccctccctctctccgtctcttcctccctccctctcgtttctttcttttttcttttctttctctctctctctgtctccctctctctccctctccctccctccctcccctccttcctcctcctctctttcttttgaggtggggtctcgctaagtttcccaggctggtctggaactcctgggctcaagtgatcctcctgccccagcctcccaaagtgctgggattacaagcatgcatgagccactatgccaggcctattttccctttcctgctatttcctcccagctaacgcgcttttaaaatttgatacaaattaatttttctttttttgtcttttgttcaaataatgatttgatttctgttctctgtctgggtcgcttcaataacatggatacctacacatagttttatcagtaaaggtcattgacataatcagtgtgttgtgagaacaaagataggccctcatttaagctgctccattactcattttataagtcagagaaggaaggggacagcgtcctctgttttcagatggctattgaagtgagtcagagtgacggtgagcagcatgcattgaattctagctggaaagagggtttttaggcctgcgtttgagcttgccctgaatgaataaggctggaaacctataggccctggagaacattaatgaggaatctgctttccctgacagctccttgataaacgaaatgatggatgtgcagcgtgcagccctgagcaaaggcctggcagctctgtggctgagccctagagggctgagctgggccagggctcccagtagtttgttcaggagcactgagagccacagcaggtgctgatccagctcttgccttcttcgcgagtatctgacaagtctgcagagaccgcaggagcctggctactccttgagttcactgtcttggagcaagcctgtgggggaatcacatgcccccccactctagtgcccattggggacatggaggagggagtttccctatttgcagttaggttttgcgtgctgtccgcgagcttggtttcccctttgggttgcacagtgctgagatctgagcccaaggcagttgggacattaatgatgagacagaggaggctttgctgtgttccacatctatcaggctgctttgcccagggagacgccccccttgcttggggtcttgggcttgggtaggggttctggaatgtctcccctccagcaggctctgcctccttggcttccttgattcagagagcagtgcagtggctttgttgaggagcagcccctgtggaggcgctcatgggtgacaggctgtggctgaatagtggacagccctggtcactgacattaacatggtgcaatagagccttcttatgtgttccttggttcccactgccctttcatggtcgggtgtcctgattgtctgtggctagactatgccaacgtgatcagtgtccttcccagaacccctgaaagagggtcatagattgagatgtctgtcaccacccctgtccattgcagagtcacatacatgctagagaccagctcgcccttgatgcgacctgaggacctcgcccgctagtcattacagggaggggaaagacaataaaaagatgaaagagagtgctgtccctggtaatggaagttactcatcattgtaccagtgggcagccacatagggataggtcggaagagaaaggggaaagagtgaataaaaaacgctgatgtttgtgaggccgagagaggaacagaactattactgctggtcaagggggccatccacttaaaatgttcacatcctgtttcagccacaagctggccaagatcatcacataaagggacaaacgttggccccagaaagaacgcatggtcatcttgagtcaaggctgtctcatttgatgtcagaattcttaagagctgctctggctaggtgcagtggctcatgcctgtaatcccagcactttgggaggctgaggcgggtggatcacctgaggtcaggagttcgagaccagcttggccaacatggtgaaaccctgtctctactaaaaatacaaaaattagccggacgtggtggcaggcacctataaccccagctacttgggaagctgaggcaggagactctcatttgaacctgggaggtggaggttgcagtgagctgagatcaggccattgcactccagcctgggcaacaagagcaaaatcctgtctccaaaaaaaaaaaagaactgctcttggctgggtgtggtggctcacacctgtgatcccagtgctttgggaggctgagacgggaggattgcttgagcccaggagttcgagattagcatgggcaacataacaagaccccatctctttaaaaaattagccaggcatggtggtgtatgcctgtggtcccagcaacatgggaggctgaagcaggaggatcacttgagctcaggagttggaggctgcagcgagccatgatggcaccactgcactacagcctggacagcaaaggaagaccctgtctcaaaaaaaaaaaaaaaaaaaagcaagaaaaaaaaagcatccaggtgtggtggctcacacctataattccagcactttgggaggccgaggcaggcagatcacctgaggtcaggagttcaagcccagcctggccaacatggtgaaaccccgtctctactaaaaatacaaaatattagctggatgtggtggcgggttcctgtaatcccagctactcgggaggctgaggcaggagcatcgctcaaacccaggaggtggaggttgcaatgagccgagactgcgccattgcactctagcctgagcaacaagagcaagactccgtctcaaacaaacaaaaaaaactactctccaaacagaacctgcacctacccaattgtggtgggtgcccctcctggggctcctgcagtagcggtggtgtgggaattgagaatcttgcaagtgctatgagggagctgagacactgagtgtggcagggccatgtgcccagagcatgcacaacccatcctaacgtctgccggggaaggtgggggatttctgtgcattgcttttcaaccagaaaggtaatttttgttccccaggggacactcggcaatgtctggagacagttttggttgtgacactgggttaaggagtgctactgtcatctaatggatggagagcagggatactgctgaacatcccacagtgcacagggcggcctcacaacaaccaagaccacctggcctcaaatgtcagtagggctaacatccagaagctctgcgagtctgtgggaagccctggatgccccaatcctctttcattttcttctcaccacgtaggacagtttagctggacagtacacaggactcattcaaggggtcatgagaggagacctcatagcataagggtcaagtacaaggactttgcagtcagactgacgtgggtttcagtccctacccatcctagtggtgtgaccgagagcaagttgggcatagtgacatctgtcttgattgactttggagtttgacaggcagtacatgcaaagttctctattcccatgtcactcagagtgagtgtgcaaaacatactattgttggcatccatcgtcataagagtcactgtgaacatgggtgagcttagcaccttgtggcacggggctgtggtgagggactcagacagctttatgattgagtttgggcctcagcgagatggcaaagctatgcttctcttgctccttggaccatggtgacctgtgaggacccctgggggctgccttctccactgttgcagttcagggagctaaggccaaaggctactgcagtggtggactctggggtccccctggtgacaaggaagggactttgagctttggaatgccctgggctgagtcttgccacctgcaggtttgtgaacctcatcatgccttgtttttagcacaacaaaatgggataatagtgactttattattgatatactattatgctgttttcaggtatgtgacactgctgctattttactgtttcttccagatttccgtgagggtggaagaaaatcataccatatcagatgcctcgcagagcaccaggcccaccgtgaaaggtacagcaaattttacttccctcttcttgcctcgttggaaattctttcctgtgagatttcctcccctccgccctccgcgccttctgccatagcctatagcctcctctgggagttcttggataattttgttgccttatacctttgcaatttccagtatggtagccatgcgccacatgtggctgtggagtgcttgaaatgtggccagtctagattgagatgccttgtagaagtataaaatacacactggatttcaaagacttagttcaaaaagaaagaaagcaaggtatcttattgataatgtaatacagtttacatgttgaaatgatcacttggatacgtggagtaaaatagaatgtattattaaatgtaacttcacctgttttcttttgacatttttttgtggacccagaaaattgatagacaggtggatttccttcacacttacacacttgtcttgctcaagaccagccctgcttcctcactggctgctcagtcaaatgcctcctccagtttaagctgtccatcacggggccacccattatgtgtccatctcatcttctctgctcagtgcctgtgcaggcagctggtgttcctgctcctcccgcccagctttgcttatgatgctagtcttgagtgcaggctgctgagcttctcacctttcttcccatacatgtagaacctctcctccagaaacatggggtacttaccagctggcaaggagcagagctggggttcacattcatttctgtcttgctccaaatccatgtccctaatagattactgtctccaattgctttgtggatgtaaacacatagtaagttcctagagagcagggaccatttttatttctttcatctctgctgttcaagacctttctaaagcttttttgaaagaattaagatttctagtctcttgcccttccactttctgctatgtgaagacacagtgttcctgccctctgccctctggatgctacagcaacaaggtgccatgttggaaggaagcagagaacatccctcaccaaataatcaatcctgctggtgccttaattgtgaacttctcagcctgcagaactcacgaaggtcatcaccatgtaggctgattgatcttggacttccaagcctccagaactcaaatcagtgaatttaaaaacattttatggagggcggggccaagatggccaactagaagccacggtgttgggaggctgctatcagaaaagaccataataagcgtgtgaatccttcatcagcaaccaaggtatctgggttctctcatcaaaattgactagaaggctggcgtgacccacagagagaaggaagaacagtgtggtgtggcggcccacctgagagtcacatgggaaagggaaccccctcactccagataaggcaggaggtgagtgagcacgctacccagccggggaaactgcttttccacagaactgtgaaacccacggattggaagatctcactcgtgaacccacgccaccagggcctcgtgtcccagccccagaacacacagattcttacagcctctcagctggaatccgcttaagcttaccaaactcctcggggaggggtgaccagtaccagctgcagctgcctgctgtctaagccctttgaactcctgcagggaggggcagcagccagcactggcaactgcctaacatgctaagctccctggacagggggaagggtggcacccatttctgtagctacaggctacgcttttcccctgctagagccagggaggctggacagcttggtcccaagacttgtccccacagcccaacacactggctgtggcagtctgcggctagagtgcctcttcaggcccaatcccaacccatcctttcttagttggggtgtgtgtggggcggggcgcttccctgctggatctccagtaactccagccagaggctaagggacagaatttggatctcctgggcctcagcccataggggaggggtggccgcagtctctgctgaccagcagatttagcttttcctcctggtagttccaaggaatctggacagcccagatgagtgggtttcccccaagcaaaacacaccctctccaccaagggacagagtgctccattaaacgggtcctgctccctgtgtcacccaactgggtgagacccttcaacagggcttgtcagataccctctgcaggagtgatcctactggcatcaggttggtgccccttgaggtcagaggtcccagaagaaggagtaggcacccatctttgctgctctccagcatccttaatgacatctccaggcatgggagcgaatcagatgaataaggcctgaaggtgaaccaccagcaaactgcagcagccctacagaagagggactggactactgaaagaaaaacaagcagaaagtgacaacaacagcatcaacaacaacaatcaaataaaaggtccccacaaaaatctcatccaagggtagcagcctcaaagactgaaactagacaaactcatgaagatgagaaagaatgaaaaaatgctgaaaacccaaaaggccagagtacctcttctcctccaaatgattacaacatctctccatcaagggcacagaactggacggaggatcagatggatgaattgacagaagtaggcttcagaagatgggttataaaaaactacaatgagctaaaggagcatgttctaacctaattcaaagaagctaagaaccttgataaaaggttagaggaattgctaactagaataaccagtttagagaggaacataagcaacctgatggagctgaaaaacacagcacgagaactttgtgaagcacacacaagtatcgtgaagcataaacaagtatcaacagctgaatcgaccaagtaggagaaaggatatcagagtttgaagaccaccttactgaaataagacatgcagacaagaatagagaaaaaagaatgaacaaagcctaccagaaatatgggacctcataaaaagactgaacctacgattgagtggagtaccagaaggaggtggggagaatggaaacaagctggaaaacacacttcagggtattatccaggagaacttccccagactaccaagacaggccaacctgcaaattcaggaaatactgggaacaccattaagatactctatgagacgatcaaccccaagacacataatcatcagattttccaaggtcgaaatgaaggataaaactaagggcagccagagagaaaggctaggtcacctacaaagggaagcccatcagactgacaatggacttctcagcagaaactctacaagccagaagagattgggggccaatattcaacattcttaaagaaaagaattttcaacccagaattttatatctagccaaactaagctttctataaaatcctttccagacaagcaaatgctgagggattttgttaccactaggcctgccctgcaatgtctcctgaaagaagcactaaatatggtaaggaaaaactggtactagccactgcaaaaacacatgaaaatataaagaccaatgacactacaaagaaactgcatcaactaatgtacaaaataaccaaatagcatcatgatgacaggatcaaattcacacataacaatattaaccttaaatgtaaatgggctaaatgccccaattaaaagacacagactagcaaattggataaggagtcaagactcattggtgtgctgtattcaggagacccatcttacatgcagagacacacacaggctcaaaataaagggatggaggaaaatttaccaagcaaatggaaagcaaagaaaaaaagcaggagttgcaatcctagtctctgacaaaacagactttaaaccagcaaaaataaaaacagacaaagaagggcattacataatggtaaagggaacaattcaacaagaagaactaactattctaaatgtatatatatgcacccaatacaggagcacccagattcataaaataagttcttagagacctgcaaagagacttagactcccacacaataatagggggagactttaacaccccactgtcagtattaggtcagtgagacagaaaattaacaaggatattcaggactcgaactcagatctggatcaagtggacttagtagaagtctacagaactctctaccccaaatcaacagaatatacattcttctcagtgccacatggcacttattctaaaatcaaccacacaattggaagtaaaacactcctcagcaaatggaaaagaactgaaatcatgacagacagtctctcagaccacagtgcaatcacattagaactcaggattaagaaactcattcaaaaccacataatttcgtggaaattgaacaacttgctcctggatgactcctgggtaaataatgacattaaggcagaaatctagtatttctttgaaaccaatgagaacaaagagataatgtaccagaatttctgggacacagctaaagcagtgttaatagggaaattttgcactaaatgcccacatcagaaagctaaaaagatctcaaatcagcaccctaacatcacaattaaaagagctagagaggcaagagcaaactaatccaaaagctggcggaaggtaagaaataactaatatcagagaagaatcgaaggcgatagagacgcaaaaaagccctccaaaaaatcattgaatccaggagctggttttttgaaaaaattaacaaaatagatagactgctagctagactaatagagaagaatcaaatagacaataaaaaatgataaaggggatattaccactgaccctacagaaatacaaactactatcagagaatactataaacacctctatgcaaataaattagaaaatctagaagaaatgaataaattcctgcacgcatacaccctaccaagactaaaccaggaagaagttgaatctctgaatagaccaataagctctgaaattgaggcagtaattaatagcctagcaaccaaaaaaagcccaggaccaaatggattcacagctgaattctaccagaaatacagaggagctggtaccactccttcagaaattattccaaacatttgaaaaggaaggactcctccctaactcattttatgaagccagcatcatcccaatacccaaacctggaagagacacagccaatatcatactaaatgggcaaaagctggaagcattccctttgaaaactggtacaaaacaaggatgccctctctcaccactcctattcaacatagtattggaagttctggccagggcagtcaggcaagagaaagaaagaaagggtattcaaataggaagagaggaagtcaagttgtctctgtttgcagatgatgtgattttgtatttagaaaaccctatcatctcagcccaaaaacttcttgaactgacaagcagcttcagtgaagtctcaggatacaaaatcaatgtgcaaaaatcacaagcattcctttacaccaacagtaggcaggcagagagacaaatcatgagtgaactcccatagacaattgccacaaagagaataaaatacctaggaatacaagtaacaagggatgtgaaggacctcttcaaggataactacaaatcactgctcaaggaaataagagaggacacaaacaaatggaaaaacattccatgctcatggataggaagaatcagtatcatgaaaagggccatattgcccaaagtactttatacattcaatgttgttcctgtcaaactaccattgacattcttcacagaattaggaaaacctattttaaatttcatatggaatcaaagaagatcccacgtagccaagacaatcctaagcaaaaagaacaaagctggaggcatcatgctacctgacttcaaactatactacaaggttacattaacaaaaacagcatggtatgggtaccaaaacagacatatagaccagtggaccagaacagagacctcagaaataacaccatacatctgtaaccatctgatcttcgacaaatctgccgaaaacaagcaatggggaaaggatctccttattcagtaaatggtgctgggaaaactggctagccatatgctgaaaactgaaactggaccccttccttacaccttatacaaaaattaattcaagatagattaaagacttaaatgtaaaacccaaaaccataaaaaccctagaagataacctaagcaataccattcatgacataggcatgggctaagagttcatgactaaaacaccaaaagcaattgcaacaaaagccaaaattgacaaatgggatctaattcaactaaagagcttctgctcagtaaaagaaactatgatcagagtgaacaggcaacctacagagtgggagaaaacttctgcaatctacccatctgacaaaggtctaatatccagaatttgcaaggaacttaaacatatttacaagaaaaaaacaaccccatcaaaaagtgggcaaaggatatgaacagacacttctcaaaagaagacatttacacagccaacaagcatggtaaaaagctcaacatcactgatcatcagagaaatgcaaatcaaaacctcaatgagataccatctcatgccagtcagatggcgattattgaaaggtcagaaaacaatagttgctggcaaggctgtggggaaataggaatgcttttacactgttggtgggaatgtaaattagttcaaccattgtggaagacagtatggcgattcctcaaggatctagaaccagaaataccatttgacccagtaatcccatttctggatatatacccaaagtaatgtaaatcattctgctataaagatgcatgcacgtgtatgtttcttatagcactatttacaatagcaaagacatggaaccaacccaaatggccatcagtgatagactggataaagaaaatgtggcacatatacatcatggaatactatgcagccataaaaaggaatgagatcatgtcctttgcagggacatggatgaagctggaagccatcatcctcagcaaactagcacagaaacaaaaccaaacaccgcatattctcactcataagggggagttgaacattgagaacacatagacacagagaggggaacaacacacaccagggcctgttggggagtggggatgagaggagggaactatgagggtcagtagggatggtgctactaattaggtagtagggtgctgcagcaaaccaccatgacacacatacacctgtataactaacctgcacgttctgcgcatgtatcctgttttttttgttttttttttgtttttttagaaaaagccgggtgcggtggctcacacctgtaatcccagcactttgggaggccaaggcggacggatcacaaggtcaggagatcgaaatcatcctggctaacatggtgaaacaccgtctctactaaaaaaaaatacaaaaaattagccgggcgtggtggcgggcacctgtagtcccagctactcgggaggctgaggcaggagaatggcatgaacccgggaggtggaggttgcagtgagctgaggcgacaaagcgagactctgtctcaaaaaaaaaaaaaaaaaaaagatttctagtacattgcctaaaagaacccttggatgaagtcagacacatgggtagtatgagaccccagatagcatcattttgtatgtacagaatcgcttttttttttttttttttttgagtcaggttctcactctgtcacccaggctggagtgttagttatgtggtcatggctcactggagccttgatctcgtgggctcaagtgatcctcttgcctcaacctcccaagtagctgggattacaggcacacgccaccatgcctggctaatttttgtattttttgtagagatggggttttaccatgttgcccaggctggtctcgaactcctgggctcacgcgatcagcccacctcggcctttcaaaatgctaggtttacaggtatgagccactgtgcctggtctagaattgcttttagtggatgattttttgctgtcactgttaatggcgtgcattttctgagttatcagagatggccctgcatgctgcgagtctgtgttgactgtactgttggctgtgtgtgtggagggcaggaaagtgccgtccttgctgtaacttgtgttattaatgatatggacactgtgagttgcttctagagagctacacctcacttctgtgtcagcaaatgaaggcccaggaactgacagcgttccctctagctttaattgcggtataatcaccacaccctaacattctcctgttttacctttggcaacatctagagtttggttgtcacagctgatggggtgggggtgctatggcattgggtgggtagaggccaaggatgctgctgggcatcctacactgcccaggacagccccccacaaattatccagccctaaatgtctacagtgccacaggtaagaaatcctggaccgtagggtagacagatttgactggagtggagaaattgtatcctggggtaagtgggatttggattgcagttagtgcagagcttgtgtgtgtggaacgccttggacactggactaatccaagaagttgggtggggaggaggggggctttttctttaggtcctggaaaccattaaaaacctttgaacaggtgctttagaaagacaaaactggcatctgtctgaaggatggattacaacaggcaccagcagactgtggcccacggggccgtgtccagacttggcacacaaccatgcccattcattcatgggttgtctctggctgctgtgatggttaactttatgtgtcatcttggctaggccatagtattcagatatttggtcaggtacttaggaatgttgttgtgaaggtattttttagatgaaataaacacatcagtagactttgagtaaggcagatgacttccataatgtgggtggacctcatccaatcagttgaaggccttaagaaaaagactgaggtccgccaaagaggagggaattctaccagtatcctgcctttggatttgagactgtgacatctgcgctttcctgggtctctggcctgctctggaaagtttgggcttgccggcctccacaattgtgtgaaccagttccttagaatctgtccatctgtccgtccatccatccatccatccatccacgcacgcacacataaacaaaccctattggcactgtttctctggacagccctgactaacatcactgctttcttgccacagcagccaagttgaatacgtgcttgtaagtacagggattgtgtggcccacaaagtagaaaatatttactctctggccctttacagaaaaaaggccaagcattggatttggtaagtgaagtccttccatgaaactgagaagtgctgagtcagtactcaatgggagttaaaacagagaaactgtaaaagccaagagggctcaggatggtgataatcacggtctttcattcttttctcctgtgcacatttgacccgctggcatgcaggagatttaatctctctaatccagaatgtgttttagggaatggcttgcctggcttgtgggttgaaatgttctctcctcagatgtggctcctgcaatatcagctcacctgatgacaagaagtggaagccatgtaaccacctgagacgcaagttaattagggtttatcagaaagacaacctgaacccctgtgggatgtgctgtgggtgaagaaaagataccagtattctgtgattccaaataggagattttaaaaattctacccctggaggatgggttggcatttgtcttccaaacataggttaaatacgttttatttctgtctgttttgtacacattttaatcattttccagctcacaattacagttggtacttctcaattctcagtgaattgtgtagtggaattgtttgcaacatcatactttggaaatgacgttggcaattaaagttttggtccaagtttaataatgaagactatttgaaaggccaaaaccgatggatgcttttgagatgaaatagtcatttgggaagaaaatgagggcaggttgtctacttcttaacatttatctgtttttttttcttttttgagagggtcttgctctgttgcctgggttggcgtgcggtggcgcgatctcaggtcactgcagcctcaacctctggggctcaagtgattctcccacctcagcctcccaagtagttgggattacagacacatgccaccactcccagctagttttatttttttgtagagatggggtctccctatgttgcccaggcttgtctttaactcctggtctcaagtgatcctcctgcctcagcctcccaaagtgttgggattacagacatgagccaccttggattacaggcatgagtcaccacgcctggccttaacattgatcttgatgacactgaaatcgttgatgtgtgccaagggggttcctttttctaaatggaagctcactgttttgggtatccatgaattcatcatagatatgaagagaaagtttgaaatgcccaccagctgtctgtggtagcacctacatttgtgttactcatgaccaatgcagctttcaagtttatgacacgtggcaccccctgagcttaactacctggttgctaatgtctttggacatcactgtatttgttatgtcagggttccttttgctaattgctcttgtgggctttcagactttctctatgtacgtttttttgttttttggtttttttttgggagatggagtctctgttgcccaggctggagtgcagtggcgtgatccactgcaacctccacctcccgggttcaagtgtttctcctgcctcagcatccctagtagctgggactacaggcatgcgccaccacgcctggctaattttttgtagttttggtagagatggggtttcaccacgttggccaggctggtcttgaactcctgacctcaggtgatcctcccgcctcagcctcccaaagtgctgggattacaggcatgagccaccgcacccggccagtgtaagtcttttgaaacacagacacctagtgcctttcccgtgagtctttcagggaaagattgagttccgtgtcaggttggagttgctgatcaagcgactgactatacggcttcctagccccctttatttgaaaaaccagcgtggtcttcacttttcccttgagcctacaaccacagggtgcctgttcatgtatttccaggaccttatgcggctcctttgctctgcttattccgagaaccaagccttgggactgtgcattttgaatacaaatgaaggcacccggaggaagcccccagagtctcggcacagttgaggaaacaaacaaagcatgctacacgtgcaggaagatccctctttaattcctatgatgacctctctgcttttttattttttaagttaaaaggagtcaatgctttgggttttgttagactggacaaggtagcaagtcatattaaactaacccaggttgttgcttgagttttcactgaacttagactctactgacgagtatagtcaagcagaaattcccctcacgaggtggcctgatggtgtactccagtgggggggtgcagaagatttggagggatctgcttcccgactggggcaggttaacctctttctgccttagttacctctttgcatgtcctaagagcacctgcttatcagatccttaggaggattcactgaattcgtccacttggaatccacatggaaggctgcctggcatgtaggaggtacccagtaaattttagactcctgttatttttgccagttggattcaacagatgtttgttccctggactagtgtttctcacctgggggtgatctgcacctaggggacatttgacaaagtctggagacattttgggttgtcacagcttggggagggagtgttactggcatccagtgaatagtaaccaggtgtattagttttctgtcgctgtaaaggaatacctgagactgggtaatttagaggtttatttggcacatagttctacaggctgtacaggcatggtgccggcatctgcttggtttcttgggaggcctcagagcttttgctcatagcagaaggcaaagggagagcaggtgtctcacatggcaagagagggagcaagagacagagggaaggctaggctcttttaaacaaccagctcttgcatgaactgagggaactcactcagtaccagggggagggcaccaagccatggttcctccatgaaccaaacacctcccaccaggccccacctccagcagtgaggattaccccactacatttcactgtgagatttggaaagggaagacatccaaactatgtcaccaaagatgctgctaagcatcctaccgtgcacagagcagcccccataacagggttacctggcaccagagtgtcagtagtgttgaagttaggctacactgtagttcacttgcttattgtgtgtaggaagaccggaggccagttacctggcaataacaacaacaacatcaaaaccccctcaaacccaaaacaaaaaaaccccacatgacactgtgagtgttttttttttaatttgcaggagattgagtcttaatccagttgaagacctttatttccttgctagttacagagaggtttttcctggttcgttgcctgtgtttgttgcagttagtttttattgacctttctagggttcatgtgtgtcccttgggtttgccatgttttgttctccaaagccccaggagggttccccagtaacagagactgtgttagatttttaacattttcttttactttttgttttaaatgatttcttttgattaattacacactcacactgcgttgcaaacatagtgctgtcagatcccagtactgtgtcctttaccggctttccccaaggggagtggcttctcacaggatcatagagcaggaaaacccaggaaatccacgttggtgcaacacagttacctagccttggagcccttacttggatttcaccctttttgcgtgtactcatttgtgagttgcatgttaaagatgagagtcagtaatatatttccaaatgtcaacagaacataaattgagcagaagagtttataatgagatggaggattgagcagaagagctcatagcgagccagggcgaacaacctggcgaggagctccttgactttcttggaggccgaggtgggagcgttggtgacaacccccgggaaggcagatgttatcaggagttaaaatgtgatgtgtgtaccgctcatgtgtgtatggggtgtgctccttttgtttttgatgctgaaatgagacaaatcatttcccttttaagctccaggcagactgatggaggggggaaaaataacacccaacttactgcaacctgaaatcctttgccttggatccacttcctaagttcctatagtccttattttataaactgataaaacaacttttctctctcaagtgatgatcatcttgtgttttacactaattaagcccatatacacctccctttggaattccttcttctgatctgcttggcctgtttgccagttagtcgccttactaggagaatcaaaatgtaaactcataatagacaggaacccaacatcatcagcacaggatgtggcagaatgatttttctttcccacctcttgctgagaaggcaatgagattggaaatggcaaacaccccagagttctgtaactctgagtgtggaagaggaggtggcagcccttgacctcagtagcggagccagatcatcgaacatccccgtccaggaatctggacatgcactggtcaagaattcagcacaatttcctttggtctggggattgggaagctctttttgtgagtgaggcatggagtgaaattgcagaagcctgcgtgacttgtagaaaccgaagccaggctcgtttactgccttgcacaagggagatatgataagacagaatttatttgtgagtgtcgtcgatgccaaggagcctgtccaacatttatagaggcttttgggctaaacgaaaaagggtttgatctgtctgtggagacagaaagtagatgagtggttgcctaggactggggctttaggcgggtaagaggttgtcactgctaaagggtacagggttaatggaaattcttgaaattgtgctgatggtggctgcacaactctgcaggtactaaaagttgttgagttgtactcgaaatgggtccactgtatggcatgtgttttatatctcaataaacctgtcaaaaaagggtgcaggaccactgtttttgtacatgtcctcaaaatacttcctgtaatctagtgtggtcacagctggttcatgtgcacggacatagtgtcagtgtcattgtggagatagcagtttcagattcactggttccagaaaatgtgtccctgcctgttatctccgtgttgccacaattaagaaccaagggtccataacaagcagtgaaaccatggttcatatcagaggaagtggggtggtgtcatctcttttgtatttttctcttttctctcccccactgcctttgcccacttccttctccaaaataaaacaaaagagagaaagcaagagataagtggctgagctgaatgtggtccagccctttagaagaggggagtacacatactggagggaagataagcgaaaatacagcctttctcaagggccagcacagacggagataaagagagagccacaggcacactggccaagcatcagctcctcaagcatccatctcactattcagggtggggaaatacttgatacctcaagtcctctttatcatcgcagatgaaaactgacataggtgatttcctttcggagcatttagggagaatgcaagggaaattgacaacacacttggtgcaattgggtaaccagtctttgtgttgccctccaatgactcttgcttggaaatgattggaagcccatcgttttaagtcattggaacgactgtccccttcataaagcatgatgtagcaaaatgaaaagcatacttctggttaaaagtgtttttcaaaaaaagcttaccacattgaggaggtcatttcatatttcctgatattcagcaattttgctgtgagctttgtagagttgttctggtgcttagttcaaataagaaaggaattactgaaattgcacattaagttaaaaaaaaaatcagggttttgggtcctgagacttgttacctaaacatctgtcttgctattttgttacagcacaaagtaggaattgtaaaacatcttcgttataaactgagtactatacagtctctgggagagcagaagaaacgtggtaggaaggaaccacccagggtgggtaatgacagagtagagatagtcagatagggccggagacaaggccaggaaaggcgagaggaagagcctgcaggaacgagtttcttgcacgtttgagagctggacctgccaagagggtaaggccaacatctgtgtgtgttctttgaggaaatccgagtagcctgccctgcctttgaccctctgctctttgaactgtggattccttcccatacacctgtgcattctcagtgccgtggtcagatccccaaacagacaccaaaccccgacctccgaggcccaggcaggagcataacccagccccaaggggagataaagacagaaagaatcagtattatagcagggacctttttcaggaatctgccttctgcagggcagtgccctaggtgcattcaagccagcatagcaaatccacatcactagaaagactctttccgttttataacttgggaaactaaggccaaggcagtgacaaatgccaggtccccaaactctgaactgcagatctgcaagctgaatggtggcaggtgggccagtgggattttaaagccgtgtgcttttcagggcaccctggtgcttctccaaatgccggaagggtttccttgaaaattcatagcactactcagtcaggattctgcaggacagtgccctggggagtgcatgagtggatggttctgtgggtagaagccacgagctgaagatagttttacatgtttaaagagtaaagagactgggagcggcggctcatgcctgtaatcccaacactttgggaggctgaagtgggaggattacttgagcccaaggagttcaagaccagcctaggcaacatagcaagaccttgtctctaaaaataaataaaataaaataaaagccaggcatggtggcagtgctcctgtagccccagctatgcgggaggattgtttgagcccaggagttcgaggctgcagtgagccatgttcatgccaatgcactccagcctgggcaacagagccagatcctctctcaaaaaaaaaaaaaaaaaagaaaagaaaaaaacagtaccttgttgatacatggaaatgatgtgacattcagataaagttttactggagctccgccatgcccattcatggacatattttctatggttgctttttcacaacaaggggtgttgcaaccatggcaacagacactgtctgtcttgcgaagcctaagatatttgctctctggtcctctgcagaactagcgtgtagttctgagtgcttgaaggcacgtaccatcttggtggtgtgacttggactttcacctctcctgatcccttcttcatttccaccctactctcatcttgccttgcttgcagaagcctggtattttcataattcgagagtcacttacttcatgtgaagtcttgtcccagttaaagtgccaatagtcctgggagaggtaatacattaaaccttatcagttatttatacctcaggattggaagggattgttgctggctttgtcctataacagctgcgaccagaggacagagcctaagggctgttgcatgaaatgagggaggtgtgggtcacctctgtgcagggcatgagaagagaggaggctgggtcatctgaaagatgacctttgttcatggcctttttctgtatcctcctcagtcacccagaaattgggattgttggtgacaatcttttgggaattggtgttagcttcggagagccacttagcctgaagaccctccttactccgttatcatagaaccagagtggtagccacacaggcagactgtccatgctgacgtgtaaggcagggccttacacctcctacccatgtaggaggtggtggagctgggattttacatggacagccttctgctcccctggtgcttagctacattctagtgccttctgtgcaatgccagcttaacatacatatgaagtgtgctgacccaatctcctgcctttgcgttcactattttagatggttgtgtcaccttgagcctggactagggagataacacgtgaaggagatgccgcgtggtttctgtcttgtccatggtacgtggaacacattcccctcagtaacattatggttgagacatggaatgccacaatgtacagttgccaccatatggtatacttcatatatatacacatatatatttatttagtttattttaatttttttagagacagagtcttgctctggtgcctaggctggagtacagtggtgcagtcgtagctcactgcagcctcgatctcctgggctcagtgatcctcccactgcattgtcccaaagcgcttggattataggtgtaagccactgggcccggcctacttgtatatttttcattgcaaatgtacatttcagttacgttgtgggctttaaaaagcctttctaggctagttgggaatttgaccctattttttacagcatagtttctaggagaaaaacatttctgaggaagtaacaaaagaagacttgggctgtatcccatttttaatttagagagcactgtcatttgaaaatttcttctctcaacatgttttctttttgagacatgaagtaggcaggcaggatcttttttacagtggcgctggtgtctttgggaagcggcttccttggtttgcctttgctcattttctttcttgacttctccaggcattcagctgcaggcatgtacctctgctgctgggagagtggcaaggagagggggttggaggaacggggataaaaattagctagaattcaaaaacggcagtgacagcccagatgatttttcatgctaacctactttaaaagctgccagaataattgtggagtgggaaatctctcatttctcctgtcctactctgacaagatctaaaaataactttgaggagatgggcatgtggccctttgatctccttggcctggagtatttcttggtaggagcagagcttacaagaaggtgttcttcaatgagtgttctggcagtcggagttgtgggtggggctgattactgtaatcttccttcgtcattgaacgatttcatctgcccctggtttccattacttgctgctctaaatattcctctccccgcaccttccttttatgtagccacaaactggaatatgtgcatggaaaacccaaaggaggcaaatcccacttacactgcagaactttggtgctggatttagcggctatttaccaagcacctcctcttccagaataagtagcacagatctttgaccgccccccgccccccaccgagggactgtggtctagttggaagacacaaggcagaggtgtaaaaagggaactctggagataggaattggaaatggggctgagagctgaagagatggcctggggctagagaccagggagatgggaggagggggagttccttggaagagtgtgcccctaagagatcctgaagagtgagcagagattgatgagaggcgagaggagacctagagttatcagggctgcagaggtgtccttggcacatagaggccatagtatccacgttggcttccagggtaggggcagtgcatctgcggctggctgaagatggaataaatgggatagtggctaaaaagatgggggtattgggggaacacctctccttggagtggtcctccttgcagataaggggagacgtagaacagcacttgacagggaagctggtgtgggggaaggatttttttacactaggggagacttgtggttgagttaaacaggttctagaggccaggcatggtggctcatgtctgtaatcccagcactttgggaggccaagttaggaggattgctcgagcccaggagttggagaccagcctgggtagcagcagcatagagagaccctgtttttacaaaaaatacaaaaattagctggacatagtagcatgcacctgtaatcccagctgctcgggaggctgaggtgggaggataacttgaccccaggagttggaggatgcagtgagctgcagttgtgccactgcgcaccggcctgggtgacagagggagaccttgtttctaaggggaacaaaaaaagaagttaaagagataagataaagaatggggggaggggacgtattttttgcaggagggaaattttgagggtttttagccttggaaaaggagcagaacagatgggaaggtcgtaaacgtggaacctttggaagcagaaaggaagatgatttctcttaaaaagttttgcctagagatgactaatgtgaaggtcttggtgttttaagggagcagggaaagccagaggtggtgggtccggtagatgcaggaactgacccaggctttcagattgtacactggggagcagagagtgcgtgcttgggggtggggaggctgctggccagggctgaccttcctcccatgacccctgcgtagaatcagagtagcctcatttagtgtacttgagtcaaggccttctgtttaagagcttatttgaactcattacagtcatcgcttggtatccttgggggattggttccaggacctcctgcggatacccaaatgattgcacactcaaatcctgtagtcctctcagcaaaacctgctgataggaaaagtcagccctctgtgtctatgggttttgcatccccagatactgtattttccatctgaatttggttgtgaatgcagaacctgcccataaggagggccaattgtatttattgaaaaaaatccgtgttgttcaagggtcagttatagtttgaactacaaaaagcaagcaaccaaacaaaacccccaaaaaccaaagctttaattggttaagtcagagcagactaaaaaggactacatgcccagtggaactttctgtgtagtctagtagccatatctggctatgaagcacctgaaatgtggctcatgcaacagaggaattgaattttaaattttattccttttaaatatttatttttgtctttcttcgtttcttttttttttttttttttccctgagatggggtctcgctttgtcacccaggctgaagtgcagggtcgcgatcactgctcactgcagccttgacctcttgggctcaagcgatcctcccacttcagcctcccaagtagctggggccacaggcatgagctactttgcccggctaattttttaacttttgtagagatgggggtctcgccatgttgcccaggctggtctcaaactcttggtctcaagcaatgcttccacctcggcctcccaaagtgctaggattacaggtgttgagccacaatgcccagcctaaatatgtatttcagtagctccatatggggaggtgtcttggacagagcaggttagcccgtgagactctctggtccttgagtgagagggaaggatgagggcttgcagatgatcccagtgggctggttctggaagcgaaacctgcaggccccatggcttggggaaggctgaccatagcaggtgggaggagctctctgaaggccgaggctgagcactggtggagaacagggcccgtgctcacgtatcccacaccccagaacttggtgtgctggattccagccttgtgtgtttctcattatgactatgtaaatgccaggagggttgggactgtgtgatttttcttcttgcttggatgctcgagagttcttcattaattagtgaaggaaagctggctctaaggagaagcagttgaagtggagttcattgcccccacttctctgcagcaggaatgccttgtccctcctgcctcggttgaactcactttctcaggctcccacctttgaatggaggcccttgtcaggctctccatccccagcgactctgttgacatttccccatgggaaaggaaaagaccatctgaaagtttccatctgtgtgcaaggttttctgaacatgttgacaacatgggtttaattttgtgaggtcagcaagagttcttgtggtttgggatttagtaaaaactgtaggctttgtatgggaagaaaatctctctcacctctgtcttctattcttcattctctacacagactctccacttgtctttagcactaaaaacacaaactaagcattatgttttaaaaaaaacccaaaccccaagtccagtagctgattgccctgctttagcttttctccctcgttgtcattcttcaaagaaagactccactcctttcagctgtcaccctttcaccctgatcaccgcatgcagtctggcctctgccccgcttgaaagaagcactcttcccagggcacccgggaactcggaactgtgaacccccagagtctgcccagcccctctgtccctgccttttgagcaacagcgactggtgccacaacctggggtgcccctttccctgggcagcattacccacactgggccaccgtgggccaagtcacccacactgggccaggtcacccacactggaccatatgaggccacgccactcacactgggtcatgtcacccaccccaggccacactgggccatgtcacccacacttggcagggtcctgtctttctccactctggtgtctcctttatcttgatgctcaagactctctcaaaacaccagtggttcagcacagtgtggggacagagacttcagcgaggcgcccccagccccacccttgacgggaaataagcgcaaactccttgtgcctgagactcaaagggtcgtgtgcctttattggcccccttgccttacaccagtgttcttaacctttctgtgtgtgtgcgtggctctctgtagtcatcgagtgaagccgcagaggtctcagaatcacattctaaaataaaagtagaatcataaaggaagcgattaaaagtgcaattgtcaaaatatcaaaaacatgatttgttgaatagtgcttttttcttttctttttattggtaaaatacatgtaatataaaatttagtcattttaaccttttttttttttttttttttttttttagacagagtctcactctgttgcccaggctggagtgcagtggcacgatcttcactcactgcaacctccacctcccaggttcaagcaattctcctgcctcagcctcctgagtagctgggattacaggcacacgccaccacacccagctaatttttgtatttttagtagagacagggtttcaccatgttggccaggctggtctcaaactcctgacctcaggtgatccacccaccttggcctcccgaagtgctgggattacaggcgtgagccagtgtgcccggcctattttaaccatttttaagtgtacagttcagtaacagcaagtacattcatactctgcacagccaacctccagaactccttttgtctcgtagtcctgaaactccatacataactacccactcatttccccattcccagccccagcacccacccaactttctgtttctgtgtgcttcacagctctgggacctcagatacgtggaatcctacactatgtgtctttttgtgactggcttatttcactcagcgtactgtcctccaggttcgtccacatggtagcatgtgtcagaatgtctttcctttttaaggctgagtgctgttccattgtatggataggtcactttattcctgtaactgtagatggatacctgggttgcttccaccttttgactgttgtgaataatgctgctacaaacttgcctgcacaaatatttccttaagatcctgctttcagttctttgatgtgtgctttctaaaccttttttattttttccttttgttttgagacagggtttcactctgtcccccaggctggagtgcagtggcacgatcgtgactcagtgtagccttgatctcctgggctcaagcgatcctcctgcctcagtctatcaagtagcttggactacaggcacatgccaccatgcccagctaatttttgtatttttggtggagatgaggtcttggtatgttgctcaggttggtcttgaactcctgggctccagcaatcacctgtccttggagggagttggcaatggaagtgggttggctgttggagcccattagaatattccagagggatgatggttccttggaccagggtgtggtcaaggagctggagagatgggagtcagttacagacaagacagtgggatttattgggattcttgatttctctcagtggtgagaaatttcgtctttccacacaccttccatggaaacccggaacaccatgggtcccccgtaggcagtcttaagaggatagctgtttttgttctccttccaaattcccattagacttgaggtcagagtcacactttacttgttttgaatatttaaagtagtatacctaatagctcaatagactgtatgcttttatttttattttttgagcctgccttcctaggtatttggacaaatttctccataagagaagtgaacacgtaactctaacttgtaatagcaaataccgcgggaacactgggagccacatattaagatgttattagaccttccctggagtatccaaatggtctataattgcttaataaggagaagtttttgctgagatttacatgatagagatttgctttttaaaaagaaattatccagatttgaatggaaaaattgcatagtctcctgagtgttgttttgcctttgactttgtactgtttaagaactgattatgagcaggaggaaataactcacttcagctgtaatataaatgtgcattggtatttaagcatatgtgacacataaaacaataccaacttggccagaatttaaatgtttatgtaaattacatttttggacaggcactttcctctattttgcagagaaaataattttttcccaaagagattttgtgtttaaaaaaaaaacccctaatactactattaggagtgttagatgccttcgatgtggttttctttcctctttttgcctgaaaggcttgagtgctgaagcatctagcgctattcttgtgtccgggaacgttcctgcctcatttttgtttctagtcttgtttctttctgtgtcagaaataagactaatgcgtgcagctgcacctatagttcaagatgaaggggtctgtgtgagagagagaacgtctgtgcatgtgtgtatgtgtgtgagtgtgtgtgtgagagagaggagagacgggcgggggaggggagagagagagaaaagagagagagagaaaaaaaaacacagcctctttgtaatacctggttgactcagtgaagtctggctctctgagctttactgaattcctccttacttattttggggccggaggtggagatgagttcaaaagtagataaaatttgcctgttacctaaatgagcagaatagattgcgcataatcttttctagatgaagcctgtgtttttggcattctgctctcaagtcctctgagctgatctgagagtgaactggagtgttaagttgagagagatgttgatgactctggtgtggtcttttcctttcggagaagtggaggtgaaacgacttgcccggggtccctgggaagcagagcttgtgccaagatgtaatttttcggttctaagccctgtggtttttcttctgcagcaaggtgggtaccctttttctgtaagggaccagagagtatggattttaggattttggggccagtcttggcaactattcacctctgcaactcagccacattgtgagaaggcagccctgcacattgcataaacaaacaaatgtggctgtattccaataaaactccatttatggccactgacttttgaatttcatagaatattctgtaagcatgtgtcagcagcttcccctgtgcaggtccatgctcagaggtagtcgcgttggggaaagttgctttctgccctcctggagttgatagacttgtggggaggcagatactggaaagcagccacagacacaccaaaggggggagtcagtcccctgtcatgggaattgtgatggggagcgccctcccctgtgcatttagaaaggccccgccacacggaaccactgggaagctgaggcttggagattgcgtgggatttgagatgagccaggcgtgggcagggagatcgcacaggggaaaggaggatcgccgtggatcacacaggacaaaggaggtcctgacctgtccacccccaaagccctttgcttccctagcccacgttggtgtagggtgggccgagagggggcgcagtgtgaggagtgactgtagctgcagctcagcagcgtctcaggagaagccagctgtctctactcaccacgggagtttatttccagtgtgggagagggactcttgagagagaaggacaagatgcccgtttgccctacagattcctttgaggaaaattcctataggggtctcgtctctgttgtatttattgtagtacgacctttttttaagtgattcaccataatctctctaggccgtatttaggcactgaccctaaatgtgcgttaaaaaaaaaggtttgggatattttggtttatttatttgtgtgtatgtatatagttgttaaattggtgtccttggggtgggggttgatcggtggaaccttatcttctctgctttcttgctccaccccatattttggtttgtttttgttagaggtcggcaaaccttttgttgtcaatggccagataataaatattttgtggtttttaaaccctgtagtctctgggtgttatatggcaaaagcagccattgacaacatgtgagtgactgagtgtgtttatttatgggcactgaggtgctgggatcccatattcacactgttccgccaccatcaccgccattcataactcccaaactttttctttttcttggtggaggagtggagcagggtcttgctctgttgctcaggctggagtgcatcacggctccctacagccttaacgatcctcccatgtcagcctcccgagtagctgggaccacaggtgcgcatcaccacgccaggctgattttttaacttttctgtagagacgtggtctccttaggttgcccaggctggcatcaaactcctggcctcaagcattccacccactcctgcctcccaaagtgttgggattacaggtgggagccaccgtgcccagcctcagaaatttttcattatcccaacccgaaacctggtccccatgaaacagtaactccccattctcccttcccccgcagcccctggcacccaccgttctattttctgtgtctgtggatttgactagtctgaggtgcctcatgtcagtggagtcatgctctgtttgtccttttgtgtctggcttttttcacttagcataatgtccttgaggttctcccatgttgtagcctgtgtcaggacatttgcagctcagttcatttccgaggaattgtcctatatgcagggggtcttaggaacacaggtaacttcacttcccatttgaagagcgaggagttctcccgaggccctgaacaggaatagagactgtgaggcattggcgtttggaaggaagtgtctctgaaatagaaacgactgtcagatgaagagggacagttcagtatggtacccgggcctgcctttccagacgtccccagcctctttgcctagttcccactctgggcccctgggcaggtgacccgcagctgcacatgggtttcctgggaagccacagtgctgaggatcttgggagagaggctcaggatcagagtctggggagtgcaggagcttgcggggggagggggtggggtcagtgggggcggggggtgctgctttggggattgggaggagtggactggggcggggtcacagagtctttagctgaacccatgggtgctctgggtctcggcttgtcctgactcaagtcaaggggcccaggcctttgtaaaggtccacattgcccattcactggggcctggctttgggtgagggtggcagctggagatggggggaagccctgaacgggaatcttggccacacactgctatatccgcgacaccaaattctatcccacctgttgttggctgttctggaaaccagcactgaaaaatacggagtggaaaagttttctgattttttttttcctgctttgtttgggttttttggaaaacaatttcaaaattagcatatggcttgttaaaattaaatcacaaaggaagtgcctatggtaacgttttgatcaggctctaggtctgtgtgaaccacggcccatatttgaaaatccagctttattgggacatagccatgcccattgctttctgtgtcctctgtggctgctttagtgtgccaccagggcagacttgggtgggttgcagcagagatggcatggccctcaaggtccaagatgtttactctcttgccggtcctctgttatctctggtctttgtggttgccacagttttcttggatccaggagttaaaggcagtcctgagggatgatggcctcatctccgcagttgcctggaatgctgaatttcagacgtgctaaaggaggggttgcagacattgtgtggaatgcattcagaccccagatgtgggtgcaggaaggcaggcatggcacagccaggtagagactggtttccaggcccaagcagccttcagcagctgtgcgccttgtttctgatgttgtttgggagtaagaataatgtagacatggggggtcatgaggctcagggtaaaaacttcaaggaaacctccatggcatggttgggcgcagtgactcatgcctgtaaccccagcactgtggaatgccaaggtggaaggatcgcttgaggccaagagttggagaccagcctgggcaacataaggagaccctgtctctaccaaaaaaaaaaaaaaaaaatgaccaggtatggtggcgcacacctgtggtcccagctactcaggaggctgaggcgggagcctgggaggttgaggctgcagtgagctgtgattgcaccatggcactccagcctggaccacagagcaagaccctgtctcaaagaaagaaagagagagatagaaagagagaaagaaacctccatggcagatgcatggaggaatgggttaatatctagaaatacgctgagtggtggagtaaagaaaacccacaatagaatacctgatgaatgtggggaaagcacttctgagctcctctagttttagaagacctaaaaagacgatttaaaaaaacaaacaggagagccctgttattgttgatgtcttccaaaacgaacgtgcatttataagccaggtggcattttaatgtcacgagggggtccattctcccatctgtctcctttgcttttgttagagtcagtagcttctaggtctgcttgacattggagaggatactgaatgcagaaaattttgtttaattataatgatttgattttttccttctgtattcaagtttgcctgcttctaatgaattggcagaaatgaagagcttgctcagattttgccaggaccatttaaaagcaattaaaatcaatttagttattaaatttgaaattattgtctggctaaatgatagtttaaaattcaatttatactggcacttactttttaatgaacagaccacatcacacatttttatgttctcaaattatctgtggctttaaagctgtaaaaaaaggtgctcttttaaaaaagccctgcatgtttcctttttcctctctacttccgctaaaatatttacatgtttcttttaaaataaggtgagaaaatccccttgacttctcaattttaagaaactatacttatcttttcatcacaaatgttcatttatctgtgttgaagtcaacccaagaaatcttaaaatataacggaaagaaaatgtttctggattttttcccgagaatacatatacttttaaatggcacgttttacccattgactttaattcctccctccctccattacatttttagatgtgttcaatgaaacgtagtcctccccctttaaaaaaatggaccgagcatcacgtgtgaggctgcaaagaggctccctgccaaagcatcttatctgccgctggtaaagccccgcccctccgtcagcagctaacccttgagcgggatgtgtgcttgtgccgggtgcattgcattaagagaatgcaactgaatagagaaggatcaggaccttttgtgcagaggtggggagtgttaaaaagggggaggcctgggtgggagggtggagttagtgggagatgggtatgcttagtgcttaaattccctgcattccctaacacgaatttaagaaactcacacagtaaatgagtcagggagagggagagacagggagagagggaggggagagggagagttcctttcattcatgacaggatgaactttgcatgcttcagaacaatttacatttttccttatttctaggtacttttttgaactaagaacctggagggtgtgtgtgtgtgtgtgtgtgtgtgtgtgtgtgtgtgtgtgtgtgtgttggtgtgtgttggtggtggggtttttttgccttatatttcataaatatttcttggttgattaaatgtcaataatcgctcatttctggtttgtaaagctgttacctgatccttgaataccacgaatattttgtacattctaaataattgagagaaaataacaacgacaacaaaaagacacaaataaaaagcatctccgcttatttaagaagagtagatctgtgcggggcgctgtggctcatgtctgtaataccagcactttgggaggccgaggcgggaggatcccttgagtccaggagttcgagaccagcctgggcaacataatgagaggctcttttttttttctttttgagacacggtctcattctgtcgcccagactggagtacagtggcactatctcagctcaccgcaacctccacctcctgggttcaagtgattctcctgcctcagtccccctagtagctgggattatgggcgcgcaccactaccacccggctaatttttgtatttttagtagaggtggggtttcgccatgttggccaggctggtctcgaattcctgaccttaaatgatccacaccctccttggcctcccaaagtgctgggattacaggtgtgagccaccacactggggcgcaagagcacgtcttttaaaatcagtgctgtctgtggggtgggaggggaggagaagtagatctggccatgctgaaaggttcgtgcagtggcctcctgagctgcgcacatgcttctggagctttgggtggacatttagtctgcatgtggatctctgtccaagcctgcactgggagcccctgccccaggaagcgaaggctgcatttcttttatgtcaattaacagatttctgccccaccctggacatctgagcgttaactgatttgtaagggaggggtgagggagggtaaaattacaattctatatcttaacattgggggtgaagcatttttaccctagaggaattctatccaaacacattaaacactcttaataagggacaaagggttgggacgtagcggttagggggcaagcccatgagcctcactccttgtgctctctctccaggaattggagagggaatccttttgcttagcattcccacgcctcccacgggcctggcactgggcccgcgggcttgccttagtctcctgggctgccctaacgcagcaccacgtgccgggcggctgtaacagcagcccgtaattctcccacagtcctggaggttctaagtcccagatcgaggggtcagcagggttggttcctccctaggcctctctcctgggcttgtagatactgtcttctccctgggtcctaacaaggtcatccctctgtgtgtgtctgtgtcccctcatctctagtcctgttggattagggcccgtcctaatgacctcattttaccttagttacctcttgaatggccctaactccaaatgaacagtcacattctgaggtcctggggcttaaggcttcagcatatgagttgggagtagggatgtaatatgcctaatgtccagaacaggaaaatccatagaggcagaaagtgggttcctgcttgccagggctggggacgggcagtgtggggtgactgctagccagcacagggtttcttctggaagtgatgaaagtgttctggaattagacagcggttgcaaaattctgaatgtattaaaaaccactgaattgtacattttgaaagagtgaatttcatggtatgtgaattatatctcagtaaagttgttataaacaaaaactgtgagggtaagaggtaaaaggaagggagttgaaagcagcatcaggtgtgaacagcccataattcagcccatagacgagcgcgaactcctagcacagctgtctgttgaagatgtgcgtgaatgcttgctttccgcacccttcggcctgcttttctctactctccaatttcatcatacattctcttccttcctccccctccccactttttcaaaacgtttcttctagtccttacttgtggctacacaaaattccataaacataatgctgcagttcaaagaagtgttctgatggtagggagataacttaggaaaatattttacctttggggaagttttggtttccttctgagtgaaaaccctccatgaaagagaaacttaaatgcagttttcaaatgctcctgagacattcccagccttttctttgtggagaagtgaaggcaggacaatttccaaggcaaagagggacctatcgcagacagcagaccccaagtaaagaaaggcacagtgatggtgggtattcgtgcagtgttttgaaaatgtggaggtcagggatgctagcttaccaggccagcatgatcaagttacgagaaatggagaccaggacactacctctgctgggtgtgctgctccgggctccttcgaaaggggaagcagctggtggacttccttgggctgtggttaaatggggctcccataggtgccatgaaggctctgcagagccagggatgcttgcaccctggagagaccttgctccaggagctcaggagctggtaggggtggtgacagtgaagcaccggcttgccgtgcccagtgcttgggcagtgctgagctccgagggaggaacccagaaccatgcgggagcaagggagggaggcaggcgaggagaagggttgcccaggagcctgcaggtcgggtcggtgttgtatcaaattgtcttttcctgctttgctgtctgatcccactaaagactagccagagagatgtggaggtgaaaaatggtggacagccatttttctccctttcactgtgtctacaatgtctgtttcatatcaacagcaacatctgtgcaggcatcctaatgagtataaataatgtcttcagaaaactgggtttgtgaggctcctgtcatctgaatttctttcatcatttaagtgatgattttttactcattgacatacagttgttatttagtggccacgtattattcgtatagggttctttatgtgctttctgtgtacatttgttttcgtgctcatcgtatttcagtgtggcttatatataataagatgcacctgttcttagctattgtggacttttttttaaaaaaaggtttatagagatatgattcacataccaaacacccatttaagtgcctaattcaacagttcttaataccctaatttaaaaaaaaaatacagtgttgagtattttccttttctcgtttttcactaaagtagactcaggattggggttatctgtcagtcccttggtttgattcttggctgccagtgtttactggggacggatgttggtacctcccttaataggatattgttacagcattttacaaattctggttaaaaaaagtcccacatgagatctcccctcttcccccctctctgagtgtaggcattgtcagctgcagttgtccagcatctccaggactcttttcatttgcgggatggaaacaatgtaccctctgaacaactcctccctgtttctcctccctccagctcctggcaaccactattccactccctgcttctttgaatttcacaacttgaggtagcttgtgtaagtggaattattttaaaagctggttcatgttaaagtgcttagaacagagcttggtgagcatccggtcaacagtaagtacttttattattctttttatattactctttttttttaaagaggccagacacatgggcttctgtcttttcacagcttgggatctgtgcagacccaggcttccagaagccatcccacttgaattcttactcccttttcccctaaaaagaagctctgaaatcctaattgtcaagaaggctttgcctgctgtgcatgcctgagtaatgttatttttgtcattatttgagagacagagaggaagcttccagtcccctgtaaggaaacgaaatcatcgtgcacagatgtggttctgtttatagagggaaggaaatggaggtgaagagtgtgtgtggcttgcagccaggcttgcgagtgtgcagaggaataaacttttttgcctccagagttttaactggaaatgtgtctgaattctacctcctgggcacactggcctgaggtctcccctgcatacctgatcgtgaaagtcttcgggtgtgtttgtaaacacgcagcccccctgatgtgagagtcagcacaaacttctaaagatgcgatgatgaattctatcagagaagtctttctggttttgtgaaaataaccttgcactctttaattatatccaaatgatcaaatctggctctgatgtcttgtcaaaattaatgttaaaggacagtgccctttatattttacttgtctgggtataaacatcctagtctttaaagttgagtctgtaggactacctctctacttgattactctgaaaagagtgtatagagtgagtttttaaaatggaattagtgtgcatacgaggaacagagtgacatttaacaaatccttcaatagatagtgctggtatgaggattggtgaaactagaggtagggaatgagcatttttggttctgtatcatattcccaagacattttcaaatgattcaccctttgccatcagaatggtttgaaatcgatcagcctgaatccactaatgtgggctgcggcacatgaattttaacactagaagcacacggttgtgctgtgtttcaaatgaactctggccatttgaagtgagcaggcataggcagtcttctgtcctgtgataacctcagtacatatcctttctgttttttaaagtaccttacaagctgctgcattacagtcgttattattgggccattacaaaaagctgtccaattttaagtgtcttggataattcttgtttgccccagcatcagaattgagcatttttttttttttttagatggagtcttgctctgtcaccaggctggaatgcagtggcgtgatctcggctcactgcaacctccacctcccgggttcaagcgattcttctgcgtcagcctccggagtagctgggactacaggcatgcaccacgatgcccagctaatttttgtattttttagtagagatgaggtttcaccatgtgggccagcatggtctcgatctcttgaccttgtgatctgcctgccttggcctccgaaagtgctgggattacaggagtgagccattgtgcctggccaaaattgagcacttttatcatgtagtattcatgtcttactggcaatgccctgtaaagttaaataagttacatttgtcttgcacaggtaataattatgaggtaatttccacagaatccaagggcctcattgactttgctataaaatcaaaacagtgaattctgataagactagacgcatgttactcttaaattgggctgtctcctggccactgttgtgcctttaacctcagcagaaggggagctgggctgcagagtgaaattacccggaggtcaaatattgctaatttgacttttatcatagagacattttctcctctcgcaccaaggcagtggctttaatccctctttcagtggtgagacaggtgcaaagcgtttacaaaaggctttctcttgttttgaatgcgccaagaaagatttccaggccgttaagttaccaatccttctttttaagtcttgaagcaattactgtaaggtcaatccactaatttcctttcagagttaccaaagacctctcatgtaatcatttggtacttgttgccatgtagccagtatcactgagtgcttttactgtgagcaaagcacaatgcatcgggcagggagggatccaaagggatcttggtttttacctttgagccatctgtggtcttgagtgatctacgtgcattagcaattaaaaggtcctgatattcttgtttgggcatattgaaaaatgtgctcttacagataggtttcctctctctactgccccccgccccccaattttttttattgtggtaaaatacataaaacagaatttaccatcataaccatttctaagtacactgttcaacagcattaaatattcattacattgtgcaatcctcaccacgatccatctgcagaactttttcatcataccaaacagaaaactgccccattaaacacaaactccctattcttccctccccacagccccagcaaccaacgttctactttctctctctatgattttgacactctagggaccttttatatgtgggatcatatggtatttgtccttttgcgtctggcttagcacaagtttcatccatgtcatagcatgcgtcagaatttccttcctttttaaggctgtataatattccagtgtatggatggactacactctgtttatccactcatctgtcagaggacacatgggtggctttcaccttttggctgttgtggataatgctgctatgagcattggcatatgtttacttctcattgatttaagtttacatagtcatgtgtggctagtggctgctgtattagacaggacaaccctaggcctgatagccctgaggacctagtttgggtgggaagacaggggtgacctgcagcgagttgtcggctgggggccttggtgagagccagatctgggttgtgaggccactcgaggcagggggaatggtgtggcgggaagtgaggcccaaaatgagaatttcagagttgaaagctttggaagtaacatgatgctctatgactgtgaccagactcaactgcaccaatgtgcatctgagatcaggtcattggcgttgaaatcgtgaaatgctcactgcttgggacgtttgcactgtgcttgatgtctggaggttccgttaatgttaaaatagcaattatgggactggagattaggtttaatgtctgggttttttccactgtcttcaaaagcccgggtcttagtagtaaccatgctgctccccattttagtaatttcagcctggtttatgttgctcaatagcagaaaagcggttcagatttcctttggatatcatggaccatatgtttgcccaggtatcctttcttattgggaactatcaaatagttaacacagatttctccaagggcaccgactgggaaattagtttaccaaagataaatttggtaaaaggaaagtttttatgtgcgctatccttaaactaagacacatctgtcgaaatattaggacgtgcccagtctcccatcctctgctgaaactttagactgtacgtccttcagatatcttctctttggtgctttgtttgggaacagattagcctcatacttcctcgcttgtaaaactgctatcccatctcttgctcaatgcttttcttgtaccgaagggtgagggggaggttccagctctgttttctgtatcagtttcctgggtgatgtttgtttgagggtgccttgtgtccagagccccagaaggtgtttccgttctctgatgagcctgaagtctgcatgcttcgcctttggtagggaaaggcagctggggaaaggttgcatggcccagtgccagggtgccagagtgcgtgtgcacctgctggggagaagcccgctggggcccctcctctcagcacaagatgaggcctcagggcagtgcagcagatggagggcttagctgtccttgccagcaaaagctgctgggaacgtggcactcagataacaggacggttgagaagcggtgagttagggttactctgatggggagatactgagaggaggggatgacaatcttgatttctgttccctttgtgaatcttttggtggccaaaatgaggaaaaggatacattgtgtttgaggacaacaaggaacatctaggcacattgcatacttgattaaatgcacaaagagcttcttgtgacctttatcacaagagtgtggttctatgaaggtcgtaggtacaatagaaattgtgttggtctgagagttactcagattagggtgcattgtgtcaccaccattttgcatagctgtggcaccttgtcaagttaaccttttcctgcttgcttttcctaatcagaagaatgaagttgaccgtatgtactctataaggtggttgtgtgaggtcaatgagattacataggcaaaatcttggtgcaggggcacttggtaaaggttagtttctgttataaatttggggtattctgtgatgattcctactcccctcttctcctcatggctaagttctacttattctttgacgtggctccgatatcactttcctcaggaagcccggtttcccacccagatggctttgggctactcatcagtgttctgtaaaatgctgagaatattgtttatagcacttctgggttgttttgtgatagtcttttgagatatctgtctcctcaccaaactgttctttgtgtcatgggcaggcccacgtcatcctcgtctttgtagtcctgcacctggcacagagcctggcacatagctcagtcaaacaggtgaagactgggttattacatcttcccactccacccccttcattatcaagtcgtggtcagggcatgccccaccaaatgcaaaccctactaggcagtacagctgagacttggaactagactaacccagtgactcagaaatgtgccacaggacttatttggctctagatggggtcttaaaagacattcatagttgcaggcagaacagaatatccagaacaggtgcagaataacctgtgtgtacacagtaggtggtagttataatgcaggaagaatttggcacaagaagtgttacagtttaaaatgaagtcatgggccctatccacactggggacagagataatagtaactaatcatcatcactgtcatcactagcccattgtcagaggtagcactgaacacttatgcgttagccaggatttgggttctagagggtttagtgtactagttgggttaccaagacaaagatgcaggcatggggtgcaagttaacaaaggttatacactaggtggcaactgactcacaggagcctggttattgcagcggttgtggccagagccatacaagtgttctgatgcccctcaactgtgttgaaatttgtttgaggccaaccaagtcagctggcgagggggaaggcaagccagagagaaattgtgaaccagaaaggccccacctctggcagtggctcttccattggagatgaagtcttcttgccctgtttttctctttaaaaaagtgagccatttcacaagggaagttaaattaaaaactgtgcttgttagcgcggagctgggacaaccgagggaagtgatgccaaaggcaattgttggtctttccttcaaatatgtgctgacttaggaagagcaaaatgttttatattaacaattaacaaaagactaagtctttcatcacaaacaagtctaaattcagtggttaggtcagtattatattttcctatagttttaaataagatgcttatgtattcactagtgctttggatgttctttggaaaaatctccaatttagtgacaagccccaggaaatattactcttagttggtccagcatcctatattgtttgtgaaatccctcttttattgtcttttaaaggttgtaaaatgctttttctgtcaataatcagagaaggatgccgcattcatattaccccagtttccaactcaacctctcctttccaattgaaaacaaaagtcagaattcactttttgttgtggggcattaagtagtaagcaaagagatttcactcgccagggaaaagaaggagcctgcaaatcagacaatatcaaaacataaccaaaccatataaaaacacaaaaatgttgcttggcagaatttaactataattaattgtactaatttaatattgtagacacaaatgatcataaagccatatggtacaatccttttgttcatgaatttcttattcatcaaatgttaggtacgtgatgtgggaaagccagtatgttgggcttcgtgctaccagggctagagttgaccagttcagctttgtttctccagtgaccaaaaaaaaaaaaaggtatctgccttgcacatgaaaacactggatggttagattggatttagccaacaacaaactgcaaaaatcggttctggctaactgaagctcacagggtttattagagttgttggagcccatgggaactgatggagggcaaggaggcttgtcgtgcaggagcagcaggaaccaaggaagctttgcagagatgagaaacaaaaaacagggaacacagcaacatttgctgtgtcaggaacgactgccactggtggcctggacaccatcacagccgcagaagatacttaagacacatttctgttctagtgttggtagttcaagattcaaagtatgtgtgaaagtgagtgtgtgtgcataggcagagtagctaattggttgagttggggtccatgtgcccacctccaggttggaccaggggacaagccatgcagcgttttggtcacccctcacttggcagtattcccaccaggaatgaccctcgctaggatttgaggggcctggagtcactacttactaattttcttaaagttgacaacgatcacaaacttcatggtctgggaaaatgtgaattaattgcctgatccaccttcatatcttttttcttttcttttttctttttttttttttttaacaaaaatctgtatattcatagattgtctcttcctctgctagtggttttgcagtagcattttcaggtgaggaaacaacaacagagtttagggtccagctctgtcattgccattgttgtagcgatttacaagttgttactgctagtatgaacttttgcctagttaaattttggaaacttgcctgtaattgcatttgatggatgataaaaattgataaatgacttgataagtgataaaaattctacggaagaattttccatggactggcttctggctttgatcctttccaactgtgcttctcctaccctcaggccgcccctatcatgctgtgcttgtctggccccactcaccctgtcctgacactggatgatttatttccaaatgaattgctcctggaagccattccaacaccattacaaccggcggcaacacagctgtcttggatactcctggaccatatagatagatgtaaccacagcattccggtagctcccacttccccagcattttcttttagaatgggggcatcagagttgaaggaggtaactgtgggtagtgtgtcttgtctttggaaattttcatcatgacctgagcttgtgaacactctgccttggccccgcctcgcactttggaagagactggagcaggagcgggcagcgttgccttcgcagcatggtaacttctctcagcgctgtttgtaaagcagaatgggagaggaaactccccagagggaaactgggaccctgttaggtagggctagcaagaggtggttaaaacgtaagcatccgctgcaccagactgtattctccacgactgtatattttttgttgttcataagagccccgaattgcaatgagtacgattttccctggacgctgcagtgtatggagaagctgtcacttgtcacatgacagctcagtcattcgatccctgggtgctgcagagagggaagaattggcctcgcagtggggagtgagtgccagcccgtggcctgtcccctgccacgtgtcaccatactgaacgtttgtgtgtgctctgtgtgttttcaaaacaccttcatgtcacctgccccggactcctccctgtgagcaaggcagggtgggcgttaccatccctctggaccaacaaggacagaacagcttgagacgcacagggtggcttccccatggctgcggaggcatagaaagtgagggcacgggacgtgaatccgtgtgctgggattctggccgcctgtgcctgccgatcaccctcagtgcctccctggatttgattttgtggctcttctgggtgtgcgtgtgagtgtgttgtgggtaagtctgttgtctaggggaaggaacgggaaatcatccggccaggaatctctgtggggtggtcggcttgagttggccatatccaagctctgcgtgtgtctcacttttcagagtagcaggaaggccgggtgactttgaaatcagatgggtattttcctgattcgaagagacttggcttcttcccccgcccctccttctccctcctcccccctcctccctcttgctggctcacaaactcaatggggcatcccagcccacccatgggaggccaggagaaagaggaggcagagctgtcagagtgtggcccttcgtcttgggggtgtgcaagtgaccgctcctgccccttgatggctctcctgtttcgggtataagggatgttgtccaaaccatgtgtgggactctctgttgacagttgtttttaaattgcctgtttaattgagcttctctaaagtcttctttgtgccaagtatcgggacaggtgatagaaatagaaaattcgacacaaatcgaaaattccagtatcaaaaatgacagcgatgtacccttgccccttaacgcagccaagaaacaggggtgaagggctactctccacatatggagcaggccaccacccttgagtgacagtagccgaacacagaacattctctgcagatgtcactgaggcttaaactcattatgttttaaagggataatctgctattcttaagaaaacaaaaaacaatcacaaatctccctgccctccccacccctgcccccacttagatcctggtagggtctggcagggggagttttgcaaggagttggggcaaattactccagcagatacttccaccccgtatcccaagaaatgtgtgtaaatgctgttatgaattaatttaaaggtattccaaactcctactaattattatgtgtttgctcaagtcaagatcaggagaagtacaggcattgctatcccatggggcctgtgaaactctggtgaggtgtcctagtggaagagcttggggccccatggtgtctggaaagcgggctccactggagattctggctgttttcagcttgatgcacacggggtcccctggagaatgccaggcctgcctgagtgtgcagaggtgagggatcctcacactgcccagcatgtacgtggctgggagactccagagagacatgcaaaagtgctgttaactagacggcgtggtacaaatgcaaagtgagtgggtttttttttttccttaaacgacagtgaacattcatttcaatatttattttgcttattttaatattttactcaatgtttatttatttttatgtttttgagacagagtttcactcttgttgcccaggctgaagtgcaatggtgcgatctctgctcactgcaacctacgcctcccgagttcaagcgattctcctgcctctgcctcccgagtagctgggattataggcatgcaccaccacgcccagctaatttttttgtaattttttgtacagacagggtttctccgtgttggtcaggctggtcttgaacccttgacctcaggtgatccacctgccttgacctcccaaagtgctggaattacaggcgtgagccactgcacccagcctcaatatttatttcaatacagaaacggacttaattgggtattttgttgaaggcaaatagtagcaaagtgggactggtgtgaggcagtggaataacttagtgaaatccaaggtttatgtagttattttccccccacttttttttttttttttttttttttgaaatggagtctcactctcttgcccaggctgcaatgcagtggcatgagatcagctcactgcaacctctgcctcctgggttcaagcaattctcctgcctcagcctcctgagtagctgggattacaggtacccgccaccacgcccagctaatttttgtatttttagtagagatggggtttcgccatgctggccaggctggtccccccatttttatggtttgaaaattttcaaaccctggctgggtgtggtggctcatgcctataatcccagcactttgcggggctgaggcagaaggatcatttgaagccaggagttcgagaccagtctggacaaatagcaaaatcccatctctgcaaaaaataaaaaaatgaaaaattagccaggtgtggtggtgcacatctgtagtcctactgcttgagaggctgaggtgggaggattgcttgagcccaggagttcaaggcttgtgagccttgattgcgccactgcactccatcctgggtgacaaagcaaaactccatctcaagaaaaaaaaaaaaattcaaaccctcagaaaagcttaaagaatagattcatggatcgttaaacatttttaccaaatgtatgttttctctcattactctaaggttgctccctttcccccctcactctcctcttctccttcccttcactccatggatgtgtaggacattctcctacaaaaccatagtacttacattcttgaggttgtcacacctcataattaaacatatgatggttttattaagtatgctgtcacatgtaaatttctccagttgtttgatccaagttgtactcatggatagtgtattgtattttacgtctctttagtcttctgtattgtagaggagtcccccaaccttcttctatgacataggagtttggggatttgtctgtttcccgatgtgattagagtgatgttgaacagttttggcaggaacgctgcacagctgatgattatatttcccattgcatcccctcaggaactcagaatctccttctccatccttggtgaaggtgtattcaccagatggctccctgttgaagctcccttctctctgttaccaatgagtaatctgtgctatgatacagtgagatggtgtgattattctgttcctcacagtggttttcctttggtggttttagcatccactgattaccataaattaattagtccagctttggcaaactatggcttgccgtggtgactcacgcctgtaataccaacactttgggaggccgaggcgggcggatcacaaggtcaggagatcgagacccatcctggctaacacagtgaaaccccatttctactaaaagtacaaaaaattagctgggcgtggtggcgggcgcctgtagtcccagctactggggaggctaaggcaggacagtagcctgaacccgggaggcggagcttgcagggagtcgagattgcaccactgcactccagcctgggtgacagagcaagactccgtctcagaaaaaacaaacaaacaaaaaaacccccaaaaaactccaccaagtctgtttacttatgtgttgtctgttaacagttgcttttgcactacaacagcagaattgagttgggacagagaccagatagccaaaaatattttctatttagctgaatcttgatctagtacatttttggtcaaaaaatgatgcatttctaattcttctattcatttttcatttagtagttggcattcttaaagaagagctttctgttttgacctttaaaaatcactatggattcatttattcttaatttttttttttttttttttttttttttttttttgagacggagtctcgctctgtcgcccaggctggagtgcagtggcgcgatctcggctcactgcaagctccgcctcctgggttcacaccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgggccaccgcgcccggccttattcttaatttttaaaagtgtgttatacgttgttgtcattacattattcttttagatacacaatgttgccctaaatttgcccagtgggaacccctccaggctgggcactgtgttcttctgtcacgcccccttcaggatggggcctgggttcttttgttatgctcctctaaggccctttaatctatgtcgtttcatttttttgttgttgtttttattttgagacagggtctcactctatcacctaggctggagtgcaatggcgcgatctcgactcactgcaacctccacctcctgggttcaagccattctcctgcctcagcctcccaagtagctgggactacagatgtgtgctaccacgcccagctaatttttgtatttttggtagagacagggtttcaccatgttggccaggctggtctcaaactcttgacctcaagttctccacccgccttggcctcccaaagtgctgggattactagcatgaaccactgcgcctagcctcgtatctgtgtcctttctttctgggaccggaagaggtttcaggttcccagtggaaattccctgcccctcaccttgaatcagcctttggccaaagagccttggagaatgatatttaatatttaaaaaccaggaactgagaactgagtgtgctcattgctatggggatatcattgctcctgggctccttgggtgcagagacccagggaaatagatgtttctgtgtatgctttcacactgtccctccctctcaagcccaactccacaggatgcttcctcaccttcctcttgccatctagtatcacgcttctgtagtgagaatctgctgcctacagcaacaacatattgacacatccattctcttctataggacacaaaaaaaggtttcagaaatttttacgttggtgctgccaccaccaccgctaccaaagcaatgaaataaagttcaagattccttgagattctcttgtcgttaggatgtatctcactgtgggtgtacagacaatatacaaaagttacttaatttttctccgatgtttatagtaccaatttgataatgtaagttaaattattcatctttattgaattttaagatatgcatattttatcctctttgagttaagtatttttcaaatatagaaaacgtttacgtggtccaaagtcaaaactctgttaataggtttgctcagagttctcagctcccatccttatcccaccaccccatttttactcacctcttcagttcattgccattactttttgccttatcttttttgtgtgtttctttttgcatctacttagtgcttttaagccccccatttaaaggcctaatgctaagtcttacatgtaaaccagcaaaaatgtcacctttttaagtagacttttgtgaccaaaaccttattatcaaagcgtgaaagttgagaccgtctagggagttttcatcatggtggttagacagtgtgtggaattgaaatgtacagcgtttgtacatgcaggtccgttattgagagaactgatccaaaaccgtgacgactgccaataaaatgtactttaccaaatatctgctcaaaatgcccatgtctccttaatgtcaatacccaacacatgggtacatccagttttagtctcaaatgttttaagatttattaagcttggtttgcaggagtttagtgttcttggaattagaaggatttctctagtgatgtggtgagaagagataaacctgggaccttttgtgttttcttgatacgcacatttatgttgtgtgcaacacaggaattgtcaggaacctgcaatgcaatctttcttgatttataatcttgcaaaatgtggaataaaaagtaaagtgcaaagtttaagtggtaagtgttacaattcatgtgaacaatatgatgctttttctcatgcttacttgaagacagcagctggcccttgagttcagtctcagtgcaaacagcctccaaagaaagtgcattgcactaaggaagcccttttcatctcacaaagggcaaagtctggattgcccccctttctctgttgtctttgcctgttgctccctggaccccagccagtctccccaggcctggagctgggtcagctaggtctgtggccaggaggtgggggtccacgtccactgtgctcctcagcggcaggttctgcaaactgcagcccgtggggcagactccacctccagcctgagtgaggccatccagctaagaatggctttgacatttttaaatggccagggtgaaaaaactaaaagaggattttgtcatgacacatgaaaatgatataaaatgaaagtgtcaactgtcatacattttgatttttgtcagtttcagagaaatttattttctctttttattaaatgtcactacataatatacttgattttgcctttctgctcactgaagctaaaatatttactctctggccctttccggaaagagtccgccgaccccctctctgtggaatgagagcttccaaaaagatgcagaagaccgtgcatcccaagcggttgtaaaagccacttactttcgtaggtttaatgactcaaaagaaagggcgcttgttccctcccttccttcctgggcaggcccctttttggaatggagtttcgttatacagaaagttgttctcgctgtacagaattctgcgatgccttcacttgatggctgtttcttcggggataggagggctgggggtcaggatctgatctcacacgaatggttcagagtctggacttagtagctcagagcagttcactgatttgggatctctggaagaaaagggtactgagtcactggcaccttctgctcagctcctgacagcagtgtaaaggatgctttcgtgacacccagccttcagcccaggaggatggtggcagatcagacagctctggaaatgcagggcacaatgcgcagagggttgcaccacaacagcagtcactcggtgcccgcctggagcactgctctcatttccagagtccctgtatttctgatcttggctgctttaaaaaggaggtgtgggcctgggatcccagaagtattcctctgtgattctgtaccacagctttaccttaattgggggtgtagggggtggggagaaagaggaagacagatgaaagcagggaaatccttcttggagtcatagttaaaaggataaaataagagctttagtgtagcctccgtttccagcaatccattttattctttgtccacaaactgaatgaaaataagcagtcattcaaaaatgatatttacgtaacctacaaaaatctcaatcaaccaaggaaaaggtggaatggggcttaatacaatacagggctgtctccggagttccctcccttgatttcaggcttttggtgtaaagctcccgaaagaaagcaactttgatttttattagactcttcaaaatcatctcggtagaatattgaccttttttgtgtgtggaaaaatgacttctacgaattctcttgtaggagtgtacattttggtcattttttggaatgtaggaaaaaaaatgtggggtaccctttattgcattttcaagaccttccaaagaagataattctgattgtaactcattataatctgggaaagtagattgttctggtttcaaggactgcgtgtgctttaaataatcacaggctgctctcagacttgggaacttttggtagaatacagcagtgattctcaaccagggcagttgtgttccttgggggacatttggcagcgtctggagacatttttggttgtcacgttttggggaaatgggtggtgctcctggcatctaatgggtagaggcccaggatgctgccaaacatcctacagtgtgcaggacagcccccccccaaccaagaatgatttagccccagatgttcatagcgccagaggtggaggaactgcctcgggggatgtgtaggagctttactttatgggttttttaatggaaaatatatgtatagacacgtacatatatatacgtgtacatacacatgtagatgactctgctcagcgcacccatgaagtatgcagtgcacctgtcccctgggatctggttatacgatgggtgtccagcctgtgcccaggggatcagtttcctttgtgctgctgcagtaccttgtcagcatggagagggggaggtcagttatgaggaggcccttttggggtagagtggaggaatggtgccgcctggtcaaggcctcgcatggggtagtgttctttgtacagttctaggtgaggcggcgaacacgttctcatgcattcttcatggtggtggtgatgctgatgttaagaccaacgggcctctgttgttctgctcaaggttccaagtagagtaggttttctattttcaaaatgtagttcacggtgtcccaatttttagtgcagcgtatttcaacaaaatgtccttttacacatataaatggcttatgttgcaaggtccccctcagcttcctggtgtggaatcagtgatggataaaggcagagaggctctcaggctgacatatactccctatgaagaggggggaagaactgtgttggcccatgggtgtttggggaaacacttgtattccaaggtatttgtggagaagatatgggatgtttttccatgttgggcttcggatatgaagtttaaggaaggagaatggagtcctggtgcacacctctcataagcacacgcacgctggccactctgctggctccagagtcatccagagcatcgagcatagtttctcccccggagaccctccaatctgatcagatagggaggctgtgagtctggtgacccccactgcagggggcagagctagtgcaggtggtgctgagctgactgggagaagaagggcctgcaggaccggctgcaaagcccttaggggagggaggaagtgaggaatttggtttcctaaacgggtggtccaagagaggccgggttcatcgctgtgcagtgaggtggcactggaaggagggagtcctcagatgggccaccctttggggctataagtctcgtggtttgtttctcttggcttcaagataacatatctagtttgggtgttttgggatgatgaggttggggtgtttgggaattgaggtggccgcgtaggcattgaggaagatactggtgttttgtgcggtcaaagggcaatggtgtggaactcagatcccagctctgaccctgtgtggtcttgggggatcatccaccatcagtctatttctctgtgacttggggataacagtacatgtgagcgtgaaataagagtataaattgcatcaatgtctgtgtgtcaaggttgcctgaggaggagttggctgggcttgcactgacgcttgattctttgtatcactccgacttaaaccacgacacttccaaggcagagtctaaagcctgtcctctcacaatcttctacaggtgagtaggaggccatagaccttgtgagtacagagtcctaaaagaaggcagaaatgtgtgaatctgccaaaagtaaagaaagggtgttactactggtcaaagtcgttgcaagaatgctggcttttacaactcctgtttctgctgctatcacctgctgcctgtgtcttgtttcctgggctccagatcattttcacatttctcaaaatggtccttggtagctgtggtagatggaataatggccctcaaggtgtatctccatcctaatcctggaacctgtgaataggtcattctacatagcaaagtggactttgtggacgtggtttaaggatctcaaggcctggtgccaggggctcatgcctgtaatcccagcacttgaggaggctgaggtggaagggttatttgagcccaggagttcaaggccagcctgggcaacagagagagaccctgtctctagaaaaaaactaaaaattagctgggcatggtggcacgtgcctgtagtcccagctactcaggatgctgaggtgggaggattactgaagtccaggaggtttaggctgtagtgagccatgttggcgccactgcactccagcctgggcaacagagcaagacactgtcccagaaaaaaaaacaaaaacaaaaggatatcgagatgaggttggggaggttgtctgggtgggcccagagcaatcacagaggtgcttctgagtggaatagggaagctgggggaacagaatcccagaggagataggaggatgggcgcagaggccccagtgatgtgggcccatgagccaagggatgctggcggcctctagaagctggacaaggcaaggaatcgaattctcccctgaagcctttaaaaaaggacacagccctgtgacccattttagacattgcacatcgagaacctaagagagtgtgtctgtgttgcttatggtagccgagctggagattctttgtgacagcagcaacaggaaacgcagacagtgggtgagcaccagatggtagagtcaagtttaatatgctggagcaaggagggtcagctaatcactggcaaaagatcagggcctgggacttttgctaactgtttctatggattcctccttcctcttgcaatgagaagcgacagcctcgtggtgaaatttgttagctgtttattattttcattgatctgattctactagtgtgatttatgctaagcataaatgaccaaagttgactgtggttttttgaagaacattggaaaataaacgtacaaaattatgtttttataataatggttcagtccaaaataaaggaatatattcatagaaattagctaaaattatagagggtaagttacatacatcttcttcttaaagatgctggtaccaacactggaagaagctgtacaagtgggcaggttgttttttgtttttgagactaggtgtcactgtcacctcaacctccccaagctcaggcgatcctcccacctcagcctcctgagtagccgtgactacaggtgtgcacctccacatctggctaatttttgtattttttgtagagatggactttcaccatgttgtccagactggtcttaaattcctgggttcaagtgatccagatgccttggcctcccaaagtgctgggattaggggcatgagctacggtgcccagtctcaatttttaaaaatatattttaccatcactttccaagctttttgtcctatgtgacaacagaaaattgaatttcttaatccacttacattgaatttaaaatccacttaggaaagtgagcttcaggtattagaattattaactccgaataagcagatactctagcatattttatcttccagattgtgttgtgattgtaacaagacacattttatgcattttagttttcatcacaaactggctgaaaatcatgttatgtacaaatatgacttgattcaatacaatttattgtttgggtataatttgaattagaaagccatttgtataccttttgctcacttacattatgctattatgcttttgacatcagaggaaatacacttacttaaaatcctcgcagatcccagagcaaatgaagagtttttgttcttttaaaaattggaagtagtctagttttctggttgtacagtaacaatgtgatatatattgtctttatcatatatacacacatacataaatcatctttccttcaaagatctcagatcacttttttaaaaaacagctttactgagatataatttacataccataaaattcccctattgtaaatgtacaggttcagtgaattttagtaaatttacagagttgtacagacatcgagacagcacaattttagaacattgtcatcactccaggaagcgtccctgtaaccattagcagtcacgtcctccccagcccctggcggccactgatctattttatgtctctggatttgcatattctggacattagatataaatccaatcatataacctgtggtcttttatgtctggcctcgttcatttagttttcaaggttcatccatgtcatagcatggattgatccttcactttttattttattttgtgttttttagaaacagggtcttgctctgttgcccgggctggaatgtagtggtaggatcatagctcggtgcagcctcaaacgtctgggctcaatcagtcctcccacctcagcctcccaaatagctgggactacaggcagacaacaccacgcctggctaatttgtttttagttttgtagagagagtgtcttgttatgttgcctaggctggtcttttgaattcctgggctcaagcgatcctcctgtttcagcctcccaaagccttgggattacaagtttaaaccaccacacctggcctgttttttattgttagataatattccattgttataaatatcccacatttttagattgattcatcagtttatggacatttggttgctcccatgttttttgctgttataaataaagctgctgtgagccctcgtgtacaggtgtttacatgcacatatgcttttattcctctggggtagatttctaggagtggagttgctgagtcatatggcaatgctatgtttaactttttgaggaactgccaagctgctttctatagtggctgcagcatttcacattcccacccaaatgtatgagggttccagtttctctatatcctcgccaacacttgttattctctctcagagaactttctgaatctctcttataatgcctagggggttccttgttgaagatgaaattagggactaccatgaactgctttaggaaacctgggagaaaggagtcaggcccctttttcatatctatgcagtgtaaccggcctctcagaaagattggttggagtggatgggagaataaagaaatgaatgggttgggtgcagtagcttacacttggaatcccagcactttgggaggctgaggtgggaggatcacttgatcccaggagtttgagatcagcctgggcaacatggcaaaacctcatctccacaaaaaaatacaaaaattagctgggcatggtggcacacacctgtggtcccagctacttgggaggctgaggtgggaggattatttgagcccaggagttagaggctgcagtgagctatgattgtgccactgtattccagcctaggtgccagtgagactgtgtctaaacaaaaaaaaaacaaaacaaaacaaaaaaaacagtacaaagtgttcagtgccgtcagatgttctgaatatagtatgatgagaatgcagtggtgggggagaaggtggattagtttctgtggctgctgtaacaaactaccacaaacctagatgcttaaaactacacacatttactatcttaacagttctgggctgggtatggtagctcatgcctgtcatctgaacactttgggaggctgaggtgcaagaattgcttcagctcaggagttcgagaccagcctgggcaacatggcaagaccctgtctctctctaaaaaaaaaaaagccaggcatggtggtccacacctgtagtcccagctacttggaggctgaggtgggaggatcacttgagtccaggaggtcaagactgcagtgagccatgcgagtgctccagcctggatgacagaacaaaatcttgtctctataaaaagaaactggaaaaaaaaaaaagtagttctagaggtcataagttccaaatgggtcttattctgctaaaatcgaggcatctacagggtggtggtatttgctgaaggctcgagggttaagtttctggttttttgttttgttttgtgttttttgtttttgtttttgttttttttttgctttctcagtttctagaggctgcccatattccttagctcatggccccttcctccatctttaaagccagcactgcttgttcgagtctttttcacattgcatttcccctttcacattgaaagcactcttctgatgaaccacttctgttaaaaccactcttatgatccaagataatttacttttttaaaagatgaactgattagcagcctgaattccacctgtagccttcattcctccctgccatgcaacttaagttgttcatggtttctgggaatcaggatgtggacaccttgggtggggatggaccttaactctggctgccaccaatggcgcctggtcaaagtatcctgtaggatttattcttggaaacggcgttaaccccaacgccctactttgctggctgtgtaagaaacacgaggtcagtcaggcagtaagaggagcatggacttgttttctgaaacagcgacacaatccattacatattttcgaatgacgagatgagatcagacttctgctttaggaagagtcacagggttttgtggatttgcaggggaaacaggcggtcagagggagttctgtgtcaccgtccagaggctggggtgccaaggagggcagtggcagtgggcttgaagagatgcaatggggctgctttggggctgaggcgactggactggcgtctgattgatggaataccaggagagggatgggagagggaaagagatgagtccaggatgacagttggaaagtcctggacttcggagtaaagggtagcgattgaggagttaaagggtagaatcaggctggggagagcaaatttacttttgaaatagtgacctttggatgctggacagggagatatgaagcaggcagaggaaatatgggcatgaaatagagcttcagcattttctacaaagaagccaccacattcggtgacatgacaagggagtgatgccagagggaagagaggtacaagggcagaatgctggggaaatgcctgtgtttaatgggcgtggagaacccgcttaataaataatgagaatatattgctggactgaaacaaaagtcctcattagctcattaaatgtttcctggaattcccagtcaaatctgtgaaacaattttaatgctagatgttttgtaagtatttctccggaaatctggaaatttgtccacagacccccagacattgtttataaactgaagtcagttgactcaagtattttgcaaatgtctatggaccctagtgtgattaatagaaacacaaattattttaaaggtgtcactcaatttacagtcattctgtatttttgccatttggtattttttcctgaaacattacataataagaatgcagcatgctttctttatgtaggtgatctgtgaaactttttgacaattaaaaattggtttttggccaggcacagtggctcacacctgtaatcccagcacttcgggaggccgaggagggcagatcacccaaggtcaggagttagagactagcctggccaacatggcgaaaccctgcctctactaaaaatacaaaattagccgggcgtagtggtgcacacctgtaatcccagctacttgggaaggtgaggcaggagaattgcttgaacctgggaggtgcaggctgcagtgagccgagatcttgccgttgcactccagcctgggcaacaagagcgaaactccatctcaaaaaaaaaaggaaggaaaaaaaaatatatatatatatgtatataaaaattggtttttgctgtttgttgcggcatcacttgcagttacaaagaagtgaacatagtggttacagattgggttgtaaggctggacctggccgtatgatgggttactaggcacctgttaaaaatagtactgtggaagtggtatatttattggcatgtccatgtgtttacaatatattacaatggtgttactgtaatccccaggagaccagcagcccagctgggactctgagagctctaagatacgtccttggagtaaaccaagctgcaaggaggtctgttcacttctgtattgtttatccactcataaatttgatttacatagctggactttggtgttgtacagttatctcataatgagggttattttaagaagtgtctcaaggaaatgtgtcgtgtgtttactgaggatagcgttgtatgtagtccacaatttcctctttctgggagaaattttgcacatgtatcagaagtctaggagctgtgtttctgatatttgcatcttctttattgtttagatactgtgaatccagcatctaactatagttccttctttgaggtctaggaaacttggaattggattgacaattcccttccaagtgatttcaggttgtatccgactgcgaactttggataccgccttcctgtctcagcttcgtctcctttgtcctaccatgatcttctcttggccccagtttacccagtgaattactttatttttgctattttgtatgtgtttttggaagccacccccagttttttctcttcttttcctgggtggggagttagaagtgttgcagtggatgatggtgctgtggctttttggaggttggtttgcagtagcttttgagttctggtgtgttagtgtcatcttattctaatctagctgcttcctgttgaagtacatcaagacgaagtatatttctaaatttattacgatgaatactctatcaaaagcagctggtgcttaggccctaggtagagctttaagataaagttctttaatatcaatttagaaaaagaaagattcataatgattaatggagctcctgcatcactgaattttactggaataaaaaaaattagtgggcttaaagttacattgaatgtagtggaaattctttttcttatctccattactgttggggaacaatttcatctaaaccccattgaaaactgggccttatagccttcagtatacttcataacatttgttggaaagcaggaaatgaaaacgaagtatttgaagtaaaagttcttaaatgtgtcccaagaaatgaggattactgcagaaagaatggatcagttatttctcgaattataagaaggaaatatctgcagccttttttgtcatcagtgcagcagccccggtttttctgttaatcatagctggtaataatgccctccggtttatagttttgatgagccgggagctaggctgcgtgttttacatataatatctctgttccatcagctgcataacctagatatccttcaccccatttttatgagactcatgggttcttgtctgggaccatgcacctagtaactgacaagattgcaaactagttatgtcacctgtggagttccacgacaaaggcaattctaggcgatgtttatgtagtgttccttgcatgccagggggattctgtgctctttccatgtgtgaatgatagcatccacctgctaactttgttgggagggttcagttatcctctctgtacaggtgagaacaggaggtactgaggacatctggcccaaggatactaccgctggcacggggtggatggtgattcgccctcagtccctctggcgcagcatctgtgctgtttgctgccaggccagctgcatcccagatagagtgacaggatctgttcgcgtcacatccagaaaaggctctgaggccaagctccctgcgttgcttctcactttcactctggaatcagaggtgcgtgcctggaggacttagctctgcatggacagctggtaaggtgtcacagagggtgaggtgggccattgtagcagagagttgttaagagttggttacgtgggttttctcacagggtacaaggctgaggaatgggaaaccagttaggagaccttgctaatagcgtggaccaaagatggggagtaggtccagacagattccgcagtgttcatgcagtgttcatgaagcaggtgtagacagattgcggggccattcatgaaggtgatttgccggggctttttacggatggaaaaccccttttctgtgttcatcccacctcctgttgtcgacagatgacacctgcacaatcaggtcctcccaactccttccaccacccaaagtgaaatacgcaagtcccagagaactgtgtcattcttaccgaagtggctgatgtaggatgttagaaacatctcccaccccaagttgtgacaacctgaaacatccccagacattgctaactgcctcttggagggggcacagtcacccgctgttgggaacacaggcctaaaagcttggagccagggctgactgtctgtgtaggctagaacagaattcccaatgacccatcaccatgacatctgacactcaaaccgcaccccaccccgaccccccacaaccaccaccttttaaaaatttccatttttggaaaaggctggggcttagaagtcattatgaaggcacccatttccagaagggtaagaatcagaaagttggctaattcgggtctctgctttacaggagttccgcagcgtctttcagtagagtgaagctccagtatttgtatgagtgttggggttgtttggtggtgtggggtaatgcaggaggagagaattggggaactgttaaccaccacccaaacaggctatagagaagaatgccaggggactttactgtgatggagacaggagcgttgaagtctgaagagtgacatctgggttctctgtacgttctgatttcttctgctaggatgagtatagaaacatgttctctggggtgaaagtgaagccttgtgaaattcatacaggtgaagctgctgatagcagctcttcccgatggcatgaatatggaggtggcggttgaagcaagtttggtttgtgaatagaaatatacgtgttcatatgtatgtgtgcacgtatgtgtttgtgcatgtgtatgctttaggacccagttcttggattagctgattatttttttccctctctatagacattggtgacctaggttttcagatacttatgtaagtgaatagttgaatttgtttgagcatatttaattgctttcctgaagggatttgctggctgttttgttaaatgaaattgaagacagtactgttgacctttccaggtgaggagggagtcagaagtgttttgcaaatgatggaaactgaaacgtgagtaccaggaccatatgatgttcagaaacttttatcataactacagtgaataaataaagtgcttgacaattagatttaaaattaagcttcatcctcattgcaaaatgtggagacagtgctttgggacatgaggaagagattaattaggattcttttctacctcaagatgcgctatgtcatctctgaacaaaaaactgattggtattacgtgaggattatcttcataaagttcagagttgtatctacggggacagatttgaattgctgttaattgacaatttgctgaattggaaagatcatattaccttaatactttaatgtatcatctttaaatgtgattctttttctttctctcactaaagattagtttcatgccactaaataaaatttaatcttttgctgtaatttaaataataataagtgcttacaaacatattatgcagctgatagcttgttaaaatttcctgtgggcttgttttttgtttagaagtactgattttgccagttgtacaagcatgaaatattgtttatcaagcctcataagacattaaagaggaaatcaagtttgtgtgactttaatgtctctttttctccttatttcagtggctcatacttttaccctgaacttgtaaaatctacaagcttaataagattccatattttataggaactaatggatattcaatgacttgcctgaagagtagactaagaaaatgtatttctccatgaatctttacatagaaaaatgaaagatttttcctgaatatttatttctcaatatatacagcattaatatgtctgtttttcttcaaagcagaaaaaaaaaaaatcagtgattgcctttgggttttgatcttgctctgtatttgttttaagtacacacctattacatgcccactgtattctaggcactaagctctaatgaaaagtggtttccagtcattcgaatggaacaggaggctcatgtactttgaagtgggtatacagaacttttgcactttggttttattctactttctgtctatgtccttggcactagaatgcttggacgacagtttgctatatctgtggtatttatggaatgagtgaaacatgcaaggagaatgccctggctgccgttctggcttctgccctacccagagcatccagtatacagaagcagcgtttcttaccacagcttgcggaaagacacggggagtagtcggcttgccatataaggaagttgccttcagtggccttgttcattttaggtgttttttaatacttgcttctcttataatacatgttactgttccgtgaggaacctcagcagctcccctaaggggaaaaaaggaggagtacttgaaggagtactgtttatacttcaggggcaataaaatccatgtttatgcacaaagggacctttccacttgtgtgataaccattctacaaggcccttgagttcctgtgaggaaggaaggacgccataaggaatgaaatcacagaaccttattatgaaaatagtaatggtgggatttggaaattatactcaattttttcttctgaaaacaaattgaataccacctgagagttggtgctaaaggccctgattttcgtattttaaaaaatttttggcatagtctttggatttgtgctgtcctaatatggtagccaccagctgtacatgagtatttaagcttaactaagattaagtaaaatgtaaaattcagtttgtctcacactagccacattttgagtgctcagtagccacatgtggccagtggataccttattagacaaggaagatgtagtgcagaaagttttattggacagaagaacaatggttattcagatatttccctattgggaattccagggaagaaagggaaaacttaaatctgaagaagaaaaattttataccaagggactagggggcaatgcagaaaaattaaccacatcaaaacaatttactacatcaaagttcattgtcatgacatattagaacattagcataaaggaagtatctatgcacttcccggatttaaaaaagagtcacacgaaggatcttggaatcagaatgacattgtatttcttaacagcaacacgtgaagttagaaaacagactgaacatagacttctttgaaaataattttccctcagaattttgaaggtgttcctccactaattattaattaaggatagaataaagatgtttgggccgggcgtggtggctcatgcctgtaatcccagcactttgggagtctaaggcaggtggatcacttgaggtcaggagttcaagaccagcctggccaacacggtgaaacctcgtctctactgaaaatactttcacatgtcacttctaggaaacttatggagaatatgtcccaccaaagtgagggagtaaaccaagaaagggggaggtttgggatcttggaaacagaaagaggcagaaggaattctcaaacaaaggtgttttcagggcagtggctcttgtagtacagactagagcaggagacaaattttaggaggaggccaggcgagatggctcactcctgtaatcccagcactttgggggggcccaggtggacagatcacaaggtcaagagattgagaccatcctggccaacatggtgaaacctcgtctctactaaaaatacaaaaattagctgggcgtggtggcgcgtgcctgttgtcccagctacttgggaggctgaggcaggagaatcgcttgaacccaggaggtggagcttgccgtgagccaagatcgcgccactgcactccagcctggtgacagagcaagactctgtctcaaaaaaaaaaaaagaaattttaggagaaagtttggtgttagtgtattggtcgaaggtgggagggatgtgggtgggtgttgcgggaggaagggcatggaactgacaaattatccaagagttttgatcatgtaaaaaatgtaatagattgttggagagtgtgggaaggattatcaaagagtacaaagaaaactgaaatgaaaacagaggcaaataataattctaggagaacacaaaaagtatactaaaaaaaaatcataggctgggtgcggtggctcacgcctgtaatcccagcactttgggaggccgaggcgggcgggtcacgaggtcaggagatcgagaccatcctggctaacacggtgaaaccccgtctctactaaaaatacaaaaaaaattagccgggcgtggtgttgggcacctgtagtcccagctactcgggaggctgaagcaggagaatggcgtgaacccgggaggtggagcttgcagtgagccaagatggcgccactgcactccagcctgggtggcagagcgagactccgtctcaaaaaaaaaaaaaaaaaaaaaatcataatcatactatattgcccactcagcagtgcccattccattgtcaaagtaatatatgtgaaatattgatttagctgaaaaaaaaagttatatgagctatcgaaaacgtggaagggtcagtgtaagattggtggtgggaatgtaaaaaaccaacaatccttacctatgtgtgtgaaaatcagtaagtgatatctaaacttgatgtattgattagagtatcacaaacagactatttagaaacatggaagtctggccaggcatggtggcttatgcctgtaattacaacacttcgggaggccgaagcgggaacgtcactagagccccggtgtttgagaccagcctgggcagcatagcgtgaccctttctctaccaaaaaatttaaagcattagccaggcatggtggtgtgctcctgtggtcccagccactggagaggctgagacaggaggatcacttgagtcctggaggtcaaggctgcagtgagtcgtgatggtgccactgcactccagcctgggtgacagtgagaccctgtcccaaaaacaaaaaacaaaaacaacaacaaaaaaacaaacttggaagtcactatgcagggaacagcaccaataacagaaacagctccaagaaagtggttgctttgggaagtggaattggtgatagatggtgctaaaaggcatgtaattaataaaaggagccttttgcctcacctgcattttaaaaaaaattttgtacatgtattactttgtaaagactaaaagtggtttggaaagtgaaagtataggatatactatctgtataattacagacattttggcatagttaaaagcagggtttcacaaccttggcattgattgacgtttgtgtcaaataattctctttgttaagaggacctgtcctgtgtgttgtgggatgttccgcagcatctctggcctccacccactggatgccagtggcattcctccgccagtcctgacaaataacagtatctctagacattgcccaatgtttcctgggggtcaaaattacctgtaagaaccacttgttttgaaggatttttaaatatgtcattgaataaacctcaatatataaccctgctgtttgatattggtaatacaggaaacaccagcttccttacacagaccttgaaccctggagcaaatgaagcggtttggaatcctctggcactggaacacccgcaatgctcatgctggtgcatgtattagtcagcgtctggctcttggcccggttaattcagagctcactaaaaacagaaaagggatcaggaggaaactgcagcttctctgtcatgcttagtggcttctgaaaacatattttagatttttcatgttgctttcatgatggtacaacttgaatttctctggagttgaaatgttaatcattatggcaaaaatattgcaccctttggatgcattccagtgctcaggtggctgcggacagatcctctctgtctctctgcttccctccacaattcttttgcaagttcttagttaagttattgtcaagtgtttttccctagaattgacacaggaagtcaacaggaaaatggtatctcagattttttgatgtggatgaaacctcataaatagtttaaaaccctcatttcacagctgaggaaactctggtgcagagagggttttttacaattaattgggagcacaatggggcctggaactctgttcttctgttttactctttccttttaaaatacaacatgtgtgcccagtaatgctggaggaggatgatagaacgggctggggaagggctagggcatctggcgggtcatgggagtttgtcaggattttcgcactgttagaagttctcagcatcctctgccaggggcgtgtacccttagtaagcttagagaaaatggcacagagaggcaggaagtgtagtttccatgatctttccaggaggtgctcctgtacctcagttcctgatggcccagaactgggtggagagtgtaggctggtgcattggcgtgtctgacagggaagaccctggcctccttatcttgcagctcttgctaccagggcactcatggagccagcgtgcaccgccactgcagctgttcttgaagaagtggccagaagagtgaaattggcccgttgaggaagggtgtggagctgcttctctgtgggtccctgcatgacttccctgttccttcccctgggatcaaccttcctcaccccacatggttcagcagatgagggttaagtctgccccagcttgggggacgctggtgtcccactcaaaccggttgtccagtattttggtgctgcaccaggagagtgccatctgcagtctgcagggctgtcttgcccaggtggccccttcttccctcggatggatggggcatactgttctgaccaccatgtctccttccaggccacatcctctttcgtgagcactgtgagggcatcaccccacatttttagaaacctcagcgccccatcttgcccccatcccttgcctttggcaccacttaaactacagcctcattctcttcctcctcgcctgagttctccagccaactcaagtgccacctcctccatgaagcccctgtaggtttcctccactgggacaaggacgcgcagagatgaaaggcagagaagtccagccctgggacttccaggccgtcagttcaatcctttgagcctctgtctcctcctctgtgcagtggggcagttcagtgctcccccttagtgctgtggcacgctgcgttgattggcctgggtgctgttgcggatgcccagcgagttctctgtctccctcctggttcttgtcccactccctgctccctgttacagcctggaagtggttggacggtttcccctgggagtcttgagaacccccaaagacgccatgcatcttcttgtcctcttttcgtggcatgttctgtgttgtgtgtgtgtgtctgtgcaacgtgctgtggcattatgtgtgtctgtgtttgtggcgtgttgtgttgcatgtgtctgtctgtactgtgtgtgttgtgtgtgttgtgtgtctctggcgggctgtgtatgttgtgtgtgtctgtgcacgtgctgtgcggcatgctgtgtatgttgtatatgtctctggtgggctgtgtatgttgtgtgtggctgtgtattttgtgtgtctgtgtggctatatgcggcgtgctgtgcatgtcgtgtctatctgcaccgtggtttgtgtgttgtgtctatctgcgtggtgtactgtgtgtgttgtgtctatctgtgcagtgtgtctgtgtggtgtgctctgtgtatgttgtgtctatctgtgcagtgtgctgtgtgtgtgtgtgtgtggtgtgctgtatgtctgtctgtgcaaggtgctatgtgtatgtcgtgtctgtgcagtgtgctgtgtgtgtgtctgatgtgctgtgtgtgttgtgtctatctgcagtgtgctgtgtgtgtgtctgtgttgtgtgctgtttgtgttgtctctatctgtgcagtgtgctgtgtgtatgtctgtctggtgtgctctctgtatgttgtgtctatctgtgcagtgtgctgtgcgtggctgtgtggtgtgctatgtgtgttgtgtccgtctgtgcaccttgctgtgcatgttgtctatctgtgcaccttgctgtttgtgttgtgtctctctgcacggtgcactgtgtgtgttgtgtctatctgtgcagtgtgctctgtgcggtgtgctgtgtgtgtgtctgtgcagtgtgctctttgtgtgtgtgtggtgtgctgtatgtgtgtgtctatctgtgctgtgtgtgtctggtgtgctgtgtgtgtgtctctgcagtgtactgtgtgtgtgtggagtgctgtgtgcgttgtgtctatctgcagtgtgctgtgtgtgtggtatgctatgtgtgttgtgtctatctgtgcagtgtactgtgtgtgtgtgatgtgctgtctttgtggtgtctgcagtgtgctgtgtgtgtgtggtgtgctgtgtgtgtgtctatctgtgcagtatctgtgcaatgtgttgtgtgtgtgtggtgtgctgtgtgtgttgtgtctatctgtgcagtgtgctgtgtgtgtgtgtgtggtgtgctgtgtgtgcacgtgtgtggtgtgctgtgtgtctgtgtggtgtactgtgtgtgtgtctatttgtgtaccgtgctgtgtgtgtgttacatgtcctgagctcacgccttctgttttcacatttgactgtgattactgtcctttttgagatctgagtaacagggacagggctgggcccgatgacttaggcctgtagtcccagcacttgaggatcatttgagcccaggagttggaggctgcagtgagctgtgatcgcgccactgcactccagcctaggtgacagagtgagaccctggctcaagaaacaagaccaaacgaaacaggaatgggtggccagttctgccacttcctttttatttgtgaaatctaagcacatacataatccaggtagttgtcacggaaaggggccataactcaagagaagtggtgccctggagcctaaaggctttcccattaggataaattagaactggaaattgtcataaagacaatgcagggtttgtggatttcagctggatgagtaaagaccagcctgggcgtgaaggattttcatagtcagttgctaaaggtggtgccccaggaaggctatttggcaggcgtggggcgcagtcctggcatggggtgggatggggctggaggtgctgctaatctatcttattaaaacccaggaagtttcacaggcgccttccaaaccacagctcgttgatttaaagatgtgaattccacgtgtgtaagccaacagaacaattgcgttttgtggtctctggctgatgaaaagtccctgatgaagtgctgtttggtaaaacgattcctctccattttcctcccttccaatctgtggttcacatttattcaacgttcttttctttcaaacagcatttgtgtgtagccaacacacatgcatatggagtgctgcgaagtctctgtgcattatctggaaacctgctttctccagaaaagctgactatccacttcccgtgctctcaagcccaagagacaggaatgggacgtggggagcgcgtaccctcttctcaacaagcaggttgaaaatccagtgaatttctttatgatggaatttgaatcacgtggacattcattagaatatttgggcaggattaagcccttaaaactggctctagattatggttataaaatggcctcaaaggaccctgaaactaatgaaagaattcttccatttctgacatgcttcactccctctggctctggctcttatcccaaatcaaagaatgttggtttttttagtgtttcctttataaacaaggatggtttccagattttttttttctttttgtttttttttttttttttgagatggagtcttgctctgtcacccaggctggagtgcagtggcgccatctcggctcactgcaagctctgccttctgggttcacaccattctcctgcctcagcctcccaagtagctgggactacaggcccccgccaccatgcccagctaattttttgtagttttagtagagacggggtttcaccatgtcagccaggatggtctagatctcctgacctcgtgatctgcccgcctcggcctcccaaagtgctcggattacaggcgtgagccaccgcgcccggcccaaagtgactcttatactccattataattatgaatttggaaaacaataaggatattatatgagtctgctcaggctgctgtaaccaaagaccacaggctgtgtggcttaaacaatagaaatttcttttctcacaattctggaggctggaagtccaagatcaaggtgccaggaaactcagtttctggggaggcctctcctcctggcttgcagatggccgccttcttgctgtgtcctcacacggcctttcctcggagcgtctgtgtatgggtggggtggaggggcaagcagagagcttgcacacttcgacaatatgaccatctatcataggcatcaatttagtttaacttcatttcatttacagggtgttaaaaaggaaaatcatctgcataatttgagctttttcatagtgagttctgaatctaatttattttgagttattacagaagtctgcggatatcccaccttaagatagccatatgcacaattagtcatttcttaagggatcccccaatgtgaaaagaattccccgagaaaagacgacctgaaagatcttggcctttacataagtgtacacagaattatttttattgtgataaaatatacataacataaaacttactatcttacacagtttaactgtacagtttagtggcattaagtacactcacgttactgtgcaggcatcatcaccatccttctctaggactttcccagctttccaagctgaaactctgtcctcattaaacatgagctttccattccttctctccccaccaaccacctggcacccactgttctactttctgtctctgtgaacttgatgactctggatacctcccgtaagtggaatcctacaggatttgtcccttttgtaactggcttatttcacttggtagaatgtcctcaagattcatctgtattgtagcatgtgacataatttccttcctttttaaagctgaataatattcccttgtgtgtatagaccacattttgtttatccattcatgcatcgatggacagttgggttgtttacaaggaattattttaaagccgaatccagggtggctggcttgtgactactatttagatgcagacagtgattccaggtggtgcgtggtgaaatcatgtcacacccccgcggaaaactccacagctttcctcatgtgccctttccatcacttctctgctgctttaggaactacttttcttctgaggtgacctctttctgttcctttcagtttttaaaggaaagaatagtagaagtattaaaagcagcagcagaagtccacatgttaaccctgtgccagcccacatccccttgtgatctctggcagtggggtctcttctgctagcttctcccgagcttcctgccaaaaccctgtagccggccttcgccatgtccctgaatttgcttttctttttccaccctctacaaccttcctttcctgcagaagtataaactttcaatccgtgtgtataaactttggggacacttcgcaatcagcatgatgaagttttatttttatgtgaaaactcttgatgattctgaaattgtggtgtctgtaacttaaacatcatctacaaaatcactgctctatctttggatgtgagtttgttctagcatgttatcacagtaccgaattccaaagaaactgctgtttacttaccaagggtaggctttcaactcagatgagtttatgactttatttacatggaatagtcaaaatggacttctgacatttgctgcaaagtaggacaacttaattgatattgatggatctactcatttattcagcagataacaaagcccttccgattgcaggtgttgtggagagagcaggatattcatttgctagggttgccataacaaagtttgatttgatttttggttggggatggaaactgtgtaggaggcaagcgtggagcttgatgtgagctccttgaaataatgaaaaaccagttacaaaatctgtattacctgtagcagtacacattctcccaaagcattctgttggcattttaaagtcctttaaaacacacagctgctttctgttgcttcaaactaaataaggcattatcttcacttttccttttgttaacctaaagaaaaaccttcatttgtaaagcaaatcatcacagcaggaggattttctggtttatgcactagggtgcatttaatctttattttacactgctgattaactttatgattcaaattttaacttatagtttctttttaaattaattacattattgggtgctttcatgtttttgctaaaagccttcctattagaagcactacaattgacagtgatggactgacctttaatatttttttgttatgtgaccagtgtttggtttataaaaatttttctctaaaacaccaacttttggctgcaaataccaccttttcacttgggttcttttcatagtgtttatttacatgggatattgtcactttgcacgctgtagctatttgtctttgtcagcaaatgtaggtaaaatattaatcttgtatgaaattcagataagcagggaacagatggatttatggtgcttgaaacctctgaactctgcagctgtggcaagttgttgaactgtaaataaattctggacggtggctagcaggggctggcgtgacctcatttgccccacaatacctcaccgtgccagggatgcatttcctgccctgtgccacctgtggtttggtcctagtgctttggggccgcagagtggagctgggctccctttgaggaagtcatcagtgctgagagccctcctcacgggtgagagtccagtgggatgtgtctgagcagcctacgctgggcatgggccggggcacgctgtgtcccaagcatgctttaggggtcccagtggcaaaagcacatttgtggttgtttaatctctggaggtggaggatagccccagctcctgggtcagtcagctggcggaacagggtaggccaggggagacagcactccaccctgctgggcatcttattaaatgcagcccagtatattcaatgccggcatcactacttcatgggaaaggatgcagcgcttacagcaggtagtggggtagagtggctgtgtggggattttcaaaatggaggctaaagtgatgcactttggactcgctggaaagtgcctggacctctggtgagttcagcctgggaggtcagagcaccacaaaatttgcttgctgtggctgggtgcagtggctcacatctgtagtcctagcaggagctcagtagtccaagctcaggagtccgagaccagcctgggcaacatcctgtctccaccaaaacaaaaccaaaaacaaaaccaaactggcttggtgtggtagtgtgtgcctgtagtcccagctactcaggaggctgaggcaggaggattgcttgagcctaagagttcgaggctacaagtgagccatgatcataccactgcacttgagcctgggtgacagagtgagaccctgtctcaaatgaaaaaaaaaaaaaaaaaaaaaaaaagtacttgttgcctggccacaggaaggtctgtgtgttggtttgtttaccttcccgaacctttgctggggagactttttatgcccccatatgccccagattcactaacaagaaggaagtgttctgttctgtgtaggatgtgcagaaacagccttgaaaatgttaccaatcaccgaccttctgaaacgagcttctgtggatactgggaaagcactgggacaccattcccctcactcctgcctctgcttccccagggtggaactggcctgtgcttgatggtgccagctgtcataaagaagtcattgagcatccctgcatttgcactgtgtacccagcaccatggagggatagccactttagccaaagcagtttttcagctttactgagatgtaatttacataccttcagactccctccgagggtgtttttttgtgtattcgcagagttgtgcaatcatcactatctgagtttagaacatgttcagtaccccatgcccactgtattagtctgttttcacgctgctataaggaactacctgagactgggtaatttataaagaaaagaggttgaattgactcccagttctgcatggctggggaggcctcaggaaacttgcagtcatggcagaaggcgaagaggaggcaagacacatcttaccacagcaaggcaggagagagagtgagaggggaagcgccatacttctaaaccattagatctcgtgagaactcactcgccatcacaagaacagcatgggggaaacccgcccccatgacccaatcacctccaccaggtccctcccctgacgtgtggggattacagttcgacatgagatttgggtggggattcagagccaaaccatatcacccatcagcagtcacttcccattcttccctccctgtcccaaccggtgcaaccagcaatttactttctgcccctatgcatttccctattctgacatttcaggtaaatactcacaacatagggacttttgtgttctcatttcactgagcattgtgttttcagggttcactcatgttgtcccctgtgtcggtgcttcgttccttttcatagccagattatactatctgttcatcagttggcgggcgtttgggctgcctccactgtttggcgattgtgaatagtgttgttgtgaacatttaagcacacgtttttgtgtggatgtatgcaaagtcattttttttgaaagccacttactacacgattggctaacttccatcagagaaatgttgtttggtggagttaaaaacagattatctgtgtactatattaagttgggtgaggaatgatgaagtgtaaattatacttacataaatattataatgctgtgcagaaactcttaagctatcattcttttagaaaatgaattttatgagcttgggacctttttgttaaccaatctgagaaaagtctgttgtcagtgtggacatattttacctttaaatggaggaggggagagaatctttcaaaaacattaatatcagtgagattaatactaatctgtcaagatgacccagtgaacagttggctatcaaagtattataagaaggtttttaaaaggaaagtgtctattttgtaaagatcttgagtaaattatgcttttaagtatgttttgatattcccccccctcctcccaaagtgtagcatgcctgagcgctgtcatgtttaggaggtgatgggttggggttagagggtgattgactgttagcgaagtgggttgggatgaacaagtgcacttgagtacgcgctgcacagtgtaggcatcaggccacgtcagtgtgtctctgcatttgggcagatgccaggcctattgcaggcagcataacatctaggaacgggtttatggatgaacctgggtaactctgggagcacaaacccagaccacacccatcgggagagattgacctgagtgatgcgctaacgcatatcattgagatggggccagatatcttgcttagatgaataattggagttcatgtcaaccatctgtcctttcccataatttaaagccaacttctatattttccaggttcatactttttttttcattaattgcatgtaaagttgcggtgaacaccttctttcttgacttcctgtttaaaaaaattacagttcttaaaattataagcttattcaggatggagtggtcagtttgtagaaaaactagctctttagatcttttaaaagcactacattaaaaaaaaaaaaaaaaaaaaacatcggacgtggtgggtcacacctgtaatcccagcactttgggagtccaaggtgggaggatcgcttgagcccaggagtttgagaccagcctgggcaacatggtgaggccccatttctacataaaattttaaaaattagccgggagtggtggagtgcacctgtagtcttagctacttgggaggctgaggtgggagggttgcttgagcctgggagttcaaggttgcagtaagccgtaattgcaccattgcactccatcctggatgacagagcgagactctgcctcaaaaaacaaacaaacaaaaacaaacccagagaaactcaaaaaccaaaaaagaggtatccttattttcccaggcctcaatgatgaaatgtgcccagtgttcatttgaatctgcccatcaattagtcttttcctgatgtctcagagaagcatgcatgatgtacggaatgtcttgggtgacctagagcggcatccccaataggactgccctgtgaacatggccccacattcggctcttgggcacttaaaagatgtggccattgtgactgagaaactgaattgtgaatgttatttaattttcacgtgtttaagatgtggccagagcagacagatgaacagtctggcttgatggataactgcagggagtttcacgatgctggtaggaggcacagtgagcttctggaagagccggccccacctaggcctgattttggtggctgctcaaaaccgctggtactgaattcctttagaatagtgcttctcaaagcgggtgactttgtatcctccccaccctccaggggccatctcacaatgtctggagacatttttggtggtgacagtgggtgcttctggcatctggtgagtagaggccagggacactgctcaacatcccacagtgcacaggacggcctcataacaaggaatcatctagccccatatgcgccacgatggaggagccctgctttctattccgaagaccagcagtcctaagatacgatgtggacagcacagacccagttttctaagtgaagagataaggcttgagcaggcagcagcctggtaatgccaaggccaggacagttagccaagtgtctgagtccatggagcttctcgggcagtgttctcttttctcttcagctattccagtttgtattaagtgtaagaatatgaagttgatgtttgtcgtgagtcaagacggtgacacagaagcagtctttcgtgctttggtctaatagctttattgttaaaggagagaaacagaaaactcctctttgcctctgcagttttctctgaaattgaatttagggaaagctgaccctagaccatgcgtgccctttccaccagcatcgctgtgggttccactcgtgggagatcgataaggaagtggggatgaccacgctgcacagaagtgttctcatcacttttgcgcttgcttatttaacccatgattgttagaaagcgtttagaaagttggtctttgcaaaccagccctgttaagtgctgagatgaaattcttaactttttttttccttcttagagataaggcctcactctgtctcccacgctggagtgcagtggcgcaatcaaagctgactgcagcctccacctcctggactcaagcagtccccccacctcagcctcccaaattcttaaaaatgctaacagtaaccctcacacacaaaaagtgctgccgttagagatggcactggtattgagaagcacgtgctgtcagtgttgcaattggtaatgcacaccacacttgggcatagaaattggaaatccaactgcgccaagctggagcctgcagaaaggagcacgaggagacgggacagcaatagagctctgtcgacggcgctaagtagaaccagacgctgcaataagacaagcgtccccctgtgctcagtacaaatgggttgcctgtggcagatgcaggggtggctttggcagagagacggctcctggcatcgtggaattgaattggctgtttcttttaaagatactgcaaattgcggcagcatttatcatcctaaggaagcccgcacagcttgccaaacagataatattgatgatgataacaacaatgataaaaggaaaccatgatgcctctactcaatgaaaatcacttttatcttatttgcaaaagtcagaggtaggacagatgtgtcagcgtcttaataagacagttattcaaggagttaaattgaaattattcacatacccaaaataagctatttggcaaacctggagacccaggggcctttggatctatcttagtgtaaaatttcttgaagcagagacctagtaggtactctgttgcttatggttccaggcaatgtattgttttttcttccccctaaatatctgtgaatgtgtgaagtaccctgtgtgccagagatggaaagtaaaaccacagaagcggggtgcggggagatggcagctaaattccttttcagcagagttgaagcatcttgttgtaagagtctagctccacaacagtgggatgcaggaaactgtaacagctgaaatacccaacagatgtattcaccatcagtgcattgggaaaccctctcaaaagtgtcatcacaaatgatgatcttaacttttgtatgacaggatctttaggtcacccaacagtaggtgcacagtttctatgatttcaatttttaccacttctggagacttgtcttcccatttcttgtatcagtgccttactgatagagttggaaattggaaccaaagtaattagattggctctccagatctcttacatgagccaagaaaggattcaaaagcatgccctgtttccttcttgacaggctgggagaggaagtgaccgggaagtgaattgctaagatgtggtcgtcattttcctttacaccacagagcctctgcgtttgggaactgcaggttcatccgagtcaatgtcagaagtgccttgtgtctactgtagtgaacatcctttgtttccatcgggtcctgtgggaagcagcactgcttattgggtggtttgagggtgaatgctattttacaacttgtgacccccttgacacactaccttttcattttagcatggagcacagagccatttctcccctgtgctggattttgaatgttctttcaaccaccgtgatagaatgtccaagaaaggaacaaaggaagaggcaactaagggaatctttcagtgggttcataagccatgctgctcctggctttgacaggagttaaaatcatgggtatccctaaaccactatcattattggagttgctgttactgtcgacgtaaagagtcaaactctgtaaaatatttgaagagatttattctgagccaactctgagtggccatggcctgtgacacagccctcaggagatcctgagtacatgtgcccaaggtggtgggggcacaacttggttttatacattttagggagaacacagcttggttttatatgtgaacccccaaaatctgagacgggtctcaatcaatttaggaagtttattttgccaaagttaaggatgcgcacccatgacacaacctcaggaggtcctgacgatgtgcccaaggtggtccaagcacagcttggttttatacattttagggagacatgaaacatcaatcagtatatgtaggatgaacattggtttggtctggaaaggcgggacaactcaaagtggggagggggctcccaggtcataggtagacaagggacaaatagttgtattcttacgagtttctgattagcgtctccaaaggaggccatcagatatgcatctatatcagtgagcagaggcctgtcgttgaatagaaggggaggcaggtttgctctgagcagttcccagctggattttccctttaacttagtgatttgggagccccaagatttattttcctttcacatacacatttgagggagacatgaggcattgatcagacacatttaaggtagacattggttcagtccagaaaggtgggacaacttgaagcaagggtgcagggggaagggggggtgctttcaggttataggtagatttaaaatttttttgataggccattggttgaaagagtcattaccaatagaaaggaatgtctgggctaccttaagaggttgtggtgaccagtgttttatcctgcagatgtagcctccaggtagcaggcttcagagggaacagattgtaaatgtttcttatcagacttgaggtctgtgatgatgttcgtgctggaggggcttaatgaggcatgcttgacccccacttcccggcagtcatggcctggtccgtctttcaggataaatttagttggccttggcccagaggaggaagtccattcaggtgcttggggggctttcgaatgttattgttggtttacattatgattgtcattgttattaaaaaactaagggctgtagagaaatggttgcagcatccatcatgtgtccctaggaattgcacatagctaagtgagaacctcacagaaccctttcacgtgcagcccgatgctgtcactgttcataaacaattgtattttgccttcctgaaaggccatctgagttcattaaacttgcatgcttccatatctatacattcttttctcatggcctctttgtggatggtttgttttaccatttgttgtccatcagcttgaatggtagggggaagagttcacaccgtgccccctgtgtagcagaatagcccacagttcaggcatggctctccagcaaggagctttctagggctctgatgctcaccagtggggggattgggcacccctccgcaactgccaggggacattgacaatgtctggagacattttgggttgtctcagtagctgtgtgggggatgctgttggctagtgggtggagccctgggatgctgctaacatcccaccatgcacagtacagccccaacagccaagagtgatggctcacaaatgccaacataagaaacccattctagggtacctttcatttgcttagtgctgcgagaaggtttatctgccaaagatcatcatcttggagagggccaagatcctgtatcctgtactggacagatatgcaggcattcaaattctgaaacgccgttggaaacatgaggctcggatcacagaagcctcctgtacatagagcaaatgagagctggaggcctgctgcccagcccagctgagtcctgtttcttatttcggttttcctttagattccaccgaagtttctctgaagaatgctgactcaggctgccccttttattccatttctttgcagggcagtttaggtgaagctggaacacagtgttccctgaggaagcattaggacaattagaccctgcctttgctaaatgaatgtatcaagaaccttcaacgtctttacaagaagcaggataaccattttgcagagtactgtgcttagtagcagagcatggcttctgttacacagtttcagtattgcaaaggtccccagccagtacagtcccacccttaattactgcttcagagctgcaagttaacgtttaaagtgttttcacagtagcttgaagtgtgatctcccatattacggtcatatccttggacttagcccatgttacataaattagatctttataagcagcacacttctttgcaagcaatttgcttccctttgggaatctgattccatagaaaacagtagtattttaaacatgttgattctagtacttacagttctattcacgtgctcctggtatagtacatctaataagaaagaatcccttatttttacttttatccaaatgcatgtatgttctttcagcatgagatataatttgtctgatcaagtatatagggagatgagattaagaattaagatttgtttcaagatatgagattaagaattaagatttatttcaagaaactcaattgcatggttgctcgcataagccactatgcagtggcagctttaatgaatggggttccaatgttttccttactgttttcaagaaggtagtgaataaaattagatgttaaagcgaattgcattgtgtgaagattgggacagatgccacatatatagttcagatgcttgcctgccagtccctgagatatactcttagcttgttaatatggaaattgtcaaacatattcagaagtatacagaatatcttggtatattcctgtgtattcttcactcatctccagccactgttagcgtgtcacgagcttgtctcatcgtcccctcactgttttctctttagagtaatttaaagcagatctcagacatcatgtgatttttacctataaacatttcaagttgtatccctaatatagaaggatttttttatgatactattattctgtaattgtttcctgtttgccttaacgaaaagaccacagactaggtggcttaaaatagcagagatgtattgtgtcattgttgaggaggtcagcagggtggtcaggcggcagcagggtggcttccttttggaggctccaagggagagccccttctgtgtctgtcctccaggttctggtgcctgcaggtgccccttggcctgtggctgcataacgccaatctctgtctgttaggaggacactgtgtttagagcccatgcaataacccagaatacctcatctcaggattcttaatttaattacatctgcagtgacccttttttcccaaatgaggtcacattcagtcttttactatataaggtcatattcacagagtccagggatcaggttgtgtacttaatcctgtttctttcgtgctcatgggaatgtatgagttaggggaatacagattatctttgtgttgtagggttttcttaagattatgatttattgaaaaagaaggtcaatggcatataaaggaaaatgtcattgataaatataaaaagaaatgcaagttttttaggccaagcagaatgcttataggagccagtgtcttggattaaaattatatgtgaacctcaagtgttatcatctataaagtgaaggtagccgtgaattacctcttagattgttgtgaagataaaaatgaatacagcattaacacagtatataaatgctaagcatttagtaattatagttcgcctctttttttctggaggctcaaagttgattgtaaatgtcaaaccaagaaataatactaggtactagcaacacataatgcaaaggaatgattcctgtgatacatgaagaactcctataaagtactaaggaggatgaccagcagcaggccatgagaaaaatgaaaaaagacatgaacagttttcttaaagggaaataatgaatagctctaaaatgtatggaatgaagctcaatctccctcatgacatggggaatgcagatgaaaagtgtaaggtaccatttcacctttcccattagtagaggtcagaggtgtgactgtgttccgctggcaggagctcaaataaaagcgggtgttgttgctggcaggcattgcaagaggtccagcctctttggggagcagattggcaaaagatatctgacctagaattgtcacttcttgggatttagctcatggacatagtgtaaatatatgcaaagaagtactcacatgatattcaccaaaggcattgtaaaagcagaaggatgaaagcaaccacccacagtgaacgtgttagattataataaaggcatagaatctatcaaacaataggaaaaaaagcataattctgtatatggaatgaactccacatgacgctcttgcatgtaaaaagcaagacagatacctgattgtgagtagagtttaatacaagttctatgtcaaagtgggaggagctatatgggctggtctaggtagaatatttctggaaggaaataccaaaaattggacttccctgttggggagaggtggattttagagatggggtagtagcagcttctcaaaaaccaagagaaagcttcgcatttacaatgggattattggaagcaataggaaacacccatttttgtaaaatctgtgagaatgtgtatacttggtaaaagtatagatattcagccattaaaaggaatgaagtattcatatatgctacattgtgagaattgaggatatgctacattgaaagaaaccagccacaaaagactgtataaggttccatttgtggaaaatactcagaaaaccttgggggaggaggggacaggaagtgtctgtttagtgggtattagatctcctttggaggagaggaaaatgttttggaattagatacagaggtggcggtgattgtataacattgtgaatgcccccaaatgccactaaattgtacacttgaaaatggttaattttatgtcgtgaatgttacttcaatttttaaaaaaatccaactgcaaggagagaagattctctagggaatggcttgtcaaagcatccatgtcaaagggaccatttaaaaatttccagtctgaggtgggtgcctttgtgaaaagcaattaaaatgtataactagaagagcaatcatgtctcagacaccaacgcaagcacaacttgccctaagttttctaagcacttcttacctcattcattcatcaccagagacagacagttcccaggccagaatccgcacctggatgcaacttttaatacatggatctagagttgtgttcttccagctctagaagagctccatgccacccccctcccctcccccccccgccacagcttgtcagaaatgcagatcacaggccgtctctaggtctgctgaatgagaatttgcattttagtaagctgcctaggcagctcagaagcacattaaagtttgagagggtaatttggggacagtaaagtgcagtcggaggaggatggttttgtggccctttggactggtcacttaatgactgtgaccctgggcaagggactgggttcgttccctaggctcctgtaacagagtgccacagactggtggcttaccgtatagaaacaaatgctctgcagctccagaggccacaggtctgaaactgtggtgttgtggggttggcacctgttccaggcctctcttcttggcttgtagaaggctgtcttcatgttcacatgaccttctgcctatgtgcagttctgtatccaaattccccaccttaatgacatcatcttcactaattacatgtacggcgaccttatgtccaagtcaggtcacattctgaggtactgggcgctaggactttaacatgtgaattttaggggaacacagttgaacccgtagcagtacttaacctttctaatcctcaatttcgtcatcttaaaaatgagtaaactacacattaatgtgggtaccatcaaaaaaacaaaaaaaccaacccaaaaaatagtaagtgttggcagggatgtggagaaattggaactcttatgcactattggaaggatcataaacaggtaaacactatagactatagttcagcagtttcttaaaactagaattatcagatgatccagcaaatccacttttgggtatacatccaaaagaattgaaatcagaatctcaaagagacacttacacactcaggtttagagcagcgttatttatattaaccaagaggtggaaacagcccacatgtccctcagcagatgactggataaacaaaatgtggcctgtccacacaatggaatagtattcggccttgaaaaggaaggaaatcctatcacatgccgcaattttgtatgaaacttgtggacattatgttaagtgaaataagccagtcacagaagagaaatactgtataatcccactttcatgaggtatctaaagtacacaaattcgtagagacagaaagtagaatggcagttgccaggggctgggggaggtgaaatggggaattgttgaatgggcatagagttggagttttgcaagataaagagagttctggagattggttgcacagcattgtgaatttaacactgttgaactgtgtacttaaaaatggttaagaggctggatgttttgggtcacacctgtagttccagggctatgggaggctcaggtgggaggatggcttgaggccaggaattcaagaccagcctgggcaacatagtgagaccccatcttttacaaaaaattaaaattagccaggcatggtactgcatgcctttagtcccagctacttgagaggctaaggcaggaggatcgtttgagcccaggaggtcaaggctgcagtgagctatgatcacacagttgcactccagcctgggtgacagagcaagattctatctcaaaaaaataaataaataaaagatggagaggagcgttacttttttgtgtgcaggaacgattgctgactgcagagcctggctggctaaaattagatttgccttgtcagtataataattgtaggtatttttggagggaaggatgcctggagcccggctgggttatttccgcccttggagtgagccagggcagcttagagggctacccgcgtgcagccctggaaggtaccgaaggagccctggaggcaccgagcgctggaggcctcatccctgagcaggttgccctccttctggtcggatggcagggcggaaacccatctgtgtcgggagtgagagctgtctgctgtccgcggcttgcgcttggagcttttcctgcagtccagggagagcagaggaggccagtgacttccatgaaaacacccccagtggtggggagggaggcggcatcccttggaggtagggatggggcccctgctgtgacccattagaggcaaagaagggcttggaagtttcattttgtcttacatgagtgtgtgtgccgagttcacattatttgcacatctgtgtttgtttttatataatgataaggacatcagtttccattgataaactataaggaagatgtgccatgtttaccagggccagagtgaagagactgaggtgcttgctttgggagaaaaatttgagggggtgacaaacaccacagacatcaagataaattatctgtgtgtattttaatagctttattgagatgctgtgcacagccatacaattcacgcatttgcagtgcacagttcagaggtttttactatatccacagaggcgtgcacccgtcaccacagcccagtttagaacattttcatcacctggggaagaaacacccacccagtggcagtcacttcccaccccacccccacccctgccaccgtgcattctgctttctgtagatgaatgcgtttgtctactctaggaacctcatacaagcagagtcatacagtgtctgtccttctgtgtctgacttctttcactctgcgtgtgttcctggttcattcatgtggtagcacgtgccagacattcctttctgttacacagtactgtatgtattatatatgtacacagccggctgttcatatccacgagttctgcttctatgaattcaaccaaccgtggattgaaagtatttgggaaaaataataatgcaacaataaaaaaatacaagtttaaaaacaaatagagcataacagatatttacatgacattgacattgtattgggtatgatacataatccagaggtgatttaaagtgtaagggaggatgagcggttatatgcagatgctactcccttttatctaagggactggaggatactcggattttggtatctgcaggggtcctggacccatcccctgtggatgctcaggggcggctgcaccacatttgatctatgtgttcatctgtcagtagatgtttgggttgtttccattcattttttggctaagtgaataatattttaatgtgatatttaaaaaattaaaatgaatgcaagaaattccatgaggaacaaaatattaattttaagtaaagaccacaggatcagtatttctgaagtttccttttgcctcaggatccagtatggctccatacattactgatcctgtctctctctctaacattttgatattttgtcatgtactttttgcattcattttgattttttttttttctttttgagacagagtctctgttgcccaggctggagtgcagtgatgcgatctcggctcactgcaaccaccgctttccaggttcaagcattctcctgcctcagtctcctgagtagctgggattacaggcacacaccaccacgcccggctaatttttgtatttttagtagagactgggttttaccatgttggccaggctggtcccaaactcctgacttcaggtgatccacctgcctcgacctcccaaagtgctgggattacaggtgtgagccactgcgcccgtcctcattttgatttttaaagataatgtattacactattgtttcttttgatggttgaattttctggcatccccttcaattttgcaccagaggtaagtgatcctaatccctgccctgacattttacactgtgctgtgaataccccagggcatcatgaggaataaaatttgaaagtgtatttcagtgagctaacttggctggacagaatacccatgggttatccttaccagtggtgccatatttatgcctttcagcagtgttgtgattaaactcaggtccagtaaaattatcattatactatattagttttgtagaacttctgtaacaaatttccacaaactgaatggcttggcttaaaacaccagaagtatatcctctcacggttctggagtccagaagtccaaagtcaagatgggggcagggttgtttgcgtctggagcctctacaggaggatccttcctgcctcctccagctcttggtggcgccaggctccagttcccttgtagatgctacaagggaactcttgtttatagtcgggatagaaattacacaaaacccggtcttgattggggataccttttggagtactggcaagttgccgcatggactgagccttccgatcggagtttgctgtcttgctggtgatctgcctggatgccggtgcacacactaatccctgaacacactaagcattgcgcttgctgttgtttaacttttcatccatgattgaattcaggagttctttttttaaaatggccatttttaaagatttctaattgggagtttttcttctgaaaagaatacccgtaaagcaaactatttaaattatacactgagagacgtatgttcattcttgtatccataacagttaagaatcattacctattactagcataggcacaaagcgtctcctctaagacatttgttaattacaaaagggacaaaagtagtgacatgtggggaagaaacccagcagataccacctaggtggtcaaggtcatcatcatcatcacgatgagggcatgttgacaccctgtgataatctgagaaggactcagcatcactcctgtggtgttcctgccaaaaatgcgtaagagtctaatcacgagaaaaattagacaaacccaaactgagaggcattctgcaaaacacctctcctgctcctccaaagcattaagagtgacaagggaagaacggggaaccatcacaggtcaaaggggatgtgctgactataggaatgtgggctcctgggagagagaaagggcggaaggagaaaccggtgaaattgggtaagtctgtagttcacttacttgtgctgtgccgggtcttaactttcttatattttgctaattgctatgtttgtgtaagatgtcaacataagtggaagctgggtggcagttatatgcaactctgtgctatttctgcagcttattgtaagtctaaaaattatttcaagattaaaagtttttttttttaaaaaagtcagatgaaaacacgaataagtaaaaaaaacataaaaagagagaaaaaaggagccatttatatgattaactttttggttggtgtcgccataagttttttcagttcggattcttagtaaaggatgtggatcaaaacaaatcttcatactaaaacatcagcagagaccttatttcatttgaacaaaatatcatgaagtcaggattcgttttgcatttgaatcttgaacatttaagttttttaggaaatttgtggtgctcctgtccttgaaaggaagcccacatatgttcaaaatgcagtatcttttaaatgcatttgaattttttaaagttttggtgtttgttgtttttggttgtttattgctttgatttttcatgagcagtgctgttcaggggtactattattgtcagttttaaatcactgctgcagcatacttcatttgatcttgagacttgccatgagtcttactgtgggggtggggaggatggggaaagaaaccattgagtatgagttggcatgtcccacagaacagcgggcggacacttcagggggctgtgcctttctcagagactcgagggctatgcccaaatcgttatgcagtgtgtatgtgtgggggggatagttggggggacgggtatggggaaaggagtaatctaccagggacgacccaggacagatcccagagccaggaatgagggttggatcttgggcaaggccatctctgccatgactgcttgtgggaactcctgcttactccccgtgaccctgagcaaaacttccaagtttgaagcctcaattttatgctctgtcaaagaaactagtttttcaccctccaccagaggatgaagtatcattctccacgtgaagcactcagcacagtgcctgtcccctctgcagacatgatgccaatctgtgatgatgttctcttctgtcagcattttacaaagcagatgagagcgttcacttgcacagcctcctgttgacctttcttctctcagacgccttgctgtagatcccaatcgactgcttttccttggccagccgattcatgcagtctcttgcttacttaatactgttgatatatttaaattattgtttaataaatacttgttattctggagtatatttgttcatccaaggatggtttactactgcttgctttgtgcaggttataacaggtaagggggtggaggtgtgtgcagagcatcagctggtcatcagccatcttgcgggagtgcccagaggggggaagagcaaagcctaccccttctacggagtgtgagggaggcaggcttgggtggaggcaggactgcaccagccttccagagctcagagaggtgacacctgagccaagtgacacacacatgataaagaggaggtttctggagtccagaggaggaaggcatccttggctaagaggacagcatgaactcatagggtacctccaggaatttttcccctgggcagtaggggcagagaaaggtacccaggggggcaggggataaggactggcatggagcatgggctcgatatcagcctgctgattttaatgaaagccgtttggtcacctgaagaacagctttgattttacttctgtaatctaaactcttttgagttggaatataaaactcagtgttccatgtgacaaaggggtttttaaattggtcattcccttaaacatctttacattttcgtatctgttgatgtcatttttttccccattgctgactcctgttcctgtcttctatttctgctcttgacttaataattcttggcttcttgacgtttatcattgccgactgctctgaatcctcatcttcccttcatttatttccatttgtccgctctgtttactgcctgagatgttgaccttttttccaagcatgcactaagcggcattttaaagaagcagcatcatgtcatagctcctggtagtggggctgggcctattcatcttggggcttctttatctaccttggttgtaggtagttaagaaaatcttaacccttgggtcattatttctatagtgggtcaaagagatgaccacgttactaaaactttcatgtctagttgcatattctgttttttttattgtggtaagatatacattacgtaatacatttgtaagtgtacaattcagtggtatgaaaacattcacaatgttgtgtagccatcaccctcttacacctaaacatttttccattatccttctccaaaactctctgctcattatacaataactggcccttccacactcccctccccacactcagtccctggtgacttctcttttttctctttatttgcctattctaggtaccccatagaagaggaatcatataacatttatccttctgcgtctggcttatttccctaagcataatgttttcaaagtccatccgtgttatagcatatatcaaaatgtcatcgtatttttgtggccgaatactaatccgttgtagggtcactcacacgcacacacgtagagtagctgtgagtacagtgcccagattggtacagaaaggccacagtgcccatgggtctgtccattttacatgctgtaccgtgtgcttcatgggaaatatatttcttctgtgagttttcttgtacattgcttgtttccagacttctaaaggggtggttgtggggatgtggtgctgtgtctcaggtatactctgcttatgaaatagcgggtgtgatggaagggtggagaaagggagttgagtaataatgttcacctggggtcgggcgcggtggctcaggcctgtaatcccagcactttgggaggccgaggcaggcggatcacctgaggtcaggagttcaagaccagcctggccaatgtgttgaaactccgtctctactaaaaatacaaaaattagccaggtgtgacggtgggcgcctataatcccagccactcaggaggctgaggcaggagaatcgcttgaacccgggaggcagaggttgcagtgagctgatatcgcaccactgcactccagcctgtgcaacaagagcgagactccatcttaaaaataataataataataataataaggttcacctgattgaaatagcctctgtattgaagaacaccagcaggtgaagttcgcttagcagatctgagcttcctgttaccctaaacactgccaaccttgacctacctctgaaagccagtgggatgaggtctagggccaggtgggaaccttgggaaaggcatgccctactgtttgaccaaggggatgaggaggctgggtactccagtgatggagaccctttccccaccttttctctcacctctcctccacccagtgccctttcacctttcctttccaaccccacacccatccttccgccccacttccccatttatttctctctgctctttcatttccgtggccagccgcctcccaagccctgccctcaagcttcccctcccttttctttcatgcccatagcctacctggatctcctctccctcgtcgggcccacctccctccacccttgggatcctggtcaccccctccactgcaagggggagaagggctgcactgtgtggagggttctccctaccttggctgtgttctggggatttcccaccagcccttgcgctgcactggtgatgcccgatgtagctgaaactctgccccgctcggggttactggcctgggatcagcataggagatgggtttaaaacaggatgcagggaggctgctggcagacagttatttgaggaaatgcatttcttaggatatagctttcaagaaggtgctgttattgtgcgtcacacatagagtggctgtaatgcgccagggcaaatgaaaattatgtttataaaatagggcaccttgtcaagattaacttgtgtgaaattcccaagaatatacctcaaacagttttttatgtcagtgcatgatattgtagtaactctcccagttctagatatctttattttaaaaggaatgcttgtgtgcagacacatttttaggtggaggttagtatgttttagttctcaggatttctaggagaataaatagccataacttgataggattggtatgaatagtacttggtcttgggaagttttctccatgaaaatgtttcatgttgacgttttgctccctcccgtcttggttttacactcattcttcacagaactgtcatttataggaacttatcccctggccatctctataggtgtctttcttgcccagataaggtgagaatcattttggaaaccaacttcttgagaatccacaagaaatgggttttagccacaagggatcattgcattgcattctataagatgagagcttctacaagaaaaaattctggagccagatattttagggaagacagggggctgataagtgaattgttattttaaatggttttcatttcccctcatcctgatttagaagaggagagaaaactctccttagaatcagtgggtagtcctgacttgaatgggtttattttctttttctctcttgaattgtcggtgtatacccgtgtctttcttggtttatccttcatccccattcctccggatacccctatttgcatttaatctgtttggtcacataacctctcaagtagcgatcttggaggtttcaaaacttaacatttcattttccccgctgggtcaactaccagtctggaagcaccagggtttccaaggttaggttacagtgaaggcacaggggacatcttcctgtctcctctgcagagccagcgccactgtgcagtggggtgtggaccccggctcctccccaggctcccaggcctgcagctggcacaggggtccccagaacctgtgagggggtccttccctctgcctccctgagggacttggtgattcttagccctctctaacagagggagaagacgctgtcaaaaatgtggtttgcccaaacccacatagagctgggaaaggggccagggactcaaatagcagagatttcctggccatccatcagtcaggttacatcagtatactccatgtggattccactgggtgccggcctggtggctgaccctgcctttagagggaactcattattgtgtatttgaagtgtaaatacctcttttcccagatgttaatcttgtttcagatattcgatggagagggttcacataataaataattccctcctgagtcggcttgcgtggctcctgagagcagctggtcagggcccttcttgtcggtgtctcactggcttttagcaaaatggagacgaagatgaaagggaaaccttaactatagcttgaatccttagggtggactaagcactcaaagccttccatgcaaagcagtgtggcttataaattggaggcatttttcttattattaggacaaaccagcacccgaattggtttgtcaccagtaaaagaatttaaaacagtgcccgatttgcacagctgagattttggcaacagtatcttacacatctgaatgggtggagtaagatggagcatcattctgtgatatgtttaaaataatataccatgaaatgatgcagtaagtgttggagatatcttccagaagtcttaggtcatttgttttcatgtttaaattgtttccgcaaaggcattctcttcaacataaggagagctaaaaatcaaatacacagaaattttgtaagtgtgttgtttttttcttttcctgtttagactttataacattacactatttacctgggctaaacaaaataaattattttgtacataaaaccacaaggagatggtttagcctacttatgggaccaaactgttgtattagccagtgtgggagaatattgcagagatgtgtggcttcatcaatgaagattagatgtaaagtctttttaaaatatatgagaatgttgaactaaagatggttcagatgggactttgctcgagttgcttgagtctagaaggcaaaataaatgtttgtaattgttacataggccagccttccaaaatcccagctatccatagaaaacaaggggtcagcaaaattggccatctgcctagactggtaggttgtatgggtctgaactagaggcagtctttccccaggggacatttggcaatatctagagacatttttggtgtcaccttgggggaggggtagtactggcatctggtgggtggagaccagggatgccgctcaacatcctacaatgcagcggtcaccgatagcccaccctgccccaccacagccaagaatgatgcacccagtagaagcaccatccctcttccactggtgacatccgaacatgtctacagacactgcctaatgcctcttggggggcataatcacccctagttgaaaaccactgccctaaactgagactctgaaatcaaccacttaatctcctttcctctgagctcaggggagggacgtgactcctgcgagctgccttggctttttgtaggggcacagatagaagccatcccccaacacggtgccctgggttctgtggtggtctctgagaacccatgaataaggatcccagggaagcctttctaggtcgtgctgctttaatattattctagatgccgatttaaagtcataaaggaagaagagctaggactgtgctggaggaccctaaagcccatggcccatggtttcctataatgctaaccatgcccggagtatctagttataaataattgtgctgaggtcatgaatatttgactttggttctcaaatattcctaagaaaaaagtcatgaaagcccctgatggtaaaaggaggagagctgagacctaagtggataggagactcaggaaaaagcaagttagaaataaagttcaacaaccacaggagaggagaaaatgggtccaaaagacttgggctttaggcacatcttacctaaggacaaaaaagtagagaaaagatcaaatgttgagaaaagattgagccatgcggagaacgggcagggtgttgaagtacctgctgctctccttaaacccagcatgctgttcactgctttattttagagagtgggtgtagtggtctgtttcagaagactcaagtctacactgcctctgccactgaggttccttttgactctgcagaagtctttacctttcatctcctttctgaaatgctgtgagcatttttcctcccagagacattaattgggaacagcagtgaatgcctagttccttgcagtcctttggcccacacgcatttccagctgcccactggccagactggattctaaatgccaaaagctacaggcgctgacagagtgcttttgaaaagaaagaaatgcatgaaatgccccgaatttatgggaaatatttatacccagcagtccttgagccatgcgtgtcctttaggaacggtgctaccagacagccgtcggcatggccttgctcctggtggtgcaggctctgatgttccactgatgtgagcccaagagaggaatgaccagtcagcctgtaaccccagctccagtgttgttaatgagtgtcaccgatcaggtttcagacgttagtcagtgtcccggctccagtgttgttaatgatggccacggattgggcttcatgcgttagtcagtgtctctgttaggagctgaattgtgtccctgcaaaagggatgtatttaagttccaaccccttgcatctcagaatgtgagcttatttggaggtgggatcttaaccgagtgtgactggcttccttagaaaaagaggaaatttggacacactcgtacagggaaaaggccatgtgaacagccacctccaagccaaggagacaggctcagaacagattctccctcacagccctcagaagaaaccaaccctactgacgccttgatgtctctgaattctgcactccagaaccgtgagagagtcagtttctgtgaagccaatcagcttgtggtactttgttatgttgggcctatgaaattcatctactgttactagcctttcccaaatatttcagtccatgaaatgcacccagcatggcaactcttcaacttacagaaatggaaaagagaaagaatactgtgcttcagctagttttctcattacccagaaatgaaaaggcctgacctctgaaaccttgaggaatctctttttaagatgccagagcctgtacttctgcctgatccaagcagagtttgctcgctaccccgggcatcacttctcactgcccaggtggcactggatgatgtccaagactggccagatctggatggattccataaatagctcgtgctgtttctggtcagtgaagaaagaggaaggcaaagccacgtgcataagtttgttgtggatgccataacaaagcgctgctggagtggctaaaacgacagacgtttattgtatcccagttctggaggccagaagtccaaaatcaagatgtcagcagggctcttcctcctgagggcttgaggcaggatctgtcctgtgcccatcttccagcttctggtggctgctggcagtctttggtgtcccttggcttgtagctacatcacccagatctctgccttcatttgcacatggccttttccctgtgtccaaatttccatccccctaccttttttttttgttttgttttgttttgttttgttttgttttttgtttttttttttagacggagtctccctctgtcgcccaggctggagtgcagtggcgcgatcccggctcactgcaacccccgcctcctgggttcaagcgattcttctgcctcagcctcccgagtagctgggattacaagcatgagccgccacacccggctaatttttgtatttttagtagagacggggtttcaccgtgttggccaggctggtctcgaactcctgacctcaggtgatccgcccacctcagactcccaaagtgttaggattacaagcatgagccactgcaactggccaaatttcccctttttataaggactccagtcacattggcttagagctctctcctaatgagtttacatctgcaaagaccctatttcccaataagaagttactcccaggtactaggtgttagggcttcaacatacgccttgggatgggcagtcttgaatccataacaccgtcaattaaaaggttctgctttcattgccgccaggttgggaaaagttgccagggtgggcttggtggaggagggtctctcagcagggcagggtcattgcagggaaaaggagagagaaacagagacacacaaaagcagatagattgccttggcagaggtggccagactagagtctttgagttttgtagagagatcaattgattacttctagaaatgtcctcttcaaagtctctagttttctctcccatttccttatacaaggctctggccatattactacttctggcacagttgattcagtgacttttgcatataggtttccccaaagctaaagctaaaaacgaacaaacaaaaaaagattattcatgaatatgccacaaactttgcccatagataagactttgtgattacaagcaaaatctgattggaaaataaaatacattatatgttagaataccaggaaacttctttttggggagcgtctttatgaaatgaagccatgctaacctccctgggactgctgatcagaatgtgctccaccccaaagcctcggagagggcaggacagccagtgactctctcctgtcagtagacacactaaacctgaatccaggatgggaaatcaatgtttgacacagctgtatctctttcagttggatcagtaacactcgctcactcactaggacttccatttgcttttagctgcctgcaatgaaaacctggcaagacgtcttagtctgatccggctgctgtaacaaaataccgtagactgagtggcttataaaaaatagaaatgtattgctcatagctctggagactgggaagtccaggatcaaggcactggcagttttggtgtctggtgagggctgctttctcacagacagcatctttttgctgtgttctcacatggtggaaggggtgagagcgctctctggggtccctttgataaggcactaatcccattcatgaggccccaccctcatgaccgcattacctcccagaggctttacctcccaacaccatcatattgtaggttaggtttcaacataggaatttggtgggcgggggggggggtacacaaatgtccggaccatagaataggacattacagcttgaaaaagcactagagagaatgacgttgttcctttgtaacacagaaaagcattcacctctcaatttagatgagccattttgaccccagttggttctgaaaatccttgttgacaaacaaaattggagaggaccatagcctgcctgcttttcccgaggcccggggaaagctttttcatatgatgttattataatgttaggtgtaacaataaatgaaagttttgtatggtctgattgggtaggacaggcctgaacacaggcaaacccatctgcacagcatgctcaattcagtcagtgtacaaaccctgtgtcatgggagcagagagaagggtctgcttccattccggaggatgacagaggcttaaggacggtgctggcgtttcagctgagcctttaagaagtggaattttatccagaggtgatcttcttggaatagagagaacaaacaggtcagggcatgcagacttgattacaggtgctctggggaccactggaatttttgttgaacagaggatgatgaaataaatcagtgttctagtgtgttacctttgggcagtggcgagatccgagtctccatagtgaacaaatcagtgcacagaccagggcagaagtgcaggggaacatggaacattcagggcctggagggtggtacccaggccaacactgccccctttttccagctcccatctctgtccacatagttgggccagtgtagacatctgggtcatatagggaggcattccagtggccccatgtggtttccatggagatcttcaggaaggggttttggggtgagagttggtatctcgtggcaaggacacactccctgggctaggtacatatgggtggttttcttgtcctacagattgcaaagatacaggggtagctgttctgctctgggcagcttctgtagagacaggatgtgtatttgcttgcctgctcctggaagccagtcactgaggcagacctctttactcgtccagaagcatgacttggggatgattatagttcaaggacataaggcctagtggtgtctttcatcagcgccccccattttacatttctgggatccccctttctcttttactctgatctggcctcccttcccacccctctggccactcaggtgaggagatgccagatcccaggtgggcaggaaggaatcccactgaatgagatccttggaattgcagcgtagcctggagctgtatgttcattttagatagaaatattgacactattgacactatttggccgggcgcagtggctcacacctgtagtcccagcactttgggaggcaaatcactttgaggccaggagttcaagaccagcctggccaacatggcgaaaccctgtatctactaaaaatacaaaaaaattagctgggcatggtggcacacatctggaatcccagctactcgggaggctgaggcacaagaatcctttgaaaccgggaggcggaggttgcagtgagccgagattgcgccactgcactccagcctgggcaacaggtcgagactgtgtcttgagaaaacaaaaagaaagaaatattgacactatctgtccgcaaaaggtcaaaggcataattacaatatgattttgtttccatttttctttttcttcttatttcatgcaaatgctgtctttttgagagaagtggttataagcacagcgatattctatgctatgtacagctctcatatatagaactctctagaatggctcaagttaccattaagcctcaggtgatatcaaggttataaaatgtaaaatgaatgatcatgatcattaagtagaaatcctggctgtgtcttccaagttctttttctttctttcttcctttttttttttggagataggtactatctgcatttcagcttagcttgccgccagtgttctggtttcttgaccatgctgagtaattttcagccacaccttgtatcccttagaagcccttcttgattctgaggtacggggctcagaaagctttgtcgtgggaggttgtaaattaggaaacatgaaaatcagatcaacaacagtggctggtcctggctgcagggctcatctgcctggagtagcttgaagttgaatgttaatatatacttttaaattgcagttgtttaattaggtaaagtgcacaggtgactttctcacactaaatggatgatgagtattgggaagagttgactaaaatttctctatcttttgcccatatccaactctcattgaattttaactcttatgagatatgtgctatttaataaataatgagtctgagttttctcccttttggaaatgtcaggaaagtctcaatgattttaagtatcttttattttataatagcaatagaatctagaatttctaaaatcaaactgagttcttgattaaatgttgaaatgcttgtcttcatccacctgggagcagtcgttgtgaacgagaagccccagtgcataaatcattgaatgatacattggagaagtctcagagtaaaggaagatttgtttacttttcagacatcctggaaggtgagcatcaaagcaggtgagtggctggctcttggattcaagcttccctgatcctttccagaagtgtatccttctcctttaagagaa[450 bp omitted]cagaggttgacacccaggactagagctcagtagaggggccgtttcctacctgcagttcccttggaagagaaggggtgaagcttaccatgttggtggtggtttgtttcctggggctgctgtagcaacgtgccaccaactggctggcttaaaacatgtatggtctcccagttctggaggccagaagtgcagaatcaaggggtccgcagggcccagctacctctgaggcctccaggggaggatgcttcctgcatccccttgctgcttttggtgttgctggcggtccttggcttgtgggcacagcactttcctctctgcctcggtgactacatggcctccctgggtgtctctgtcttcttgcaaggacaccagtcatgttagattatggctccaccctgctgcgatttgacctcattttactttaactaactatctgcaatgaccctttttccaaatgaggttctgaggtgctgcacgttaggactttagcatgtgatttctgcggactcaggtcaccccataacagtagtcatgccccaccccatcccactccacccttctcccaattcccctggtatactccagggtggctctgtggccacacatgacccaggcccactggccattagacactttggcagggtggccaaagaaattctttgtgctgaataaaattaatgtgtaaatgcggcggtgctccaagggcagtgttgcgtgaaagggcaatagaaccatggctcctgataaacagaagcctgttaagcagcaaggtcaaaagccagatgcagaagtcagaattagccgggtagactttttatttcactttcccccccttttttttttgccagtggactgccaactgttctcttaacagaagggcagtttttgagtaaatgaagcaggacttgatctgggttgtcataaattgtctctccctcaagaggtaacttctcgtgtttgccagttcagaggtgtagggagacatctctgatgtgtagatgtcctagtttggggtgcagggtggctttgggtctgagagcctgctgttggccactgggtgcgcgtgggcttctccacatgacaagacgggaatgctgtgaaggaggccgctgttccgcttgggatgttggccgagcgccgctggcctgtgtccctggaatcctctctgattcaaccattgaacattaactctgtgaggtcacagccaccagcggggcttctgagcccggccctgttctggccatagagggtcaggaggagaagacgtttcacccttggattttctgtgtttggaatccaaggcctttcccgtggagtcttgtgaggttttctcgggaagaaatgatcctctgggagaggcttgggcgcgaactgaaacatctttcaagacactgtggctcttttcagggaaatgctaagccaagcaaacatccactcagaaatgttctgtatttggaagcctcagagtgttaggggaagccttgaccctggaatgtcatctcctggtggtggcggcttcacgtggtaaacaggaggtaacctgggtgtcatgtcacccaggtgacatgacacagggccacacaggatcatcttccagtggcagtggtgaagataggggatatgatttcacatcctcattagagcccacacatgagatccagctttataattggaatcccagataatgagcatgtgaacgtccgtaagttccgcctattctgggtatgatgtcacactcataaacaagctaagcacacaaactggaatttcactttggaggaaaaaaatttcaattctgttacatgagataatacaagtagtttaaagccacagagggtctctttcgatcaggtagatctattcttctgtgctcatgcaatatgatagaagagcttcttgcatctttatgtcaagaatttgctaaaataaatcagacaagtttaggatttacctcatagtaaatcaagaactttaagcaggggcttttcttctaattaaaaatgtcatgtataccacttagacatggaaatgcttaggtaagtggagcaaattattctctggggatttagaaaaaagaaaatcagtctggtttctatggctgcatgaatctggaaggtaaattattaacccagtagactaagattttactaaaaacagactaatttgttgtggcaagacagttccagtctgtgtgctagggcttttgtttgcatgcttgcttgaaggcagacaagtcaaattaaacaataattattggcttggagggggagcagatgtattggattagtttctgtgccacatttctctcatttccaccaatgcactccagtttcagcccttgtatcagttatctgttgattgctgtgtaacaaatgaccccaaaactcagcaggtgaaaactacaaacgttaatgatctcacacaggttctgagtgtcatgaatccaggtgcagcataaccaggtggttctggctcagggtctctcgtgaggttgcagcctgcgctgcagcctttgagacctcgtgtggggctggggggtcagttccaagctcccttagggtgtggctgcagcagaagtgatgcaccatgtgcaacaattctcttggtcctgtggatcaacctggtgaatgtgggacaggccggtactggagtgtgaatgccagggctcacggggaccgaccgtctgagaagctgcctgtcacgtctctctttgtcttttacacccataaatgggcaccttggtcagagaataactccttttgagtccataatcgtctatcagaaaattctgggaaaattacttgttgatttagccacgttcatggcctatctttggagccatcagagcccacaaatggagactgtcaacagcttagcagtcagttcattagaaagtagtgttactgcagcctgggtgacacagtgagactctgtctgtacaaaaacattaaaaaattagccaggtgtggtggcgcatggctgtagttgctggaactcgggaggctgaggtggaggatcacttgagcccaggaggtagaggctgcagtgagccatgatggcatcactgcactccagcctaggtgacagagcaagaccgtgtcccaaaaataaataataaaaaaagaatgaatcacataccaatttttttgctcttaattgcatttttgaacagaaaaacagttttccctgcaatcaaatgcaaacagttcctgagcccctaatggacgagcgtcctcagctcccacctgcactataaatttgcgttaatcttccagttaacttcagaactgctgctgtctctctatgttccttctgcctcaagacatataggaaatgttggcctttccctttcaaaagaacaaaacagttgaataacctactacagtcttctgtgcaaagttagcttcaaaaattatcaagaatgttttctccaaacattcacaaagtttacagagttttcccttttactcaggatttcagcccctttgttgctcttggctctcacagcaccaagatcgtctgtccactcgttcattgggcagatgtttattgaatacctgtgtgtgccaggccctgggccctgaagtcagggccataaacacagagcacagtcctaagggcaaacgattttctcaacagggatttgaggcctgtgaggtttgaacaaatgagcctcgtgagtgccagttctggacactcggcctgacttatcggacatttcgcagattcctaagattttagaattgggagagaatctttgagatttgcttgtagcccttacattttctagacaaggcagaaagaagtccagtgggatgaggcagtgctggtgctggcaccgcctcaccctggcacttgcatcgcctggaaacaaggcagagcccactggggcccccagggtccaaagcctccaggtacgtgtctgagttctagcattggagttgccgctctcacccttgccagttgctttggcatgaagcttgatggtaccagtgtgtttctgtcttcacagcttgtggccctggccctgagacctgaggcttggatggcactcccacttcttgctttaattcttccctggagagttctcaccttccctgctttccaagtccagctgagatgggcaaccaaaatttcccaagggagaaaatagctgaaaatagaagtagaacatgaaagaggatggcttttcttttttctttttttttctttgttccttttatttttttaagttgatttatttatttatttatttgagatgaagtcttcactctgtcacccaggctggagtgcagtggtgtgatcatagctcactacagcctcaacctcctgggcttaagcaatcctcccacctcagcctcccacaggtgcatatcaccatgcctggaattttttttttttttttttccaatttttgtagagacagggtgtcactgtgtttcccaagctgttctcaaactaactgatcctcccgccttgggctcccaaagtgctaggattacaggcatgagccatgtgcctggccgagaatgtttttcaatttgggcttgttcagtggttttcacatgattggactggggtggtaggttttgaggaacgagaccccagaggtgaagcgcccttctcaccacatcatatcaagggtaggtactgtcaacctgactcaccactgttgctgttgaccttgaccactgggtttaggtcatgggtgttgggttgcgattaatgtttttccctttccatgtagtattctttcaaaatccccactcgggtggaggaggggtgttaagcatctcttcctggaggttgtttatttcggttttatgttaaaatatatcagtgcagatccattcacccatctcttgatagaaggagtaggatttttcttgggacagggatcctttattcctagtttggagtcagcttcccccattccggatggtgcagcctctacaatgtttgtctctttgaagcggagtgggaattgaaagagatttatgaaaccatctcggtatagaatctatctaggattttattttcttttcccaaatcccttgaggcaatctgtcttggttaagtctctaaaaaagcagtcaaagtggtttttgtcgaaaaaataatttgggggtactcctagttcaccattttatataatattcaattacttttcgtaaatgcaataacaaggccaactgacataagcgagtttgaagcagtcagcagtttgggtgtttcagacccaggtaggcagctgaggtgggagatcccaggggaagctcagggagcagctgcccgccttggtcagttcagccaggttaagtggaggccttgggaagagagtttctcctcttgagtatttttagaagcagcagatatcagccataaatatttaatgttgtgtttctaaactttagcgtcataaaaatacaaaaaggtgactgggcgggggttggtcagtatatacctaggggagaaaagaacttcctcaacacatcacactgcataaggaaaaccgtcttaaacgttcttagaagaaaagtcagtaggtaaacagctatcgtgtaatctgatgaatacccaccggaggaagtattagtaattattctttgcttgccagggttttcataattcttttccaattataaaaattaatatgctgtaagcagtttttaaaaataaaagtaagcatgaaaagaaaaacatctataaacccacccctagaagttttgccccagcattttggtggtgtgttttcttccaggtgtgtgtgtgtgtgtgtgtgtgtgtgtgtgtgtgtgttgccccagcattttggtgtgttttcttccaggtaggggtgtgtgtgtgtgtgtgtgtgtcctgctgtattctgagctttgtagtatgccccttccacttgaccttctccaggaagcatttgatcatccagcaacatcgattgaaaatgtttgtatgcatctctttcatgaagtacatgttccatcatttatatcacatgtgttgctggagatttcaattgcttccattttcctttaggataaattgctggaaatagaactggagggctcttgagaccgattaccatattgctttcctgagaggctgtgcgggttgcgtggcagtgaggagggacgggggtaagtggaggggctggggcacaggcctctccaacacttcatgtgaacatggtcagctgagccaggaatgcgtgacatctttatttttccccttgcatttctttaattcctaacgaggtggaatatttgatcacatttgtcagctatttgcatttctttttccatgtattagacctaagcctctttgaaaggtgttatctcaggttctttccaatattgcactttctgagtttctcttgaatcccagttattttaaggattgcagtgttggagtttcagctgaaggggccatgtctgatgtttgctggtccattagcctcctggcctgagccaaaccatgcatcttcatgtcagagctgcatatgaaacaagagctaagtccagaaagcaagaagaagctagcagattgattttcctaggtggggcctaccagggcacttctgttgttgactgtaccactctctcctgaagggccctggttgtgtactgcagttgggactgctgacgtgttggggtgttacaagagcatgcggaggctgctcctctcctgtttcctggtgtgctgatcaaaagactttttatagaatgacagttgtaggaaaagcacagattcttatgttagccaataacggattattttttaatgttattataaattggcaagcttactaatttgtttctacttgtcattagccaaagttcagtgtttcccaaggatatatgtgaatgtgtgtctgtgtgtgacatctgttgtatttttcacatgaattaattgagtatctattatgtggcaagctctgtgctgtctttgaagcactgaactgtcttatgatacacacaggatgaggacaggatcattttctatatttctgtgaagtcctttttcaaattcccattcttttgctgcttctgcatctcctttgactgctttagggcatcccaggtagaaagcttacctaatgtcaactccagttctttcttttgtagtcttcattttaagcatgatttctgtttttctttttccctttaaagaaagcttctcaaactttgaaatgaaaacaaatgaaaggagagggaaaagattcagaaattattgatagattgctaaaaacaaatgctatgataattttgggtcggagcatctgtcgttttacagcacaacagatttagcttcttaatgatgtttgtatgtttttcctcaaaagtgtattgactaggtaggagttgagccaagccttgaatgaatcatttcctgccaaattcaatagactgagcaaatcctcggagaaatggccatatttctctaacactgggttcctttcagggctcaagattccattttctctcaatactttgctcctacagactaggagtcctcttcatgctacagtatgcagtgtgtatggaaactgtgaatggagaagcagccgttcatgctgccaagtttctttcagaaggtggctccaggtggatgactttcagtctgaactcagtgtcaccaggcatgtgtgtgcccacacactgccactttaagctgtggacaaacagaacggatattctcccaccaaaataaacatacaagcaaaacactctgtcttcattcagcatcatttgcatcctataaaataatggtttctccttgatgcccacctttcttatgggtggttcttaattagttccaaacagaacttaacgtggccatgatattccacttgctaaaacaagggcagtcgagtgttcgatttgccatcattgattagacgcatgcagtcacccagtgctgtttgcccaagcatctgtaggcggggattccccagtgctgattccccaatgcttgtaaggggcaggacttaattaaatcttaaagtgacagctgaaaatgtaagggtcaggaagtcatgtctaaaaggggatttagtataacaataataacagcagtgactaagactaatcctggctcaggcattttgtttggggtcacctggtcttaattagcagcactctgggatttgagtggcgctgtgctgttgcccacaaagcccatcagtggcaccattgcctgtgtctttcggggcagtctgttagggagggggtggcacaggtgttggcacggccatccccattttatatgtgagggaacctcagccaggcaggatccttgcctggatgctctgtggggagccctgtgagtttgtaaccctccgtgcagcctgccaggtcagcggccccaaaatggagagatacagagggcaccaaattgtaaggcagagcgttggctagtgacacaagctgcctttcgatcgcctgggcgttctgaagcccgcaaacattcgcctggaccttggtcaggtgtctcacagaacctacagtaattcactgttaagaataacttcaaacacagaaaatcgctttttgtttcctagagaaggctagtcttcagcgagaacaacttgtgatttttaatctgtttcacactggtcggggaggggggaagaaaagatgttatgggcatataattaaaaatttgtcggcagatacaattacaggaagaatcatgtggcctaaaaaactgaaagcctccatatgcctcttcatcttgccagctacagtccacaaattgtagagcctgcgggcactgtggaagccagctagatttgctctatccagtagcagcagattgagagccatacatggaatttatacttttctagcagccacaggaaaagagtacaaagaagcaggtaaaatttatattacaacatcttttttactgtgtattaaattattattgtaatacctattttaatatataataatgccataatatattttatttaacccaacgtatccaaaatggcatcatttctacaagcgattcctattttaaaaattatccgcaagatattttatgttctttcttttttgtacaaagtctgcaaaatccagtgtgttctttggtcagtgatgtctgagatcccaagttccaatgtctgtctgaaattatgaaaatcaagtcatgggagatggataccctattccctacgatccacttatttcacattgcatgcctgtatcaaaacatctcatgtactccataaatatatacacttactatgtaaccgcaaaaattttaagaatatacaaaaaattttaaaaactgaattaaagagcattgtagataattgtatttttcaaaaaataagtaaaatatctggtatataacagttaaaaaaaaaactgtattatcaactctgtgaccttagaactacctttttacattttcaaagattaactctccttaaaaaaataaatgtacaaattattaccaaaaaaaaaaaagaaaatcaagtcataatgtgaaaaataatttttaagctgaaagttacactgtttctaggagttttaaactaggatagtttgtggttattaatctgtttggaagtagtccagaaaaaaatgctatgggtcaataacttgaaaatgtgcatgtggactacttaaagaggaatcgtgtggcctaaaaagtccctgttatccctccaccctgcagactccaataggagaatttccgctgctgcagactctccttggtggccaagctgcccagcactctcccgtcccaccaatggtgtgactcctatcactgagaaacagaccccttaccatttcatttccttttaattaatttaaatttaaaaatcaacacttccttggttactggaatgttgggaaccatgtgggtgtgtgcatctatattttccagggtctattttgttacctataataccagtcatgtatttccaatgaaaatttaacttgtgaattgagatatagtacaaatgtaaaatacatacactgtgatgatttaggaaatttagtaggaaaaaggaacgtaaaagatctcagtaattttttaaatagaatacaagttgaaatgatactattttggatacactgagtaaatcaaaatctatcatgaaaattaatttaaggctgggcgcggtggctcacacctgtaatcccagcactttggcaggccttggcgggcggatcacctgaggtcagcagttcaagaccagcctggccaacgtggtgaaaccctgtctctactaaaaatacaaaaattagccgggcatggtggggcatgcttgtagtcccagctacttgggaggctgaggcaggagaatagcttgaaaccgggaggcggaggttgcagtgagctgagattgcgccactgcactccagcctgggcgacagagtgagactccatctcaaaaaaaaaaaaaaaaaagaaaagaaaaagaaaactaatttaaaattatacataaggcttgccttagatttctgttgggttgtgcagatctagaccacagttgtcatgtaacaaaggaaggagagtttgaaattacaggctcacagttaatgataaaattccaacctaaacccaagaccagacattccaaacactcaagtgagtcaatctgatgatttgtaaggcttaatgttgaaccgtcttcaaatgtgatgacctcatcctaactctttccaagctcccactttgggtatatcaagaggctgaatgtggtggctcacatctgtaatctcagcactttgggaggctgagtcaggaggattgcttgaggccaggcatttgagaccagcctgggcaacacagcaagaccccatctctacaaaaaaaattagccggatgtgttgatgcacacctgtagtcctggctactcatgatgcttgggttggaggatcattgagtccaggaatttgaggctgcagcgagccaggatcatgccactgcactctagcctgggagacagagcaagaccttgtctcaagaaaacaaaacaaaaaatgaattggccaagagaagtcaaggctcatctgacttggaagggagccaggttctcagtctatactgcttttctcatcctggcagcatccccatgagataaaaatgattattcccattgtacacttaaggtaaaaggtctcaaacagatgaaataattgcaccatgactatagaaactagtaagagtcagcgcctgaaattaagcccagggctgtctcctttgacactggccaaaaagcagtaacctcttttgatgaaggggcttacttcaagctttgtttatgtgatgaaaacaccccagggctccagaaacttaacatttggttccacatccagaaaagtaaatttacaaaatggtactgcaagtgataattctcgttgacctgggattgctagggtataagcattctgggaatacctgggtttctgatcaggaagtcattcgcagctataatggtgatcctcagtcaccgggactctgggattgctagggtacaagcactctggggttacctgggttcctgaccaggacatcactcgcagctatagatggaatgctttaccccttttctcctgtgttatatgacatcggttagcaccttttaacctttttagaagataggttggaagttgagttagataaatcaacaggtagctgatggcctagaatataactttctgtagctttcaaagtgaggatgaggggcatcttgttccctaaactgcttcctcatgatggggaacctcagcattgtcttgccttgtgtctgagtacccatgtaaaattcagtatttcattcttaaaagataaaggggaagaaggaataacaatagacaaagagattccaccctagtccccatcctcattctggtgaaaagttgtcattactaagacaatcacacactcgatggagaattgtaggctgtggacaacagagccatagatggtgtactaatagctgctacaaaggacgcctctgtcctacctttcatgcccagctttgagtatatcctgtctcttgctcattaccgatgctgagttttagccctgtaaccagagtcctctttctttttccacagatgggactatgaactgtgttttaatgattagagggagtagtgaagattttcactgtgaacattttcaccccctttcccatccttggccagagatgatctcacatggtcttggcaggtatctttttacaggagtgcatgttgtttatcttgggagctttttgcacagggaaggcctttgtcttccagctctgtgaatccttcttcactgcgtagcaccttgcagaacatttgcacatattaggctcttggtgaacacttagaatcctcagtcatttgcattcacgtcatgtttccataacacattgaatgaaccagcaagtatttattgaacatttactatgtgaaacacagggaagacagccatgaacagaccagacacaaatcttacgtgctactggataaaaatgtaccccacggatgacactttgggtattatgatgccaacaatgagaacatattaaatcactttggtatttgcattagattgtgtcctgtaagtttcagattggtgtatttgccaaagaacaattgtgtgtaccccccacccaccagaaaagaatacagtaaaagtgctaaactattgaatatttttaaatggtattatatttgaaacgtgtgtttgtaattttgagccatgtaattagaaatctagggtttatttaaattcttgtttgttttagagaaatatgtaaagccacatttccctttatataaagtacttggttgaaaaaacaatttttttctaaagaaaaaaaacactctttagtgtacttttgccaattaaaagacagtacagagaaattgattcctcctggagtttgtgtagaaattagaaaacataatgcttttccctaggcatgaactcgcttaaaactactgagaagcttatactcacgcaggttgaatggagtgaatagtggtttagagaattgagctgattaataagaagtccctgattttcttttaataacacgttctgacccaataaggaaaatttgcactatgttttcctacagcgatggtgctgttaaaacttatgcaaatgggacaactttattattactaagccttttacagtatgttgctttccagggagctttgtaaatcattataattgtgtttcctcagtgtatgggttctgaatgctcctgttgtcctgtgaggtgaatttccatttggtgaagatgatactgttaaatggaggtttctaccccatagaaattaagaagagataaatgcagacagacccagcccttggaaattctgctttgtgatgaattatttccttatacttatggtgaacttttttacccgtgatgtgcacaggggcccagaatcatatatgacaagtccttccatgtggactacatccatatgacaccatgttcactagttggagccttggaaatccagtgggaatggtgagatagtgtgaacagctccaaggcaccgtgtttttaatgtaacccattcgtttctggctgaataggctagttgttgatgtggtgggcattatgagatagtgttaatggttgggccacggcatttcaaagagatgccttataagtcctgagcccattgtgcgtctctgatcattttggtcttcatttgctccccttgcccaccgtccttccacagagcattctctggaagcgctcagggagcagaacagggcaggcccacgtagaaaatggtctcttgagagtagaaggtcaggttcgctgagatctctgactcagaccacccgtacccatgctttttgttgtgatggagaaggtgctctcatatatacacatttgtgtagtaattactgcatattgatagcaatgttactgcacctgttaattaatataaccaaatggcatagctacagtgttttattctagttcaatttaggagagtatatttgttctcaatgggaattgatctggggagacccagagagtggggacatgagggttatttgtggaggggatgacacagcagcttcagaaaacagaaacattaatgcattagactgctgacctgtggggtcacacttccttcagtgatgcccataagagtcttggagtgccggaaagtataagcaacgctgagttcctgccagtatcacaaaggtgtgttttggataagagaggagccagaaagattacacttgtgtagaaagtgaaaactgagtttgagggaacagtcacattctcatggcaataaggtgggtagaatgggccgctcagcctctgcactgtggtcagctggagctggaagatggttgtggtggggctgccgtgtgcacggtgggaggtttagcagcatcccaggacccaggagataccagtagcaccgcctcccccagttgtggcaactgaaaatgtctccagatattgccagatgtcccaggatgccatagggggagcatgcagtatcattgcctgttgagaacctctggaataaataggtaaatgcatacaaatataaggatcttagtcttgcattgggaggcggcgtctgacatgtaaagacaccactagagcacactgaagtaggttctttcagagcattgcatgcatgataccctggagcccaaggagaaaatgatcaggccatgcctcctggaatcaagaaggcttgacttcacggcctggaggagataagttttaaactgatccttgaaggtagaggtaggtgaggaactagatgaaaggatcagtattaggtgggcttttaaaatattttctggccgggcgcggtggctcacgcctgtaatcccagcactttgggaggccgagacgggtggatcacatgaggtcaggagttcaagaccagcctggccaacatggcaaaaccccgtctctactaaaaatgcaaaaaaaattagccgggcatggtggcgcgcccctgtaatcccagctacttgggaggctgaggcagaagaatcgcttgaacctgggaggcggaggttgcagtgagccaagatcgtgccactgcactccagcccggacgacagagtgagactgtctcaaaaaataataataaataaataaaatagaatttttctgagtattttgtatgctgttgaaaaatttatcacttcgtagatgtatctcactttgtctatatctaagaaaaaaactatgtgcataaatgaatttttattagctagttaatctagtcagtggaatggagtattatttccagagttccacttcatattccttggtaatattgagacgctggttgtagtgaaaatactcttaattaaggcatgttgtaggttcagagtttagatggctgaatttcatgaagggtcttcaaagcattgggggtgtttggtgtacggtagtgattttcttgtgttcatttgacattttaaagtgatagacgtttaaccttgggctttctcaggactctagaatatgaatgatcactgttaactgtttagaaactcatgatgtaagcccatatgacttatggatttatgcacattctaaacagataagcatcatacaaatataacttgagttttctatgaaaggacagtgagacaccaccccccgcaagtctggcctgaacattggtggactgggaatcataaaaactgatacatacatgtcttactttgtgtttgtttgttctaagcgaaagcatgtgaatatgcagtcatctgccaatactttgtgggccagcccaggcctctgctctgaggatggcccacagcctggagtgccccagtgatcccagcactgtccacacccgcggtgcatccctcctggcttctagtttccagttaacttaagcaaagctgcacagacatctcactgtacatctctctagatttatacctcccctctctaccttcccggtcttgctgcccacacctgtcctcaagtaaaaactgattcacacttaccctgtctctcaaacattcaatgttattttcattttgaaaaaaggctgtgaccctgtgtgtactcgtacttcatccgtctgtgtaatatttaaagtttgtagttaaaatagtgaggacactgagtgaaatggggctgggagcagacttggatcggctttgggagatggtgtaggcagcgatggggacaggtggaggtgcggaccggagtgccgccctctagctgcgagcttacatcctcatgcttgggtgtctgtccttcagtttcttctccagtgccacgtcacctacctgagctgcctcaggtttgctccctgctgctgtgcacacgtaaatcagtgtctggcgggaaacaggcagacgcctttacaagaactagttgccatttatctttttattgttagacctcccagtaatgtgtgaagtctagtaattgcctgtgtgtcagactaactcagttgtaagctctacattatggtgctattaatctcttcaatgtaggcaaaatggggacagtggctcccacagcaagcccatctgctctacccatgtaagttgggagggatgtggtaccgtgtggcttctacttctccatccactttacggttgatgttcatgcttattgtaaaagccctgcaagacctagagatgctgtgagtcctcacgaaggaaaatgcagtgttccgtggggttgtgctgtccactacaggctcttgacttctgaactttctgaagtttgtatatttatccgggaactcatacttaccaagctgtattttaagtttctttcctgagtcaggcaccctccaagctaagtgctgtggctgcagaggcccctgccctgatggagcttgcctgttacttgggagacttgtagcaaacagaggaacaaagaaacaaaataatctgatgacagtaacacatcctgtgacagagacgaacaaggtgacatgggttggaggggtttgcacattagaggtaagaagactcctgtgaggaagagatggatgaaccgaagtgtgtaagatgcagccggaagagccaggagaagagagtttcaggtggagaggccagcacatgcgaaggccaggcacccaggaaactgagggaaaacacaggccaggccagcatggtggagcgagtgaccaacagagcagaggtgtgcacggtgaacaaagcctacagtgctttgccggccataatactaagaggatgagtgtggacctgaaaccccccagcagcttcctaccacactaaccagtggctggctgctggctgagggacggactgtgatgactcccactgggtcccaggcagggagataacctcaccttccactagcatagctcagcggagccaagaaggggagaggacagattcaggacactccagtgcagaatgtcagcggacgtgcatgtgtcctgccaggggagtgaaggtgtggcatgtgagcacggagtgggagggaggtgtgacttatggagactacaggctagaagagagacgagatgccatggttgggtgggtggaggtctctgctgtgggcgtgttgcgtttgagatgctgcttggaccttcaagtggccaagtcatgcagtccctgcagggataggtgaggagctatggaggttgggggctggagacatctgggatgtagacctggagactagattcgttcactggagagacccatggcggtgtagtcagcgaggggcactcaaaggtcgggaagatgcctttcagaaactcagggtgcccaaagcatttccaaaatcatttaacacctccttgcattttcacagggacttggaacctcttaggagataagaatatagggaaccagccatctggagacttctgcagagaatatacattaatatcactgtcttattctcactgactccccacctttttaaaataagggagatggcctagactaggaattttgcttaacttctatcctcctgtcctttttttctgactctgcagttttcatctgaggtagagagaaatgatgcactctgctaaattagacctgaatatctgttgtttttcttagacttgtgaagtttttactaacaaccacaagcacagtcctgaacatcgtataacagcatcatttgttaattttttgaatgaattttgtgattaaccttgatttaacaagaacacccagcccatttcccaacgacacaaattaatacaaatttaatgaaccgaagtgtgcccttctgctgccacgtagctcagttctccagggatggaagctggcctgagaatttctaagtttgacgaacattcagatgttccagaaactatcaagattctgagactgtttctaggaaaggccacaactctactggaaagtatatcagaatgacatttttgaatctgaaaagaaaaaagtcctgtacatttttaattttagttaagagtttgaatctggcttaatatattcttaacttgctagtttgaaaacaaactggtcgatgctcattttcactctcataactgtttcgatatttctgattttttttttttctttaaccaacagaggggtctttggaagacatatgtgcttttaagtttcaattttcattgcaattttgtttgtggtaaaatgcacataacattacatttaccattgtaagcatacagttcagtggcattaagtacagtcaccatctacctccagaactttttcatcttcctgcactgattctccatcccccatctccacacccccggaaaaccaccatcccactttctagctcttgttttgactactctggtgacttcatatagtggaatcatacattaattgtcctttcatatcgggcatatttcacttagtgtagcgtcttcaaggttcacacacctgtgtcagaatttcattctttttttttgtttttgaaactaagtctcactctatcacccaggctggagtgcagtggtacaatttcagctcagtgcaacctccgcctctcaggttcaagcaattctcctgcctcagcctcctgagtagctaggattacaggtgcgcgccaccacaccctgctaatttttttgtgttttttgtttgcttgtttgtttgtttctttgtttgttttttgtatttttagtagagatggggttttgccatgttggccaggctggtctcgaactcctggtctcaagtgatctgctcaccttggcctcccaaagtgctgggattacaggcgtgtgccactgtgcctgaacagaatttcattccatttaaaggccaaatatgtcattgttcgtataaacagcatgttgtttatccactcatccgttcatagacatttgggttgctattccaaaatagcttttggctattgtgaatgatgctgctgtgaacattgaggaacaagtgtctgtttgagtctctgcttccagttcctttgcatatacctagaagtggacttgctggatcacatggtaattctgtttactcttttgagggcctgccatactgtttttctgaaggtttaagtttttgtgagatgtgataaaggtagggtccaaccgtgactcctatgatttgatgcaaaggttaacccactgtatcctgcaagccaaatttagcccttgctaattttgtacaggcaacatgctaaggatatttttaatattttcagatggctaaaaaaattgaaggataatatgtcattatccatggaaattcaatgaaattcagatttcactttacatagttgaagtttcattggaacacggttatacccattgtctgttgtctatggagcagactttgtatggcccatggagtgggatttgctatggcccttcgagaacaaatttgcaggcctggcatggtggctcatgcctgtaatcccagcactttgggagggtgaagtgggaggatcatttgagcccaggagttcgagaccggcctaggcatcatggagaaaccctgtctctacaaaaagtacaaaaattagcggggcatagtggtgcatgcttgtagtcccagctacttgggaggttgaggtggcaggatcacttgagcttgggagatggaggctgcagtgagccgtgattgcaccactgcactccagcctaggcaacagagtgagaccctgtctcaaacaaacaaacaaacaaaacacatttgcaaacctggttaaaatgataaggagttcgacaaagcttacttacgtctgttgactgctctgcccaactccgtgggcttttccaagggtctgagtaggtgcatcaagctgtccacctaattactcacaccatcctacacattatttgtcacttttttgcatgtaagcaccaatcccagttgcttaagcctgcagggggcatttccttcagtaggagatgcagagtgtaaaaactccaacccatttgcatcttgcttatttcaggtacatttcctttcctgtttataattccaaagtgtggcttcctatcatgccttttaaggaactatctattcccattgactaggagataaatctctgtatagtggaggaaccaaactgaggaagacttctcaaaattgttctttttatcatacacttttttggaacgaagtttatagccaactaagaggcagtcttctatttttaatctgtgatatttctgtaaagtcatgtaaatgtcataactgcagtgttttcaagttgttgttgtttttgcaaagagctgttctctgcagtgagggctgagtgtgacttgttaaaaatgaaattcacatagcatccgtttcctccgttagcttctttcacttaaaggacatcttcaacatatcatttaagggcaacacttggttcatagtgtttaatttgttgtcaggaatgtcagcctcagaacttcttaatatacacacccaactctactgtaggtgcctatataatttacatttaacctattattttattttattttattcatgagggtgatcttaggacctgagataaatttgaacaggatcaatacaaatcaggctatgtttaaaccaggaagcagaattaaattctatttttcttgtatttgggttttgcaggaaatggggcatcgtgttttctcttttgaaattgtgtttgaagtgatatttgcatgaagaagcagcctgttttctattagactggtaaagtgggaatagtagaaaagagaaaggcgggatttgggaaatgtgacatgaagacgttgttaaataaggtatgcgtataactaaatgtggcaagaacaatgctacttagatacggaagctgctaaagtattttaatgttctctttacaaaaaaaaatttaagaattttaacatctgctagagctcaatctagtctgaattttttttctcatctgacctttttcatttttcctttctcaaacacacttgctcatttaaaaaattcagttggagaaccaagtaatatgtttccatttaagaaagccacagataaatattgttccatttgaaactacagcttcactcacttgatacttgtatgactattttaagttccttttaaaaaaatggctcaaatttatccttttgggagggactggtgaaaacgtctgcaggttcatcttggtttttaaatttttatgtgtttaattgtggtaaaaacacataaaagtttcatcttgctttcatgtttgcttttaaggtctgagaatattaatagaacaaaaggaacacaacagcattccaatgaccagtgagtgtagctgttcccactgtgtggttatattgtttttttacaagcctacatatgtggctttacctatattttaatatgtgaattcatacagtgtaactataaagcattgtgctcacttagtggcacagagaggttaagttactgactgggggacatgcagccctcagcacgaaattctgggatttagccgagaacagcctcactccaggatcatgctgcttctcagagtttgctagcttgcattgttagagtgtaatttctggaaaacaaggccatactggaatccggaggagagaaagatggcttacactgggtatgagtacagtgtagttgagatgtgcaaacaagatgtaggtaagataaaagaaaatgcaaactaggccgagtgcggtggctcacgcctgtaatcccagcactttgggagactgaggcaggtggatcacgaggtcaggagttcaagaccagcctggccaaggtggtgaaacccccgtctctactaaaaatacaaaaaattagctgggcacggtggcaggcgcctgtaatcccagctactcgggaggccgaggcaggagaatcgcttgaacccggcgggggggcggaggttacagtgagccgagatcatgccactgcactccagcctgggcggttacccttttttggttgtttttattttttattttaagataggtcatgtggtgtaacgggaagctgatgggacttagggtcagacgacctgggatcattcctggattccaatctccctggcaatgtagtaaaaggtctccttgtctttgagatgtcgggacggtgatgcagtgaggggcagggtgttagggaagactaaactcatgtaacacgaagcatgacacgtgtcgcgtgtgtctctttgtaccacaatatccttggacatacatattcctgacctggtaagatgagattctgtatgttttttgagacctcagcatcccatgcccagacactaaagtcacaggggaccatcagagtcccctagtagtttggaaattctgatcaccagtcagcaaagatatttgactgttggaaattttttaaatggtgagctctctttttctgtttcaagattcggtcatcctttctaatagtagacacggaagtctttttgacaaaggtaatgctaggccctgcactggctgacactccatgcagtgtactgtccttccatagcctgtgccgttagtttacagaggtcagtagtacctgcccgccccacagggtttgtgtccaagtgcttcatcgtggtagaagtggtttttaatgaaacaatagatttcttggtcttgcttcaagtgaaatccctgaagtgtttgctttcccgatgatttcatgctgtaaactgcctatttgtggccatggcccatgagcataaagcagcatcattgctattcaggcacataaaagccagatagaagaaaacctcactatttagccatcgtgtcagagagagccaaactacatgtctttctgggccctggtttttaggggattgaatgtcacccagaccttgagtcttagttatcagtgtcgcatatcaagaaaggacactgaggaatcagaattcttacaagggtggcaacttttattttatgaattgaaaaatattcctattcagcggctgtagtcacacaaaactaggcctgatgtaaggttccacacttttaaaaagcattgtatatatttaactaggattctgtagtcatttatattaggaatattgttgctagttgttttgcaagtttccagtagctgtaatgcaactagggaagcatttacatattgaaggcaggagccaccaataatgtacggattttaacagtaattagggtatctgggaattgcacaggtttcattctcgaaaagttaactgaattgcacagatcaaaagtgaaattgattcactcatctaaacatgcactctgttgctttcttggtgagaggaatgacccacctacttggtcttcatggagctcggtctcctcatctataaataatatattaagtgttgatctaagaatctatgaatctgaattttacataatgagagagatgtacatgtgagtgaaaagcaaaaccctgtgataactcatttttgttccagctacaatattgtggactctgtggactaactatagccaagacttatctgagtcaggaaaaaagtatcatagaaaatccaaaaattaattgaaggcagttgtttgtaggtacagcccaagtgactgcataaatttcacaccaactaaaagtgttaaagagtaacaagatgaaggggttagaatgatttgtgatggatacattgtgcattggaaattgtttgtaagacttccccaataattgtgtttcagttgcccaattcctgtttattctcattgtgcagaagtaagttactactcccttcaatataaattagtgtaaattgtgaattgctttcgtctaaaacaatgagagcacccaacatgaagccaggacttggggttcaaatcctactacttgttacctgtgaagccagcctagattgttcacttacactcttcagaaagcagcctctttatctacaaaatgagaataaacagggctgatgtgatggttcagttatataatggacataatattaaatagactctttctttctgaatgggaaagtgaggagttactgtatttagaagatgcataaccagccttgctgttcaagaatgttaggaatgaaaacagttgatatgtggttctcatgactcaattaaaagatgctatgtttgtgtaaaaattaagaatacatttctgctgaacttgtggaagaagcttagagcagaggctgcctgtgcattaagactgagaggacttggaaagagaagatttttaatgttttccttttacattagggtttcctaactgtggcactgttgacatgtagggctggagaactatctgtgggaggtccttcctgtgcactgtaggaggttcagcagcatccctgggcgtcccccactggatgccagcagcaccctctccgtatggtgaccaccataagtgtctccagacattgtccaatgtcccctggggggcaaaatcacgcctgcttgagaaccactgaaaatttccccaatataaacatgcattacttctgtaattttaatagcaacttaaaaaaaaagatgtcatttccaaactgacaaggctagtctgtacagcttcacatattgaagactcagaagagttggactttttttttctttttcttttcttttttttttgagacggagtcttgctctgttgcccaggctggagtgcaatggcgtgatctcagctcactggcaacctctgcctcctggattcaaataattatcctgcctcagcctcccaagtagctgggattacaggtgtgtgccaccatgcccagctaatttttgtatttttagtagagacagggtttctccgtgttggccaggctggtctcaaactcctgacctcaggtgatcctcccaccttggcctcccaaagtgctgggattacaggcatgaggcactgcgcctggcagacttggatgtttttacgaggcgttttgggcttgtgttctgtaagcatcagcttaacagaaagtgatgttgcatgactgccccaaagactcctggtggcagctgtgaaagcatccagggaccaaaacctgtgctgaggttgccctcaggcacctgtgggcctgtcagtggggccattctaagtaaccaagacaaacctgctctacttgtggaatacggatcttcttcttctgcatgttagttgtctagggtcaccttgatgatattagtaggttatctgttctactttagtaatgtgttaggagtgcacagcttaatcaatctaatatgatactgctctaaggtagggctcagcaaactactgcacacaggccaactggcttgcagcctgcttttgtaggtagttttattggaacacatacacatctgtttgcataaacacacccatttgtttacagattgccagtggcttccaggtacacgtgactacgatggctgcaaagtccaagatccttgctatttggccctttagagaaaatgtgtacctaccactgctccatggttctggaactttctccccttctgttgccatatctaggtatatctcccatctgttaatctcagtttcagaaagggggaggatagtaaacagcatagccaaacaagacaaattatgatagagagcactgtgaatatttcaactttattcagtgcttttagtgagtatgcgtgtgtttctctgcatatcagatgcatgtaacgtgtaccagagtgtatttattaaaatgcctggctcatgtacttgttcatgaaagaagcaaaacaccatcgttttccttgatttaaaaaaacggtagcagcatttgtgctggagaactttgatagaacatggcagttgcgtgtaggatattggaccagacaggctgttggggccagagttttaagagggtttctctagaaacagaccgtactaggattacatgggaagtgagtgtggaatacttcgggatcgctgatcgccggttgtatgggagtgaggagcaggacggggctcagtggggagctttctggaatgccagtcccgctctttcctgcatgtctactacccccgtccaagcacttccttggctctagtatgtcctcatgagcagggcccatgacttcccggtgttatcttctggataatttaatacagggttcaggatatttgttaagtcccataaaggtgttttaagtgaacagctgaatggcaacctcagtttgatgatgctctgtctcctggaggggcctaatgtctggctgtctccagtctccttctaacagaccggcatcatcgtgtcgtgttaagttcgcttattaattctctaccaaaggcatctgcatttagtgtccaggaatcactcgatgtttcgtttctttttatgttttctttgcctccgaaatatcttccacagattccctaaggacgtgaggaatggaggaagttgtgaaggaggagaactgtaagctgaatagaatacagtcatccctcggtatctgtggggtattggttccaggacccctgtatataccaaaatccagggaggcgcaagtctctgatataaaatagtgtcctatttgcatataaactatgcacatcttcctgtaaactttaaatcgtagattacttggaatacctaatacattgtaaatactatgtaaataattgttatattgtttttaaaattgtttttattgtattgtttttattttttaaaaatattttttttctttctttttttgacacagggtcttgctaagctcactgcagccccttcctcccgggctcaggtgatcctcccacctcagcctcccaagtagctgggactacaggcgtgagctaccacgcccagctaatttttgtattttttgtagagactgggtttcacaatgttgtccagactggtctcgaactcctggcctcaatcagtcctctcgccttggcctcccaaagtgccgggattagaggcgtgagccaccacacctggccttaaaaatattttcaatccgtagatgcagaacttgtggatacagagggctggctgttcatattttcaaagactatatatcaacaacatataatcaatatataacatatatgagatatatggataatatatatatatatattcagtaacgatatacatgtattcaaagtagtaggtttgttatagacagcatagagaagactctggctttttaaatccagtttcacaatctcggcctcttatttattttgctttgatttttattttatttttgaactttttaggttcaggggtacatgtgcaggtttgttacacaggtaaactcgtgtcatggggggtttgttgtacagattattttgtcacccccagtattcagcctggtacccaatagttatcgtctctgttcctctccttcctcgcactcttcacccggcagtagcccacagtgtctgctgttcgtgtctcagccttttcgctggagtggttataccatttaccacttgctctttgttttctctttgtaccacttactctgtgtttcctttttcctcggttcctgtgtgcttttgcataaattgcggcttttttgtgactatacttcacagtaagcttattagcaataactcattgctttattttttagggtgttgctctagtgttgacaattttcatgtttaaccttatcacaatctatgtttgaaagatattttacttcacatataagagccttacaacaacaatgtgctttcattctccttccattcttagtgctttgtgctacatttgccgtatgttttacttttatacatgttacaaacaccataatacgttgttattaattttgtactaagaagtcaattatatggaaaaggattcttttaaagagaagaaaatatttttatgtttatatttactatttctgccacttatcatttctttgtgggaatccacattttccatccgaagtttttcttccccttcatggactcccttcagtctgtcttgtaatgcaggtctacaagaagtgaattctctctgcttttgtttctttggtaaagtctttattttgccatcattctttgaaagatatttcatctgagtgtagagttttgcattgatacatcctctcagttctttaaagatttcattgtcttctgccttgcatagcttttgacaagaaatttgcagtttttactatcatttttcccctggatataacttttgggttgttttctggctgcttttaagagtttgtcactgattttcaagaaattgattgtgtcttgttggggttttctatgctgtttatcctgcttggagtttgtttagggttttgaatctgttttactttccttaactgagagttttacaacttgatttgatcttggaatccttaaaatgcgtttttggtttttgtggtttttttgagacagtctggctctgtcacccaggctggagtgcagtggccgcgatcttagcttaccgcaacctccgcctcccgagttcaagcgattctcgtgcctcagcctcctgagtagctgggactgcgggcgcatgccacaacacccagctaacttttttgtatttttagtagagatgggatttcgctatgttcgccaggctggtctcggactcctggcctcaagtaatctctccacctcggcctcccaaagtgctgggattacaggtgtgagccactgcgcccagccaaaatgtgttttaagtaacatattttatcatctcagtactagtgttttattaatgaacactaaaaccagttagagaaacactgatgaaaaccagtgtttattatttttacatatttttataactccatattggctccttggaccttttagagttgggttacgagaaagcaattgggcatttgcctggtattatgtagagggtatgcaaacacggttagcttgtggaaaagatatcagtaacaattgcctgtgtaaccgccagctttatgggagtgctccagtagtaacatttttgcttgtttcagctataaaagctattaccacaatctgtctctctcattttgtacagtaatgatccatgaacatactaaagggaaattgatggcatacccagggttaccatttacagatggcagtactgaaatgttaatttcaaaaacattcaaactgtagttttcttctgtagacatgggacaagcaatttttatcatttaatcatgcagacttggttttaaaagaaaactcttttaagatgttctttgcttttaatttatagccttctagtttgcttataacatatatgcttatttttaaagaacattaaaggttaggcctaaggaatttgtgtgcaaaattggtcattgattattaagaaaataatatagaacctttttttatgtcataaatacaactttaaaaggaaggggactcttcagagttgcctctgaggagcacatatgaaaaagaagggcagaggtttactgcagtggtaaaaaataatccacctagatcaagactattccaaaagtgaatttaaaaagaaaaaaagatgagatggtaagatatgaggaaataatgaatgcattgtgactttccacctccccatacccattttcatagtttggtgagtagaaagagaaatgaggatgctggcccaattttgattcccagtggatgaggctcacacagaactgccctgcttcttgacactattatgatattaaaagtaacttgtatttttataagttattaccatcttggcacacttgcattcattttagtcaagtactgtcacctttagatttcaagcttgcagagtcttaaaaaaatacacattggagaacacatagtcttttaacagtaaaatctcagcttattagaatgtttagtgactgaggtattcagagtcagtcagaaaagtatctttaggatttcagcatgtggagatgtctttcatagagaaaccggggagagtcaggcaaaccctagcacgttgagcatggcgtatcctcatctgcacgggcacttagacacctggacaagtccattagcagtaaggcaggatagaggggttcacaggatacgtgctgcccaggatacgtacgtgcagcccagagctgggaggaaatcatgaggaccgactagacatttattgtacagatgcatgactggctggtatggcctgggatatgtcagtgaagatacaccgtgaggttgtgggaggtaggattcacagtaaatcctaaattcttcatctttgcactcacgacgcacaatagctgatcaaagcttttagcaaactgcagcaaatgaaaaggcggcagaacctcatggtgacaaatgcaaaccctggagtcggactgcaagcattcacaccccagctccaccagtccccagccctaggacctagacatggagctgcatgtcagtgtgtccgttccctctgtgtgagaacgggatagtaacagcgctccctcacacgctcctgtacacatggaaaccaccactgccgtcggacacagtgtatgctgtagaagcacttatggtactaagcacattaaatatttaaaattattaattagattatttaatccaagctcaaagctctcagaacagagccaggcatgtaacaggtacaatatacatgttagctattattattattatttaatagagatggggtcttgctatgttgcccagactggtcctgaactcctggcctcaagtgatcttcccacctcggcctcccaaagtgctgcaattacaggcatgagccactgcgcccagcctattattttttaataactttatgtaacccggtgttgccaattgttttgaagtgtggagccgtttttcagatgacacatactaaacatctactaaacagcctgagaaacggcactctgaagagcatgccttggcaaacactcccctacttactctaaaactccagtcgattggcttccaagttcacttggttctcatttttcctggcaacaactctgcaaattattacccccatttgatgaggtgctggctgagaaggccccttgcccaggtatgtttccgacctgcctgtgacaaagtgttagattctgaaagccgggagtgctggcctcggttagctgagtgataccagcgtggggtctttcgaggctgcaggcaagatgtccgcccacctaaaggcaggatgggggctggaggggccgtgtcccggcgcctccttcctgtggctgctgagttggtatggctgtaggcagggggcctcagtcagtgttgtaccgtgctggcctcgccacgagcacccgaaggaattttatcatacaaatttgattctgttttatcaagagatgccagtagcacctccacttccagttgggacaccccaaaatatctccagacattgcctaatatcccctgggagatggcggggggtgtggggagggggcggcagcgggcactgtctcccctgctccagaacactgtattgaaatacagaaacgtgatgccaatcccatgcttttatttgggattaaatgtgtaatccatatgcttctgagtgggaaaaaaaaaaacttggctccaagcagaaaatggtgcatcctttgttgtcattgggcaaatgcttggtagggatttgatctgtgtagaggaatgctcagtctgcagtggcagccaggtagtgagcatgtgcggccctgcacacagcatgagcttgtcagacagacagtgcttgccaagcagggctctggcatgcgcttgttgttggctatggctcttccatgggcaggctcccggctcctccttgtgcatccatcccctttgttggccaccctgcctgctggccttaggccttctgctcctttccccaggtcctggctctctccagcttggcctccctccgcccatcctgtgcacctttcattcctgggtaggaggagactcaggtaaagaaggataaaggcagaacgatgccaggcaattccactgctagccattgccccaaggacatgaatgttcatagcagcatggttgacccaagccaggttcctgtcagctgctgcctggaaaaacacaacgtggttcagccacgcagtagcatagtattcagccataaaaggagtgaagccctggaacgtgctacaacatggatgctctgggaaaacatgctcagtgaaagaagccagatgcaagaggtcacatattgtatgatctcatttagtgccccaaatagggaaattcatagagccagaaagcattctgtggtcaccaggcctgggggaggagggaatgggagtgactgcttagtgggcaccagaactcctttccaagtgattgaaaatggtttggaacttgacataggtggtggttgcataacatctgaacgtaccactaaattgtacactttaatttggccaggctcagtggctcacacctgtaatcccagcactttggaaggctgaggcaggagcatcacttgaagccaggagttcaagaccagcctgggcaacatatcaagacctccatctctatatttaaaaaaaataagaatttttttaaaagaaaaataataaaatggttaattttatgttgttacttttattccaactgaaaacaaagcaaaacaacaacaacaacaacaacaacaacaacaacaacaacaaccatgtatggtccaggggaatgtctatgttgggcctgaggtgtgctgttctggtttttcttaggtgaatgggttctgaaggctgcatcaaaagaggagtctttaaagttgctaattctttcctgataggaaaagaatataatttctcaaaatgactgctttcgaggaatgcccctttctgaatttgaaaacatagtattaaaaagaagagtctctcagtgctttagattattatttcttgtattcgatgtaaaaatcccttacagtggttttacaagtctgcagaggaattcacaaagcacgattgaaaagtgatgtacaggatttatagttgaatgggaacaaaccagctgatctgcatataggatgaaatttagctgagggtgctattgagtttggacaacatttggctggacctttgtaactcttcagctctatgaaacaatagttgtgtgaagaattaaaaggtggaaaatgaactgtaggtggctggctcacatatgcctaggtctatttccagacacagcgaacagtgaaatgacagtgtcggtgaggcaccagttcaaggaaatacacaaagactgcctactcataaatacagacacaatggggtgataactggtgcttgcacttggagatctagaattctaaaacatcggaaaacaatagcagaccattctgtgtccttttctttaaaactatctcttgaaattttcgtgcttcccccaagaacatcctcaaagatgccagtaaaaataactccacaggaatctttctgaattccaatatccatgtgaaaaggctgcattttattctgatttttcacaatagaattaaggcagacatgatgaagaaatgaatgtgtagaggacttccgaaatctgtattaacgtgtgtgatcagcaactgtaatgttttgattgattatatatggtacatctttcattcattaagctaactttaatcaagtatgtgttatgtgtcaagcctggactgtagaaatgaacttgaagaagaaaggactcttcctcctgttcgggtagaaaaggtataatgcgtgttatggatggtgtgaccgaaggaaacaccggataccatgaggaaaattgagatcatcacccagggattctgtattctacttagggaataggctaaacatcaaaatacagcaatttgagacaaaggcaggcggtagtcccagaagggtaggtgtcaaatccccaagagcatcggcggatccaggttcctgttgtgttactatcctgccttcctaagggtcagacaggctctcaagcaacccccatgaccacaagttgtgcacatcctttcccagctcctctcacctaccattggcaagaactcagtagtggaacacctggggtctcttaatgaggtgtgcttgtgtgactaaaagaaaaagaaattttgggggaggagcaggctggtggatgtgcagtttctaaattatcttgtattttatttgattacagtgtttgaattcagtgttttgaagagatgtatgtagcactgcaagctctattctaacctactttctttggagaagcaggtacatgctgtgttgtgtcagcttagagagccccttcaaaacctctccatgttcaatgtggagggactgtcactatacatgcatggcacaccacaccaagaacagagggctaccagaaaattagaatcccttttatatttgtcacatatcagcatttatttagctgtaaaaataaacagcatatggcatttgttaaaatcgtttgtatttcacacaaatatttggcaatatgtaaactttcttgccagggctgtttattgtggttctatttgcatactaataatggggaaatcagtaatgaccaggtgttggaaggtctgatttctcatttaaatgtattgtttctagcaataaactaattatttttgacatgtttcataaccagaagaatgttattaaccaaagtcataattcctatttttgtgttgatcacacacagatgataagttaattatacttattgaatttaacaacatatataagagataatctcaaatttcaagactctcatttgtgggttaccatctgttttggaccaaagaataggaatttgattgcaagctttcttctgaacagcttgtaataagagctgtttgtatattaattacttattgaattattgtggattttaatgttttaatttacaagcaatttggaacttattgtggtgacagctgctcatattttgatactttatggtatttagcaatttcatcataaggctattttttcccctggtaatttataacccaatcctgaaaacagtaatttggtctctccagctcactataaggagtattgtcctgtttcatccccactgcagatttttttcatagttaaaagtatattttataagcaaaatcaagattcctttgtgcctgcttccctggtgccctttcatttctattcagagttacagatgaatttagtttcactctcattattttacttcagtggtagattttttacaaattgccctggttattactttcatcttgaatatccttatggtttttgttttcaatgtactgtaatgcactttaggggcctgtgaacctgcttgtaggtttttttttaatctccttcctttaaacaacataactataaacatgactcagtgggaataatttgcttgaatttccttaaaacacttgagtttctatataaactccctaataagaaacaccttcactcatagcttcacttgtggacttcaattatattaaacctggtacctttttattatcactgaagactattaaataagaatttagagaaaatggtggacatttaatttccttagttcttgaattcgtagatgatagaggataattgatactctctaggaggcaggaatcattcacaaccaaagaaattttataaggtaaatatcattaggtaaatggtttactgattagtgtttatagtgactgagaaataaaaacaatttttgatataaaggattatcattttatgagccataaacctggcttcctcataaatcagtgcaaatggaacacttgtgaaacagaaatgtctgaagagtaaatgaaaagttgagacgttagtgggtgcctttggttttcttgattttagaggagccggaggagaaaggattctgacccgtttgtgtgtttttatgagcacagtacatgaggatgcatatatgcacacaaatgtgcctggtagagttattggaaagctagcccaagcgatggggaatgtttagctaaagcgtgttgtcttctcccgagggtgtgcacaggttcatgtatcagctgaataaggccctgttccaaaaactgatatttcaagggaaccttaatttatctttaaatttaatgtaatttaaaattaatttaaatctttaaattatctttaaataatagcagtagcaatagctgagctaacattaattttatctattttgagactcttttatttcagaacttctacatgcataatgcctgaccggccacttttaatttctcctttctttcactttgcaaacaaaaccttacaatctgtgctatggactaagacagaaattaagaaccaataaaatgtgttaagttttaattaggaagaagaaaaaacctaaaggaacgggatggttgagaggtaaacacaccccaatgatttttaagtcttttgtttcaaacctttccctttctccctaggctggtccctgcagacggcttcccatttttatgaccggatgctgggaagcctgctggtccacaggtccatacatgaagtcaccataaggtaagcagcccagcatgccattggatccttgcccttgtacctgaaatccgtttgaggagcagaactgcattttcccaaaatggaaccccttctgttttaaatgatgttgtcaggggaagtgcccggtctttctccttactgaaggttgaaggtagtagacagacaatcattaaatcattgcgagctgcatagtcaattccaaatgagaaatttgcctttttactgacttctgagaattttgggttgtgtttttgttttgttttgttttgtttttgtttgtttgttttgagacagagtctttgctctgtcacccaggctggagtgcagtggtgcaatctcggctcactgcaacccccgcctcccaggttcaagcgattctcctgcctcagcctctcaagtagctgggattacaggcacctgccaccacacctggctaatttttaaaatagtttcagtagagacagggtttcaccatgttgtccaggctggtctcgaactgagctcaagtgatccgcccaccttggcttcccaaagtgctgggattacaagtgtgagccattgcatctggcctgccttctgagaattttggatcctgaaggagctataacaaatttttctgggtcttaccaggcgaggatgacaccttctaaaatcaacctctcttgtcaacattatcaattacaattatgcagacaagttaattataattgggtgcatgagtatagattttatttggctcctatatcttaattctatgctttatcagtttcttaatatgatttgtgtctgtctccaaattgatttgctagttaactttgaaacttattagaaaatcatggagattactatgtgtaaatctggtgagatgctaaggtttcctgactagcacaccaaacaattgtatgtgcacaggtgtcaagagttgagaagcccgtagcccaaactaaaactgagacccatgccccaaaagttctgtaaaagttatcttactacctttcggtacgtgtgattttaatttcactttacttaattgttatttaattttctgtttctttctctaatgcctttttagttaaaaaaacaaacaaacaaacctgtagaacttgggcagttttaaagtgtaaagatagaattttgaggaagctttttgatttactattttaagagaaccaactagaactaaaatgatagacttaaatttaattaaaataagcagcttactgtttgaggtacttttgtttaaagccagacatatgcatatgtaggttgttttaacaagttaaatatgtataagtattttaatgaaaggtgtagtctgtttataaaaacaaaatttgtaatgtattagtgaatttgaattttctgactggctttttcactcagtataatgttttcaaggttcgtgtgcattgtggcatgtgtcatttctttttatgtcagaatattccattgtgtggctagaccatggatagaacatatttgattcatgcatcagttgatggaaattggagttgtatttcccttttggttattattaaaaatgatgtcatgaacacacatatacaagtttttttgtgtggacatatgtttcatttctctgtggcatttacttaggagtgggtcatatggtacctctgttgaacattttgaggaactgaatttttccaaagtggctgttacaccagtcaatatttttcgaaatgccattgaaccatattttaaatgtcagagggaagcagggaggggatctttctcttatcaatgttttgagtgggtattagttcagtactttgggaacataagcttcaatttcattgaatccagcacacattggatttctcctctgcgtgaggtatctgtgtttggctttatacctcagtcatttatacatgactgagtgtttttgtagcctttgataacttgtatggtttatacatgcagatagtcatttggcattatcctcaaaaatggtactctattgctgtagttcattagtaaggttgggaataacctacataacatactctttctgcctatgctgcgtgctgcgtctcagaaagtgagggcttctaacggtttccttgaggtgtgtgtggtttcaacacatgtcctcctttcaaaggcatccatcgcagaccctggtgatagtgttttttgtatctcagtcttaaaggggttggtatggttatgaggaatgttcacattcaggggcgttcactgttgaagttctcaggcaggaagattccaagccgagaagggactaggcagtccgttctcggatgtagaggtgggaaaatctgtggtagagcaggaaggactgagagcaggctcagcaagcatgttctgtgatgggcccgatagttaggggcttaggcttcgcgggccaggcggtctgtgcggcagctgctgtactctgccattgcagtgtgaaagcagtgtaggccctacagaaatgtatgaacatggctgagtgccaagaaaaccctatttatagacactgatactgggttgcagtttgctgaccctaacctagaggaacacaactgttttctttccaccttttctaattgtggccttttgagttggaggccacctggaggtgaggctccgagaggcccacccaagggccatgatgtgatgaagacagactctaaattgtgattacgtagcgaaggcactgcagatatttgggggtcaggacttttacgtaaggaatttgagggcctttctgccacataagagggagtggctctgggcctgtgtaactgccctaacttgggttctcaccctgggggagtctccacccccaagataacctgggaatgtgtggagacatgtctggttgtcaccactgggggagtgggtgctactggcatctagtgggtagaggcccgggatgctgtcaaatgtcccgcagttcacaggacatcctccccaacccctaaatgtcaaacgtgaggagattgaggagtcctgctcaccgctgcttctgtcagccctttattttgtacttgttgtcagtcatatggctgtggaattataggctatggggcattaaattacaaaatttagtacctgtgtttgctgacataagtgtaaggatggttggactctgatctaatatttgggttcatgatgcttttagttttttccttttttaaaaacgtctttgtcattcatttaaatataagcctccaaaattgatataggccaggcacggtggctcacactttgtactccctgcactttagaaggccaaagcaggaggatcacttgaggccggaagtttgagaccatcctgggcaacatagtgacacccccatctttacaaaaaaagtaaaaacataataattagccagaggtggtaacacatacctgtagtcccaactgctcaagaggttgaggcaggagaatcacttgggcctgggaggttgagccttcagcaggctatgattgcaccactgcactccagcctgggcaacacagtgagaccctgtcactaaaacaaaacaaaatgctgatataacactaagatttatatgagatccaggccacattgggggatggggcaccgcctgcctttcgaactgtagggtacgcttcagagtttatttttcacaacttcacaggccacatcatatgtgtaggtgaacccactgctgactccatctactgccagaaagagactcatcatggtcaaattaaattcttcatatgtcagtgaaaaatcagtgtcttagagatatcatgaccagagtgcatgtattcctgaaatttgtttgaaggcccggtgcacattgtgtagaaactgtgttcagtctatctaaaagataattaaaatccataaattaatttctggctggaaaataggtcataatggatctggatatcagaagtgctaggttaaagaccacggtcatcaggaaaataggatgagctcctgctccgtggaagcagtagcatcagtgccttccaaggcagtctgctctgaaatcttgggcacgtgcatctgtgttgaactgtggccagaggaggagaggatgaaagggaggcagtgctctttttcttacatgcattgtccggctcatgtgatgtgggtttccctggtagtggcttgctcttgctaggtggagcattttcaagagggcttccttcctgtcaccatagcatctgccgttgacgtgcatgtgggctttggatgaaagccccagccagccactaattaacccagaagggtggcagggcacagaaaggaccttttctgaatgcctcatcatggggattttttcttttcttttctttttttttttttttagatggaggctcgctctgtcatcctggctgcagtgcagtggcacaatcttgggtcgctgcaacctccatttcccaggttcaagtgattctcctgcttcagcctcctgagtagctgggattacaggcgtgcgccacaacgcccagttaatttttttgtatttttagtagacatggggttttgctatgttggccagtctggtctcaaactcctggcctcaagtaatcagcccgcctcagcctcccaaagtgctgggattaacaggcgtgagccaccatgtcccgtcagggatgattttattctgtgaaaagcggcattccttttctaacacaaaacctctcctctgctctgccctcccaaccctgtagcctcatttcctatatagttgttttcatactgattatctctgaagacattgccaggtcgtttttgtttgttttgagacaaggtcttgctctgttacccaggctggagtacagtggcacgatgtcggctcactgcagcctccacctcccagggtcaagcgattgtcgtgcctcagactcccaaatagctgggaatacaggggcatgcctccacacctagctaatttttgtattttttgtagagatgggtttcactgtgttgcccaggctggtctcaaactcctggactcaagtgagcgaccacgcccagccgacattcccaggttttctttacgttttaataaatatgagtagtccatgttcagagtagaaactatacaacgtgtagaaagatacacatgcaattgggagccgtgcttttcccacacagtcccctgtcatggacattgcccctgcctgaaatgctgttttcctggccgcatcttatgccactagtttattccatatttaaatggaggcgtcactgctcggcattggaactctagtaacgaagaaataattctttgattatatttaccatttcagaccattgactccaagtaaataaatataaccgtaaaactaatgggaaattttttactttgcggggaatattttcgtactgaaagtattgtatatctgattgtgggtaaatggagagaagtgtatgaaagaaagcaagcaacataaaatatttttatgcatttctccccaaacttttcctctgtatgtgttttcctacaggtttgggtcaaactgtaaccttgttggccctcttttctgttttgttgtcgccccctgccacccaatttgggacatatcataaatatctttccattaacctagctttgaaatttttaacttgcactggaagaccacagcgtttaatgtcaaacaacgtaactttaaatcctagcttcgctgggatttaagttggttatcttccctaagcctttatttgttaaacctataaaatggtaataagagtaatggtcatatttatctcttggagttatgactggtgagatcgatcgtatcgtgcacatagcactcacacctgatagctagcatacaatccatgccgtgtattggtttctaaaatcatcttcatggcggcctgatagttcccatatgtgttcactgcaatttatttcatcgtgctgtcactggacaatgagattgtttcgagaaccacacattgtcttctttacaattacataggatgaaaagatgtgcaaagtggtaaaacaagcctgtgtcagcccccaaataagctgctccccaggcagatgttagaaaaggtgtattgggatttatatgtaaactttatacatacatttaaaattctgtcttaagctggttactgattgtgaaatgaaaataaactcagtttacatctgagcagagaaaagagccgctgcctccaaatgggcagagtttgctcgtttccatgaagcaacttggagaaagaggtgccctttagaggctgaggtcagttcaagcagatcttccagtgaccctggctcggtccagtctgcatggagacaagccccaaagacctgagccttgtccaggccatccctccaagcaatggattcttccagcacagacgccaacagcctgactaatagcagcctaactaatgacactcactttctcaggtgccttcagaaaccaagggctgctttagaagatctttaagatgtttacataacagggcaaatggctgaaagataaagcttcccctccagtgatgtcagaggagctctgtgcgctgcccttcctacaatacacgcccccttcatcagctcgtgcttccttcgctgtttcagaacacggctggcctcttggcaagaaacgaacttgccctttctgtccttaactaccagcaccagctctccagcaggccccatgtgattctactttttaagataattaaaacagcaattaagattttgtttggggccagtgttctcccacagaatgatggcatattgagtgctctaactacatactcaatgaaatgaaactcttaaacagccatttctcctgggaccgaatgctgaactgttttgtgaagggaactgcgaattaataggacttttggccaccttgaaaccaaggcttaaaaaaaaatactataaataatctccccttcagcttcttgacggctctaaaccccaaattatcacttatattgaattacttatctttagcagagaaacttcaaaaatgccatcagcccatgctcgtttgttcttctttgccttctttaagcagcacagtgagagaatgttgtggctttaacccaaagtggaaggtggttatttcgtttttgcgcaatcacaactccaaacacctcaaatcaacctaattgaaggtgtctttaatcaaagctgggtcaggcaagaaaataaacacagttgctctaattaagactcccctctcatccccctcctgtttggggccaaggaggagctgtgagtgctgccaaaactctcctttattttagaactggagaaattggaaaacatccacaggagttctcagaactcgaaggctggaagcggatgctgttcgggaaaccggttaggtgttagaatgcggcttgtgtctccagctgtacatactagaaaagaatgcccaaacacaggcctctggtggtagttctttttggttgggctttatgtgtgccaccttgcctgcttgacattgctgatgagccaggacgaggagtcgagccctgagtggtcatgggcgaggcaggtgtgtgtttccctgatcctctcctactgacctttcaggtctctcttggggaattgctggaggagctaaaataccagctcccacatactggatattttctgtgcatcgggctctgcataaaagcattgactcctcacactctcccctttacataggggctatttgatactcagtttagagataaggaaacagccatataactgaccctccaatcccagggctagatagtggtgcagctgcccctagaagtcagggtctctggcgcttggccaaaggctccctgaatcccacatctttacctgttctctgtggctctcaggacgtgagctaccttatctctagccaataagcctatacggatggggactctcaccctgatttaccctaactttattgtaataaagtcataactgtcataagaagtaatagttgcaataaaaagtagtaattgtaataaagcatgaacattccaaactccatgttatttgtccacaaaaatagttcttggcacagaagacaaaggcggactttttcccacagaatacatagctgtcgatggcactttgctttgaaccttggtgtagagggcagtcctcatgccctgggctgaggggtgcatgtgacacatcattaaaagtcaaaaatcattttcatagagcaggtcctccccacatgtacacccagagctcctgtgcttctctcctctttctctgacttcttccaaaatcgtgggtcttgtctccatcagtcaagaatttaacttttcttccaaaacatccccctcctcttctgtgaaggaaggtgcttgtggactggccttaggaaatgtcgcccagacaggaacggcacaccagtgtgccatcactcaagccagaaatgaggtttgcagtgaccttctctgtgcttgagagttctgctacactacgaataccactataataacagcacatttatttgtgggaaattaaacagcaaagccctgggtgggagatccataatttaccatcttcctgtgaaatttagttctggtcttagaaaaaagaggaggaggaggaatttttattcccagccttgtgtgtggtgaggtttgtctggaacagtggttcttgcagaggaatactggccaggagactcacttgagtcaaaaaactgaagaagatccatgaaaacaaccaccaccttcaagtgagccacttagagataagcgcagctaaacgccgggacacccagctgatggatggtttctcttgattttggtgtgatgaagcccacagagctgaagggcattaaatacagctgttagggttaggagtccattcagagaatattctcatgcttgtatctaataatctaagaatatatatgtagattctacaatttttggaattaggttttaaaagaaaaataatcatttaaaagctagcaaagtaagtgtttgttgggggagaaaagtttgatccaaatattaaatcagtcttaaaaaattaaaatatgtacttgagatggagcagtcagtcttaccaaacattacatcctggctcgattgcaggccatggatagtttttgttttgttttctcttctgcttagaaatcaaaaccctttagaaagttaacaatgtattggggaaagcattccaatccttggaccctaacttatacatttaaaaacaatgaatctgtgatcagaaagcagaaagccagagctgaagcagaagtttttctagttggaagaaagaaagatgtataatgcaaattagaggaacagataattaaaaatggcccgtaatccccatctcctcaggatcttatattctcattctccatagttctatataaacacatgcagagacacctgtatttatcacagatgctcctggggtggggaatattaaccaggctgtgtatacaggtgtttcatctccacgaatcagagtatctgctcttattttgaggcaagatctcactctgtcacccaagatctcactccactcactggagtgcagtggcataatcatggctcactgcagcctcagcctcctgggctcaagcaaacctcttgccttagcctcctgagtagctaagaccacaggcatgtgctaccatactttgctaatttttaaaatttttttgtagagagggcatctccctatgttgccaaggctggcctctaactcctaagctgaagcaatcctcccatctcagcctcttagagtgctgggattacaggcatgagccattgcgcccagctggtaccttttcagtggtcaggtcaccaagcagcgtctgagcctgcaccagttgccttactttataaatggagttcatttcaaacacaaaatgcttattttccctctaaagagcaatggttctcggccagctgcagttttgcaatgtgggacatttggcaatgtgtgcaggcatttttggttgtcaccactgcaaggaggttgggggagtccaaggatgctgcagaacatcgtgctgtgcctggaacaggcttgcttttttttttcccccagagtaaaagaggaaaggagctaggcatggcaaacaagaagggcagctgggaagctggggtgtttgccaggtcctgccagacatagtttcctctctgtgcctcagtttcctcatctgtaacatgcagagatgagatgccctccaagattggtcctttccagctgccctcactgggagggggcaccgtgccctgcctcccaggctgactcgtcctttgtaattctcttcctttccacgggactccagattcatgccggtcccactagccctgttgccctgttcctaagcctgtccagaaatccttgggactaagtgaggctgaagctatagcgctctgctcttcctacctttttaagaggtcttacattgtaaaacttcaatttttcaaacactcactggctcacagaagaaaataaaataaaaagctgcaattgtgaaaatgtaattgctcaactttagctcatgctccagatcagtgattttctcttttagccaaacttctttataattatttcctttatttttataatagattcttcaaaattaatttcaaaattccttatctaccgtctttcacaaatgtatgtatagcctagagaattttggtaataattttgtgatacatttatattgggatttgtagctgccagcctttttttttttttttttttttttttttttttttttgagaaagggtctcacttccgttgcccaggctggagtgcagtggtgatcgcggctcactgcagcctcgacttcccaggctcagatgattctcccacctcagtctcctgagtagctgggactacaggcgtgcaccaccacactcagctagttttttcgtttgtttgttttgttttgtttttgtagagacagagttttgctgtgttgcccaggcaggtctcaaactcctgggctcaagcgatccgcctgcctcggcctcccaaattgctgggatgataggtgtgtgccactgtgcccggcccaagccattttttcagtccattctttttgctcctcctagtaacccttcgtagcaaccagccttccattgttcagtcaccagaagttaatgatagaaaaccagagatttctagctgtgcaagatgtagagagaaacctaaactctatacatttgctattggcactgtgttgccatagtcactgcagcactcagcatcaccaaaagcctgcccagtgctgcaacattctttagatagatttttgttgttttattttgtctccttaaataatatttaatttttcattaggtcatgctatgatttcatagcttattttgtctctaatattttcttctgcatgctgtcttttgagagacctctccagagttcaagcacaaatcctaggacagacttgtattttgactgtcaaattttcattgcagtatgtgcaaaagtacagaaatgtcatcaaattaagcaaagaagataagaatttttgaatggcagtgttctggcaactataaaataaagtctattaagagtgcaaagtgagaggtggaatgtcgccagggcagctgcattcattatctcttgctggataacagacgaccacacgtttagcagcttgaaacaacacacattcattctctcaccgtggctgcgggtcacgggtccaggcacagcacagctggggccagtgctcagcgtcccacaaggcttggtccgggtgtcagccaggctgcgctctcctttaagctcaggggttttcttccaagcacaggttgttggtagaattcagttcctgtggctgcaggactgagaccctcagctccctgcaggctgcctgccattgcctggacagatcatgcaatgtggtgttaataatcacaggagagaaatgtggtcaaccttgccatgtaatgtaacctaacctagggagtggtgccccatctccttgacgcattctggaagcaagtgacagatcttgcccatactcaagggtcgggagtataccagggcaggactttgtgggggtaaggtatgtccctggcagtaaccattactttgaatcctcccattaaatgtaaaatatcttccaacttgaacatatactttgtacttttctccccctaaacaaacaaaaactcaatcctcattcaacaatgaaagttttgctgcctgtaaagatacttgcaaatgtgtgatatagacaccaaagacagttcccaaacagcctaaagatgtttagtgctggccgggcgtggcggctcacgcctgaaatcccaccactttggaagtctgaggcaggtggatcgcttgagttcagaagctgaacaccagcctgggtaaaaccttgtctctacaaaaagaaccaaaaaattagctgggcgtgctgatgcccacctttggtcacagctacccgggaggctgaggtgagaggattgcttgagcccgggaggtggaggttgcagtaagcccagatcatgccactgctctccagcctgggcaacactgcaagactctgtctcaaaaaaaaaaaaaaaagaaagaaagaaaaaaagaggccaggtgtggtggctcacgcccgtaatcccagcactttgggaggctgaggcgggtgggtcacgaggtcaggagatcgagaccatcctggccaacatggtgaaaccccgtctctacaaaaaatacaaaaattagccgggcgtattggcgggcgcctgtagtcccagctactcgggaggctgaggcaggagaatcccttgaacccaggaggcggaggatgcagtgagctgagatcgcaccactgcactccggcctggcaacagagcgagactccgtctcaaaagaaaaaagatgtttagtgttggtgacatcattgacgttagttgcagcctttctggggctgcccagctgtttggagtgagcagctcttactgatgtatgaattctggtttgttcatggacaacagagttctttccttgcttgttccctttgggctggtttgctcttgtgtctaaccgggtggtgtctaagaaaaccagactctgtcttggctgtctcacacagaagcccctgaacgttttcctgcccatcctccctccccagatttctgcctgccttctgggcaccagaagtcttagccagacggatgcagcggattctgtggtgaaacacaaatgacagaggtgctccctgccttctgtgttctggttttccaccaggagccctggcctccttgcagaaacatcgaggtgacatgtagcatgaccgagctcgctggcgcctcttcatcgtgctgccaccgccctgcaggaagaggggccatgcagtcagtcttgcaccactttcaacgtttgcgagggagaggtactgcggttcctcatgtggccaggaccgtgtggtcactctttgggggtgttgacatggccgcgggtgtactcggtcacctctccatgtgtccagaaaagtgctcagtgttgaatccctccacgtctgcctgagtgcactttgggattccattcctgccgcttatggggcgcgctgcggatccctgcatgcacagagctttattgaacgcaaagtcagttgtttgttgtcgtgctctgttgcccctgcttctggcttcattcatgtggtttttgctcaattcttccccggccttaggaaataggccaactcttgtttttttggaaaacatttcacctgggcatatttttctatctataattacggaatttttatgtaatcacataattataaaatataacacaatcagatattaattaccttcatgtgtataatagcatggatattattttctttagtcatctcaaaaaaaaaaaagagaaaaatacaagcagtgtttcaaaactctcttctctttttgaacagagggtggttcccacttcatcaacacctcatcgccgcgaggtgaggctaagatgagcataaccagtgacgaggtgaactttctggtgtatcggtatctccaggagtcaggtaagaggcttggttttctgtcggtaggaaattcatctacagcatcttacaagcagaaggatcaacgcttaattcaaaaccaggctgtagaagaagaagaagaagagctaagaaggttcttagtgctgatggggagaagagaaggttctggagctgtgccatccccgggtggaaagagggaatgtgttctttcttcccttgacacttctgtgcagatgaatcaggcaggaatcaagagcggttgtggtgaatgtggaaaggacggaagcagtgcggggctcttggcctccacctcggcgagggcatgcatgagctggtgtgtgtgtttgaacctcttcgattttgctccagagatttattcagctccccagcctcccctactccccgccccctaaatgggctgctaggcaattttctaaaacttaggaatcgtcgtagcatcttccaacatttttgattaccactgagacattactttatggttagtaagtaaacagccaatcacatgtgttcgttgttgacaagacagactttgagctgagcagctgccctcctccgccagcagggaagtagtgggaagaagccacggagcccagggcttgggttctaacttagaagatatgtaatttaagacctacaaaatgatattggtgaaaaacgtcctgatacccacctacctgttcaacttaaacaaacctctcaggtgcattggaaaccccgcccatgtttgcctccccgccttcctcgatgatgatgaccctggtggacttgctgtttgttatctccacgtgtttattacacacagccgttttcctaagcgacatacggtgcaggtggattcgtttcctagggctgctataatgacgtaccgcaaactggggtggcttaaaaagaaatatgttgtctcctagttcctgaggacagaagtccaagatgaaggtgtaggcgggtcggttccttctgaggggaagtctctcctgtgcccctgcctggctcctggggccttgctgcagtctttgaactccttggctcgtaggcacatcaccctcatctctgtgttcagatttgtccacatttccccacggtaaagacagattggattcggaatttaccctcctccaagacaatctcattttaactattgtttttgaatacagcaataattacatctgcagtgaccctgtttctaaatagtgtcacattctgaggtgcgctgttggtgaacactgcaacctgtgaatttgtggaggagggggcacacttcaactcataacagtcggtttgggattttaagttgggttttaagcttcgtgcccttgatatcagattgtatatattctggaacttgattatttgaaaaggaaaccccagttcctaggccccgtcctcccagagatgcatgtattcgattggagggaaaaccagtctacgatcctctaggcttgagttctctcacagctggcctggtagggtagactgtacgcattggagccacacagaatggctcgagctctgatcctcgaacaagtctgagtgaggcctgttcatttgagcctgggtttccttgcccaggcaaatgtgctcaaatacgtcaggcacgtagcacattgtaagtgcgtgccttccccatccaagcctgggtctctgtcccttgcgctcccagctagtgttattcatggaaagtacacattcttttctgcatatatattagatgcctgtgattggctgttgccagaacatagtataggaagttggtatacaaaacaaaatatgtactgcctcactctggaaatcagggaaatgataaccgctctgctaatacctcaacctcggctcttagaggagcacaggtgatctcctgcctcagagcccatagctttccagaggtgcctgcaaatggaaatccatgtaccaaaccctgcttccctgtcgacttgtggcatggaatttgagattctttccatttagcaacacctctgcacaaggacacgatgaaggccaaagagactcacagctcttgtgtaaacaagtcccaggctggaactgtccggtgtgaaggaccacgtgctccggtaacctggagacagagccatgctgctggctggtccccagggggccacggagcatgagctttgctggcttcttgaaataaacacagaaacccccatccctccccagaaaggtcggcttccttattcagtgtttgtttatgaagcttctgtaaccaggcagctgagagggagagttggagcacaacaatgcatagaccttggcaaatgtcaactttgtgtaacatctgtgagctccattcctgattcatcagtgtcactgaagtataataacacttcttaggcagagttgatattgaagagagagactattacaccttcttcagctcactgtgtgtattgtggaactttttagagcaccctacaaggttgtattcaaaggaagaagggagcaaagaaatacttaatgttgaaatgttcattctggggttattttctatgttcgtctcaagtcctaaagttttggttaggtcaatagtcattgagcccccatcaagaaagcacaccttctcagcctatcgctgtctcccttctaccttaaataaaaaggaaaacatttccctgatcatgcttcctcctcaagcacctgtactcttactcctgcaccccaccaaactcattaaaaacaggttctgcatctcagaagatgattcattcctcagctccctccactctggctttctccactagaagttgtcagtaaattctgggttcccagatccactgatcttactgcaactggcattcctccttccctggtcatccctccttacctgtgtgtggcaggaagcgggtgggggtgggcagtgaggcagggagtaggtgtttccctgcagtgcggcaggacagctgcttccctggaaggtctgctggaacactcaaccccaccttccaggtacagtgacggacaagttttccagagtcaccaagcatgtggcctgagccctgcttctctgccctggacccagcagaccaggttgccgctcctgtccatccattcatctccttcaccagtgcctctcttcctcccctctgccagtatccatggtgtcagttaggatgtattaggctgcaaggaggaatcttcagtggagcactgatggcctcagacagccgggaagcagggtgttgaagaaggatccaagacacatctcttcaaactcggaaaagaacctcaaaaacagatgtgttttgttctctgcccacaacaggcagaagtcaggtcatctggcttttagcaaaccacatatatttccctacctgtgtggattagtggattttcattgttgcccttgttacttgtccaaagcaagggctttgcccatcagaagcactcaatagctgttacccacaggcgacatctcatagcagcagactcatggcagtctgaaagaggaaactggttaaagcaagaatgttaagtagtagggaacttttgcattaccaagctctagtgccaaaatggatttgttggtttttgcatgagttcagcagtctggctttgacgagtgatatggtttggccatatctcatcttgaattgtagctcccgtaattcccacatgtcatggggagggacccagtgggaagtaaatgaatcatgggagcaggttttcccgtgctgttctcgtgaaaagtgaataggtctcacgagacctgatggttgtataaaggggagttcccttgcacaccttctctttcctgcagccatgtaagatgtgactttgttcctcattcaccttctgccatgattgtgaggcctccccagccatgtggaactgtgagtccattaaacctctttcctttgtaaattacccagtctcaggtatgtctgtattagcagcatgataatggactaatacagtgtgtgagtccattggcctctgtcttacgggatccattgcctggtcacttgtgctatctgggcagtttttaagaatcacatggtggccatgtgcctttcccgtgagctcgtgttaccatcccaggaggagagaagcaagggagcgagcccctagaaatgtgcacagcctgcacctgctgtagtgagcagctcccccaaatgctgggggagtcgtgagttgtgtgcccccgcatatttctgaatacagccagggaagtggaagtccattttccacttagtatggaaagagagaaaatttggcaagtgagtccctgtaaacatattatttcctctgggacttcatcccaaaatccaaactataaagaaaacatgttctcccagacccacatttttggcataaattaaataattcacaggaacttgcaaaacggtatgaggaatacagggggacagaaccacagattcaaactgaatttaactgagaaagagctgcctgcaagataatcgggtgatacattcaggggaaagggaggtactatgaaaaattttgttttttgagactcactcatgctgagggtctcactctgttgcccaggctggagtgcagtggcacgatcacggctcactgcagcctctacctcccaagctcaattgatcgtcccacctcagtcgcccaagcagctgggactataggcttgtgccacaagaaattatgcccagctaatttcttattttctgttttattttatttgtagagacagggtctcactgtgttgcccaatctggtctcaaactcctgggttcaagagatcctcccccccggcctcataaagtgctggcattacaggcatgagccactgcgttacctggccaaaaatattttttaaagaagtagaagatactgtctgaagaggaaagaaggaaggaatgcgcggagctggcttgagcatagtcaacacacaggacagttctgtcaccctcaaaattgccttgtatccctttgtactcagctcctcttccacccccaccctgccccggcaaccaccactgctctgtccctagagttttgcccttgcaagaatggcatagagatggcatcacatattgtgtggtcctgagagtgtgacgtctttcactcaaccttatgcatttgagattcatgcatgctgttgtgtgcaccagccattcattcttgaatagctaagtggtgttccattttgaatgctgtttctgcgatttgtttatgcatcctcttgtggagggacatttgcgttctttccaggttttggtgattccaacataaagctacaaaaaagattttcatacaggtcatttgtatgaacgcaggttttcatttctcttgggtaaatatcttggagtggggttgctgggtcgtgtgacaagtgtaggtttcactttaccagaaaccagtgcattcttttccatctaaggcagaggcaggacacgtcgtaaacatgactggttttatagacgtgagttgagtcacagaactcctctgcctgtcgcacaaggcatactggaaagtatgtaaagggacgttagctctggcgtatatatctgcaggacgctcatgaagtgtgattcttcctttgaggatttgcagctagccttctggactaatttcatgaacctgtcagggtcacagtttccatgggccgacatgaatgtagcccaggtcggctgaatgacagagcgtccttgtttgcataccttcccctccttaagcagtgccgttggtctaaccttctgcttaaaaatagaaaactctatacagcctcatcagccctccggtggataagcccaggcatctgggcaaggcaaaggccaggcttccagatagcaggattccgcaggctgggccctgtggcggccacgaaagctctctgtgcatttgcccacatacccatggtatcaaagtcatcgaaaacccagcgaagtatttccctacctggagctttgtgactgacgtccacacaccaccaggaacaggcagacaagttaataaaaaccatgtgatgatggtggtggcgacagtactgaagaaaaagaaacacaagtagaaatggaatttcactaacgttgtgtccggcacagggatgttaccaagttccgtgtccatgacggcagtaattttaaacactgtagctactaaaaggagcttgtcaccataataaatggtaaaaatccacttctcacacacgctgaattcccagagtgaggaacttctggcttagctctaaagatttaaagaccctagaggatggttgaaatctccttattcagtggaacttatgttctgatttgccctgattcgtagctgagaggccaatttattatacatttttcttgcctccattaacgtcaccaaacatgggttattcagagtgagagtatcactagttatcaaaagtgagcatctacactctgggcactcttgttttcctaaagagcccatttctgcacacctgactagctgggtagaagtaggcatgcttcttttatttacataacgtatatatggctctgtgttatatgtcatccttgctcataaggaggatagttgctatggtcccaatgtttctgttcccccgaattcctatgttgaaatcctaacccccaaggggatggtatttgggggtggggcctttaggaggtgatgaagtcatgaggagagctcctttgccccttctaccatgtgggaacacggtgagaaggcaccatctatgaatcgggaagcgggttctcaccagacacccaatctgccacatgttgatcgtggactcccagcctccagaactgtgaaacacacatgttgtttataagccacctactctatgtattttggtagagcagcccgaacagagtaagataatagtgaagtagtacatccacatgcccagactttcagggttgtgaatataacttagtgacatttgtcattcatttcgtgaagcttccatgccaagaaaatcattaataagaaagatttctacccagtgtggaggcccacgcctataatcccagcactttgggaggttgaggtgggtggattgctttgagcccaggagttcaagaccaacctgggcaataaatacaaaaattagccgggtgtggtggttcatgcctgtagtcccaactactcaggaggctgaggcgggaggactgcctgagcctgggaggtcaaggctgcagtgagccataattgtgctattgcactccagagtgggtgacagagtgagaccctgtctgaaaaaaaaagaaagagtcttgctgggtgacacacttcacctgcagtgcttctctctggtggcgatgccattcaggtgagttagcctcagaggagtgcatggaagagtgagtgagacctcagcggcctcctctttccacaacaaacccaagcacagagataaaaggctgtgctgagcgcccaccaacacgcagcgaggttatactgtccaaaaagagtacctggcagatgacccagcaagttcacagcgggtaagctggcgtgggtctcggttagagtgaggtggagcggaggggaaggttccctgttcttcaacactttctacagaaacataagactgagggtgaagtgagatcccctctgaaaaagcaccaggtgtcttgtgggggcctgatgctgagggatgggttgtagctcatgccctgtagaagagaacactgttcaaagccaaccagtctggattcaagaggggtcctgggagcttcagtctgtccgtgaaagaagcacttccctgaggcttccctgtgttccaatgcccttcatatcctaggcctctgaacagggtgctgtcagtcgagtgggattcatcatcctcaagtttttgccggagtggaggccaggctgtgtgctgggctgatctcctcctgttgcatctgtgagctgctgttgtgaggacagtggcttgagagagctgaacagaaagacatgccccctccttccaagactgacctcacactttaggggagcagtacagtgtcctttagaacacctcagcggaagcaacccagatgtccattgacagaggaaattccatcaacagaacgtgtccatccatacagtggaatatcatgactcagctttgaaaaggaaggaaattctgacacaggctccagcacggatgacacttgaagacactatgccaagtgaaattagccagccacaaaaggcaaatactgtaggattccacttagaagggatacctcgaggagtctaatccaaaaagacaggcagtggaagggtggttgctgggggatggggagaagcaggggacgtggagttgctatttaatgggtacagtttccattttgcaaaatgaataacgttctggggatggttgatggtgatggttgcacagtagtgtgaatgcacctaatgccactgaactgtgcacttaaaaatggttaagatggaggccaaggtgggaggatcactggaggccaggagtttaagacaagcttggacaacgtagcaagaccctgtctcaataacaaaaaaaattttcaaaaattagccaggcatgggctcacacctgcagtcccagctattcagaaggctgaggtggggggatcacttgaggctgggaggtgaaggctgcagtgagttatgatcacaccattgcattccagcctggacaaaagagtgagaccctgtctcttaaaaattttttttaaaaatggttagcatgatatattttatgttatatatattttaccacgattttagggggaggtcatggtattataggtgagaagttccatgtgtagattgtttttcagagtttagaaaattagtctcaaagggaagagagaaccacctgtattcacagtaatattaatattactaatattacatgataagggctttttcatagtcccatataagtgtttggggcaaatccctggcacagctagtatcatttgtaagctacattggtgtctgacaaaatccagttatttaaaaaacagaaaacagtggcttatttataatagcaatattctggacatatggccagtgtccatcagtgggcgtagttgaagcaagctgtggcatgcctgtgccgtggagcaccactcagctgtgaaaaggaaggagttgtgggtaggcacagcaagctggaggaacccccagagaaatgtgccgagtagaacaggccacgtcagaagattgcagactgggccaggtgcggtggctcatgcctgtaatcccggcactttaggaagcctaggtgggcagatcacttgagatcaggagtttgagaccagcctggccaatatggtgaaaccccatctctactaaaaatacaaaaaaattagccaggcgtggtggcacatgccagtagtcccagctactctggaggctgaggcaggagaaacgctggaacccaggaggtggaggttgctgtgagccgaaattgcacagctgcactccagcctgggcgacagagcgagattctgtctcaaaaaaaaaaaaaaaaaaaaggaagaagattgcagactatatgattccatttataggacctgcttaaagtgctgaaaatatacaggtggacaccagatcagtggctgctacagatctggagtagggatgggagcacgtgcgtacaaaggaaggttataggagagttcttttgtgttgaatgaagagtttggtaccttgaccagagacacagttccacagatctacacgtaggatcaaactgcatagattatacgtacacaaccagtgaatgcagtgcagaaaggatgacgatagtttgtgttccagtgagcatttccgtcctgcctcctacttagtggtgttgatcctctttgacagtagtgtaagatgcctagatgggaggagacaggatgaaaggtgcacagcacttcactagttttgcagtttcccctgagtccatagtaattgcagaattatttaattgtaaaaaagactataccaaaaatgtaattcaatgtttctattgtctgcaaagctttgtgtgtgtgatagatggtggtccataatgcaaaggcagccaagacatttttattatatttcgcaggtcattagccatattgcaggcctagggctgggtgggggtactctcttgtgtaatggattcgagtggcagccctattaactgagaaatggatggccacacagacactgtggggccgttggaaacagaagaatcagctggaagcaaacagcatttgtcatacggacattgcttgaatgtttgcagactggggactgtcgtttctgggtgggctgcatttttactgggggaaaaagtcggtgcatggcttcttccctgctcatttaccagtgagtcttagaatgcttttacaatatccacttagaaccttcagtgtggaggattctgttagatttatgtgttcagcctgagagaagtgggcagatttgagggtcttaacttctgaagatgttgtgaatggccacaacatataatgcattaactcaacattttcagcccattcattgagatcagggtttcttggccttggcactattgacaatggcggctggattgttcttcatcttggggggactgtcctgaatactataggatgttcagcagcatccctaacatttgcccactctctattacaatggagagagagtgggaagacatttgtcaaatgtcccctggtgggtaaaatcaatgtcagttaagaagcactgattcatatcctttagttgtaggatttttttttccttccaactggtttttcttgggaaatggagttttaatggcattctgatttctttgcccttcatcttgtgttctccttgggcttcattttgattcccttacctgcagaactcaaatagacgttcacggcaagcaaaatgcagtccttgttattattaaaattttgcaggtattttttcccttgaggaaggagaaagtctgccaaaagcattctctggcagataataaaataattgagagtagcagactttccatttgatttttcttttttggcttggctcctggtgagtaagttagttaacccggaaaagggtgttactgaaactgcctttgcaaatattgtaacggaagaaattatgacagtgagagaaatctgacatggctgactccatcttgtctctagcttcacaggctggctgtctttgctcattcctggttaaaatcaacttaattaaaaactgatattcaagctatatatatatatatatatatatatatatatatatatatatatatatataaaaggccttggtgctttttcgcttcttggatcttgtttaagaaaaatttttctttgtttttcttcttagtcagctgaattatttccccagtctgttttcttgccactcttgatgcccacatgagaggacctaaagtaatttctgacagcccgggactccttgggaaaaacacaggaggtgccacataccctgttttgagaaaaacctacgttttcctcatggaaccccaggaattgaaggaggctagatccctctcaaaatctaaggctctgttccgtgttacctgatgtattttgactttgggaggtatcagaaattactttgcaggaagaagagcttttagcctgtgtgtgtaataactaggtaggaaatatactttaagggatggctaatggagttatggaaggatactcagctctttgcacttttggattagagaagcatgctgtcagccacctagaaggtatggaaatatttctaccccacactgagagatgagactcccttgggggatgggctgattggctttggattgccttgcagtggaatgcagggtaaaagcattgcactctcttctcccattgcattcccctctttttggggatccaagatgtcatataaaaatgggacccttaatttgggggatctgtttttgccttccagctatgcctgcttattaggccctagaaactacatgctctcctggctctgtttctataagggctccaccctgaagccagtaatccaatgaagaaacttaaaaattgaaagataaaaaaatcatataactaccggatccccttctgtctgtgtatttatatgtgttgtgtgtgtgatgtttatataaaacatgttaatgttcctattagttgacttttaaagaaaaaaagtgctaaaaaaaaattgtcagaaaaatagaaacattaatgcatttaggtcacgtgactctaatctttgaaaaataaaggcaatttaaaatattattggtaaagtaaaatgtcttcaacatttatacatttggtctaaattaggcaggtcagatactgtttgctagatgctttaagcccataaactgcttctgtgatttttaataattgtttgacttgtctgttttacagccattggattctagataaggcctggggacacgtggaattagccaggtgccctagctaggctgggaagagtcagacattgtctgcagctctgtctttgtcctgggctctataatctaatacatggttaaaattgcttacctatcagatattacaccacaaattaaagctactgagaattaacattgtaatatactggagaaacaattttacttataaggtatacaaggaaaatagaatgtatttttggtaaaatgttataagaaggtatggaaatacggtttttgttaaagggaaggtaatgttgtctagttcaggggattttaaggatcgtcttaacctaaaagagcgataagacaaaactgcaagtttaaacaagcgggaggatcacaaggtcaggagatggagaccatcctggctaacatggtgaaacctcgcctctactaaaaatacaaaaattagctgggcgtggtggcgggcgcctgtagttccagctacttgggaggctgaggcaggagaatggtgtgaacccgggaggaggagcttgcagtgagctgagatcggccactgcactccagcctgggtgacagagcgagactccgttcccccctacccccaaaaagaacaagctataaagggtttgtgaaggattgatcttgtaaaggaagttctgtgtgtatgaggaagttggctaagatttgaaggagattatttcagtttttggtaaattaaacattaaaataaaagcacactgatacagggctcaaatctgggcccatgtgtctgaataatggttttcttaggaaattaatcagctgtttaacagaaaattataaagggttttaaaaggtttttgaaaattttacctgatggtcaaacgaattaagattatatagatttgtttataaggttttattaagaattgggtttaacattaatagtacacaaatgcaaaggtgaaattttgctttttcttttaaacaagattttcgtgtaatattaagggatacaaaaggtttttgtttgcccctttgagtaaatggcagggaaaaggaagaggggaaaggaaagagattcagttggcttcatgctgtcttcattgggtcctgttgtttggaaagctgaggctcctatcaaagtaaagattttttccttcgtaaaatttttgagttatcattttggctaaatgaatgacttaggtatggtgacctgggattctattttgtaatatctaatgttttaaacctttgatatttgacaaacttgccaagatcaaattctaggttatgttttaaaaaaaaattaggacacctaaagtccaaaagagatatatttggcttattcaatatattaaaaccatgcaggaagcattgtcaaatataaaatggtgtttaactttctttgggttatattcatataaatatgttattagtatgtgttacaaacttgtgtaagattcctataattctgatgtttcagtgtatgttatcattaataattataattgttatgttaaattgttgtgtgtcacagagacgaccagaattccttgttgattgcatctttatggctgtcctgagacttgtgtcatccatagacaattattgtcttgtgttgctccttttcagaaggcagttgttatattcagctataggactctgacaggtactcttgaatgcgggtctctgataagtttagaaattgtgccattggaataggaaaaaaaaaaaaaaacttttgggactctcgtggagagctgatgtgttaaacattgctaatccctttgttattcagaatcaagaaaatgttttctttttagctgtttaccacttttagcaattgaataagataaacttgtgcaaaatttactgtgagcaaaatttggagcatgttactttttctctacctgatttctgcagaatttatagaaactatttgagtattctcaacttatggcagtatagttatttgcataagtgcagtaagaatctgttctcttttgtaacagaacagaattagaaacactggttattttaccaaggctttgactggaatggcatgcattcaaatataaacagactgctttaaggaatcaaagttgacttacagagccaacaaaagcccctcaggaaaacgcctcataccttgtgcggtttctgtacagggttcctgacttgtggtaagtaaagaatgtcattttctggcgggcctagggagccccaagttatcttgagaccttgggtggaggaaagagcctattatggcaaataattcttcttgctgcactttatacaaataatcagtccaagcataataagactaagacttattttgcaagtaaatttgtcttactatgatttgtctttaataaaaatggggactagagagagaaaaattatgtttcaaaaaactataaacttcttgagttttcattatcttctgttaacactgaattctttgtgggctacaagtccccaaactaatgctttcaaatttttcttccacttttctaacttggactcagtaaaatgctactaccttgttcctgaggccctgcaagctgaagcttattcctcgtaatataggcgacaaaaacgtttcagattttcactgcctgcctcatctataacgaaagaggcctaacccacctgcattgccacctcctgatatgggaaacagctgtttaattaaacatctagtctcaggactaggaaactgacctaaaaagaatatgggatgatatatgtaaaatgtgttctttcctgtccatcccaatctgtctgtctaacaaccactggcccaaatctctctgctagccgccccatgtctgattggttctcagagatgttcacctgggtccctcagagcttaaggtccagtctacaaaggcttcggaagctaggacttccactctttatcctaggaccttatagctcactgttcacttcaatgctgtgccaaaactacagatgaccatcctaatgcctttgtcatgcaagccctgaaaccccaaccaggcacatgtgagtacatgcagacagctgcaaaggggttccactccttttaccttggggtctgcagctacacccactatgcccactgtcagcaggaagaagttagggcagtcgtctcttctttttccatcttcatagcccacaccttaagaataaggtgttataaaacccaaagggagggattgaaaccacctttgcaaaaattataactgagaacatgttgacagtgagagaaaactgacctggctgactgtcttgcttctagctcacaggttgactgtctttgctcattcctggccaagctaacctgggggaaaaatttagtttatagtttcaatgataatagtccttcccccaaactaaatgttgttgtaaaactaatgaaaggctaccaaattaggatgagaggggcttgaattctaaataatttaccattatgccattatgccataataatttgccattatgccggcagtcaagatttgcatcttccccttgaagatagcatcactgttgtagaacctaagattggcctttgagatgtcttttcaggtgttcgcatttctgacaaccagattgccccacttggacctgcgaacaaccggtcctgtggccccccctactgaggaatgactcagcataagaggacagctacaattccctatgatttcatctccaacccaaccagtcaggatgctccctaccccaccccactgctcaccaaactatctttaaaaaccctaatctctaagccttcggagagacttgatttgagtactaataaaactccagtctcccgtacagccggctctgcatgaattaaactctttattacaattcccctgtcttgataaatcagctctgtctaggcagcaggcaaggggaatccattgggtggttacattactcttaatatttgtgaataattgcatctacaaaaatgattaagtggctttgcccactgtaatcctagcagctgacaaattactctgtagactccactgtgtttcctagggccatggaatgccttcttatgcaagacacgtttccatggattcaggaaatcattttaatggttcagctatcttaatttaaacaaaagttcagggcttattgttcagctgagtctctaaaaatattttttgactgcagcggctcttttacattgctaatgtgtatccatgtttaaaaaaagaatctttatgaaacagtgaaggccagcatttctttgaggtgttggcagtctttgctttaggaataataaaggaaaacattagtttcatcaaataataaaataaggaagacctgaataaaatgtccacattagtagaggatgaaagtaccctgaaactctgcaaaacagtaatgtctcatgctttgatgtgatctcattaagtgagagcagcacattttgctggtatgttgggaccccccaagaccaccctcaggcccagtggtttgctggaagggctcacaggactcagtacctgccacacttacggtttattacagtgaaataatacagatgaaaatcagcaaggggaaaaggcataaggcacgaagtccaggtgaaactaggcacaaccttgcaggtggccacccccagtggagttacagagaagctgttaattctcccagaagaatatatgattggccatgtgcgggagagtggccagccagggaagctcacctgaaccttggcgctcagggtttttatttgggggccattcctgtgggcatgcggcccatgccgaggggttcagaaggaaaataggagaatacaaggctatccacaccacttcaggcccaggccacatggaaatctgggtgaggttctgtatctgtcgttggtgcatttatgcatttgttagatgtcaatgataaaaactaatttctaagaatgtgtaggagtgggtaagtagctggagaacgtgatacccaggcctttcatatagaaaagaatagcacatcaccctggccagctgtgtggcatgaacaattgatcctcctccaccaagtatgtccattctccctttgctaaatacagtggtgtaggtttgcagagcctctgctcacatgggaggttatgaaggggctaattgttcaattaccaaccctctcataactgtgctagttgcaaacaaactgtttgaaaagactgttttgctaaactgttctcttggtgtgattataaccatttacagtagcaaaatgcaggaatccagaagttcttacattccagatgttcataaccattccactctcctggttccagtgcagtttcagttgtacgatcttttctaagtttattgttctaaattaagacttgccattcttatgctcattaatttgttacagggagaaaaagcaattagaatgaaaatcagttgagtatttataaattacagttgtttaagtatacatcttgttcagtgtagtcaaaaattctccattggtattgacacccacaaaaatggtcagattctgttgaagatgcacataagccttaaatttcacttcctactttaaaaattggtgacgatgtgaaaatgtctaagagagtccacatttcctgttttagataagatgaaatagccactcaccaaggtgcctgtcttccgagtttattcaccgttacattcaagacttgcctgctctgaaattctactgtgaccttaaaagtgcccagcattgatatgttttatgccaaattctattccctttcttgctttccagaccgaacagcaagcgagttgtctggactgtcagacacaacactgtccctcttccccgaagtctctgtacatccctttgctggtgcctccttctccgttcacttctcaactactactgtcctcaagatgatgttctttttaccctcccacatctgtgcctgtagtaatatgtcactctcttcctcctgaagtctgagtcccatccccagtctctctgctgatcccccaagtctgagtgtccactcccaatctctccagtgactcctcccctccaagtcacggtgtgtatccccaacttctccattgccatccatactgatattttgaatgacacttcacgagcactctttaatgtaaacccacacttggtaccatcaccatttccctaccacagtctgtccacttcaaagacaagcttcctctatcctgtgattatgtcactctttgccttagtccattcgagctgctatgacaaaataccataaacaacagagatttttttctcacatttctgcaggctgggagtccaacatcaaggtgtgggagattcagtgtctggtggggacccgcttcctggttcatagatggcgccttctccctgtgtcctcacgtggtggaagaggcaagggagctctctggggtctcttgtataaggacactcatcccattcatgagggctccaccctcatcacctcccaaaggccccacctcctaatgccatccccttgggggttagatttcaatatatgaatttagaagggcggagagaagcattcagaattagcactgtttagtagaaaaacatcaggattgtgttcaaacatttttttccatgttatctttcctactgcctccttgtcttcagttccctccccaccacctggcacccagatatcctacccttgtcagtgttacctctatccccccatcactgttttgttgtagtaacaatatctcacatttgtcaagcacttgctgtgtgccaggcatgattctaaatattgacagatgaaactgtttattcctaccaatccctaggaagtagaaacagctccatcctcatttacagatgagaaacccaaggtactgagaaggtcctggcctacccaagtcacttcaaggaggtcatacagctgggattcagaacaccatccatctggctttggaatctttctcattttttcatttattcaacattcattgaaaataatgtaataaaaattatatatgtgtatctatatctacctatagatgcatatgtatatatgtatatatagctatcatgtgctacgtgatgctttcaaatacagttggccctccatatcctcaggttccccatccacaaattcaaccaactgtgactcaaaaataaattgggggctaggtgcggtggctcacgcctgtagtaatcccagcactttgggaggccgaggtgggtggatcacctgaggtcaggagtttgagaccagcctgtccaacatagtgaaaccccatctctactaaaactacaaaattagctgggcatagtggtgcatgcctgtaatcccagttacttgggaggctgaggcaggagaatcacttgaacccgggaggcagaggttgcagtgagctgagatcgtgcacttgcactccagcctgggcaatgagcgaaattctttctcagaaataataataataataaattggaaaaataatacattggaaaaaacaaaaataacaatacaacaattaagataatacatatatttttaatttttaaaagtggcagttttattagagcaagtatgaaaatatgaattaaggttgcaatgagcagcgcagcagagaaggggctgcctgccctcctccccccgcccgatatatatttcatgtgtgggacagggtctcactgcattgcccaggctggaatgcagtggcatgatcttgcctcactgcagcctcagcctcctgggctcaagcagtcctcccacctcagtctccccaagtagctgggaccacaggaatgtgctaccacacccagctaatttttcgtagtttttatagtggcagtgtttcaccatgttgcccagactagtctcgaactcctgggctcaagcgattcacccaccttcgcctccaaaaaagtgctgggattacaagtgtgagtcactgcgcctgacctatttattgttttttaaagacagagtctctctctgttggccaggctggagtgcagtggcacaatcatggctcaccgtagcctcagcctcctgggcacaaatgatcctcccgcctcagccccccccccccccccccccccccagtagctgtgagtgcaggcacgggccaccacactcaactaattatttttattttttgtaaagatggggtctcattttgttgcccagtctggtgttgaacccctggcttcaaatgatccttccacctcgaccttgcaaagtgctgggattacaggcataagccaccacacccagtgccaatcttagttctttgctcgttatctgaattttcaccatatttgcatacacctggagtattttcttaaattgaaacagttgctttttattagatataccaatacctgttagtttacgagtttcatttagttctattgttcgcataacatacatttaaatagctattaaatttcaaacatttgccctcacgctacttaaaattattttgagtaccgtcagaaatgtggaggccacaagagagtacttgaatgcagcagttgtcaccttttctccagcagcttgagaaagggcatagagtgctatctgagctggatttgaaccagaagtttttaggcaaagtaagaagagcacttcaagaaaaataaagagcaaaccccagcatttttgaggagaatgcgccatcttggtgatgcggacctaggacacatgatggcaggaaggaggaaaagatgctggcaagtagggttagtggcacattaacaccagctgagacacgggaacctgtccagttagaagccgttgattcattgttgaaagataaaactggatgtagtgtgagtaaaggatgacctgcctgcttggtgaaaaattagtaaccacagaggtggctgtcaaaaccaaccagcaaccagggaaaatgcttatagtgtgctaggtaaaagagaacagggatacaatattctgtgaccatgatgattatacatagaaattaagacgcacaggccaggcgcggtagctcacgcccagcaagtaatcccagcactttgggaggccgaggcaggtggatcacctgaggtcaggagttcgagaccagcctggctaacatgaaatgaaaccccatttctactaaaaatacaaaaattacctgggcgtggtggcatgcgcctgtaatcccagctattcgagaggctgaggcaggagaatcgcttgaacctgcgaggcggaggttgcagtgagccgagatcatgccattgcactccagcctgggtgacaagaatgcaactctgtctcaaaaaaaaaaaaaaaaagaagaaagtaattaagatacatagagaaaagggactggaagaaatcccccaatgtgagaacaggagttgtgttgattgtttaacaatgtgagttaatttctccatcttccaaattgctttctcttatattcccaaagtcatatcttgacttttgtttgagtgtgatttgcaatggtgctatccgtcgtaaatctctggtttagcattcatgctgtcttccaatttccaaatattgaatccagaattcatgagtgttccaaggtgctggagaccacactgtagggctggaggacatgagcgtctctgcacctagctcttcctagtagctgacttgcagcaggagctgaggcttctcctggcatcacctccactacaattctctgtgagcatttccaggaagcagcaccccctaccctagccgaggcccgtccaaggttgtctcgttgtcctagcccgccattgccctgggaggaagtagccacatgagtttatggcctgagtaatgcttttccctcctggatgctccccacatctagaggatatgaaaatagtcttggcaagggtgcctggtctgcgcttgtcagcggcctgagctgtattcagccaccacccttggggtccaggccagatgttatggcaaaaccgtattttaacgagatccttctggtatttcttttggacgccgtccgaggcagcttcattttacgctaaattccatgttatggtgggtcatctcaaacaggtctgcagcgcataaaaatgttctcactgcactctgttttctgtagcaaaatgttgttggaggttaggatgggagttgaggactgggccttgagggtttttttcatataaacacattaaaatggaaagctgatatgaacacgttcagtgatatagactgcaaaggcaaaaagaattctccccagcatatttttttttctttttaccatggatgtaattggagtttacatatgataagaactgcttcttgggcagaaaatgtaatcctctggtgagactaatccatcattgttgaagtgaagggaactggtagtgaattcgccccacagatgaagataggatttctaattccctcgccttttctgtttactgttcctaactccgtgagagtgtgcgtgtgtgtctgtgttttcttcaccatttgatttttcatcccggctcccacttcctcatccttggcctctctcgcatctttatttttatcacaccctccccacctccaccaccttgtcccagcactgagaggaaagtgggcagctttccaggcagctgcagtcctgctggagaaacctttatgatccaggaaatattgactgaggagaagctgtgctgactccgctatgaataaggaggttggaaaactgtcagcatttgcagaaacaaaaggaagtgctacatatacgttttggtttcataatgactgtattgtaaaaccccttctctttagcctactagattggacaagtgtgttaaccagtggctgtttggtatccattgatcatagagctagaccaacaaccaaagttgtttacctctcataaggtggcttttgcaggcgtgccaaaatcatattatgaaactcccagccacaaattctgacatgtattttcacttcctatccaataagggatatccccacccctttactccccgactactgtagtcataaaggtacactcctagttcctccctctctctttctcagcttctcggtccctgtgtgtgataaggtttcttgttgccctgtgtggcatggtgtggcacgccccagcatactcccttccttgggaactgagtaataaattctttcaatggcattagcctctttgtgttgtcactcagtcacctccataaattaaaacccttcaggttttgttggcactgtaaggtaatttattttctctacataggattttagaattgaaagggaccttgtagatcattgaattccacctgtccatgggtcagaaaagggagctggggaaactgttagggggcagatccaggccttggagcacctggttaaatgtgttctccccataagcctaagaaatggtaccaaattcttatgtcattgcatccaatatggtccttccttctttcttctcttctgtttctttcctttgctctcaagactggtgtatcactttgtctcccaggctgaagtaaagtgtgtttgttatattgcagtggttttttattcgtattattatcatcatattgttttttgttgtttttttctggatatttttgatctgtggttggttgatttggtggacgcagaactatcggatatggagagtcaactgtatataaaatcaggtcagcacacttttcctgtagaggagcagatagtaaatatcctcagctttatgagccatgtggtctctgttgcacctactcaactctcccattgtagtgtgaaaatagccatagacaacacatcaactcatgggtgtggttgtatctcaataaaactttatttacacacactggcagtgagccagacttggtctgtgggcctcagtttgcaagcccatgatctaggcaatgcacagatagcagatggtgtccctcagctttggatagctgtaagtattacaagtatgtgagtctgttaaatacttaataaaaattccagttttaatgttacaaattgatacccttggtatttgttttagctgaagatgcaaaaccaactccacagctgcctgagtattaaattctacttttctctgccaaataagcagtatttctaaaggccagtgattgataacttagcagattttgctgatgaatcaggccaacattagctgagcatagtagtacactgtataactcaaatggtttgtgaagtcatttgtgaggggtgtggtttagcagtgtcataattgcaagaaacgcaatacatgtacttggtttgttttaaatgtttatgttgcctagttagatgagacaaattcttatacagactgtttcctctcttgtgagactattacacgttttattccaaatggacaggactttacatggaagatcctaccatcctttataaaatgtcatcctttgtgtaagcctttcagtttatcatgattatactcttttttttctccctgggaataattttacctcatctggttatgctctgttactgtgtgttatgttatctaaggtctatgaccaattgcatgcagagggtggcttgcttttcaatagcaacaaccaagaaccaagcagaaatgtaaggagagtagagctgggggtagtggcctttcagggtgtcaattccccaaccatggtggggttgatgggacaatattggaaacatttttggttgttacaatgggagtgtgctactggcatctagtgggtagaggccgggggtgctgctcaacatcgtacaatgcatgggactgtgtcccccacagcaaggaatgagccagcctaaaagtcagccatgctgtgcttgagaagccctgctgtcaagagattcatcaggaatacgcctcctaagtaggtggcaagcctagcgtcttcaggaatgtctctaggctagcctactggtgacaccaaggacactaacccatcaccctcacacgatctttcatcgaggtaccaccaagctctttgttctcctgccctttaactacttctgcacctgccgcaggggcagtccttggtgcttcgtttatcattgacattctggtctttgttcctacggatgtcttgttgggcagaagagatgtgttcagagatgcgggaaagctgaggaggcacaaggcaccgaagtctcaccactctggcagactgcatatgaatgtgcccattagccctggagtccaagtgggaggggtgagatgctggcaggtgtggaggcaggcattaccttccgcagcaccctggcacctggttctggcaactgtggcctaagaggaagtggtcaagcagcctctagtacatagtccttgggcattgtcttagttagtatgggctataaccaacaccttagactgggtaatttatatacaaccaaagtgtattgctcacagtcctggaggctgggaagtccaagatcaagacgccagcagatttggtgtctggtgaggtcctgtttcacatggatggctccttctgtgtcttcacatggtggaaggtgcaggggagcttgcttgagcctcttttatagggacactgatcccattcacgagagtggatccctcatgatttaattgcttcctgaaggccccaccccttaataccgtcactttggggatttgtctcccacatacaaatctgggggggacacaaacattcagaacgtagcaggcatcttcctgtcccagaatgaatatcagaactagcaaatatcctagcagccatttcatctgacatccttattgttccaacaaggaaagctgggacagcaacctttccactcactgtggtctcctctccatcaaatgtgttgggggtctggctgctgtcccatctatgtgtctcatcagcacctcaaggtactttttatccctatatcacagaggaggaaatgcaggcccagccaaatgaagcgacatgggccaggcaccagtggcagaacgaggacagaacccagccatcctgcctgctgctgacattttctccatccagccctcctgcttgccttcatgagaccacatggccagaaatcagtaagaaaatcttgcaagcaaatggactgaaaaaccattgctctagaggccatgtagagatccattcagagaaatgcagctagtgaaaatttcagcaaataggaggacttctgttaaccatggcatggaatgcacatctcccaggtctttatgaaggtgcctaatttccagtcatgacctaccctctccaaaagaggacccaagctgatgaaagaccttcgaggtacccctgtagaactttatcctgcacatttgtcattgtgcatctgcacaggatattcctttcggcagacgactttcagctctttgcagaagtctcagacgccacatccttagtccatctttactggttcatctctttgttccaagaagacttaattgaatgtggatactgttgtccacacgatctagaaatgaaatctgtgttggagagcataatcatgtagagagataaagttatacagccaaaacatgtactcaacattaaaaacccagatgagagagaaatcaagggcacactccctccgtgggttagactgagctttgcacaccgttctttgtgagttgcctgagctgcacccacgctggctgctgtccagagctgccagtggtctagctgagcagccaggtggaaatggagtctgtgtccatgcagggaattcaagaattttggttcctgtgcttgtgggtgggtcttggagtgtaaagtaaaaagcggaatctcggagtcacatagtctacggttcacagtttagttcagcgtcatatcacatgatccttgggcgggttacctgatgtctccaatgtttgtccttatgtgtgaaacaaaaacagtaccaactccaaacagctgctacaaagactgaggtagtggacagagtgcccaggtttggttgaagatggtaatgtggtcagaatcggctctgtttcacagagcatgtgactgcaagtaccagttctgtggcccagtgctgcttgcgggaatgaatgagtcagagtggatgaatgaaatgtcccaggagcacgagactttccttccacaattgctccatcagccatgaggtttgcttgtcaggtgccgtcatcagcacataatgctgcattctggtgcattcagtagatgtttctagatactgtttcatggtggctaagagtggtttctggcacccaggcttagatctcagccccacccctacaaactgagcaacaggaggctgtcagttaccctcaaaagatctcagagactgattgatcaaggggaaagcggcagtgacagaatgatgctgagaagcttgaagccatttagtaggagccacgtgagtggcccccatcagccgtgagagtcatgatgtctatgagagaggaatcactgtggcccagagtagataaggaagattccatgtagtggatcgtcaagccaagaatgcagtgaggtcccgctttatccattgactggggtttttctcttccacactttgccaaagacctcaatgataaaagcttgcaggtaaaactctgtatagcattggcagagaatagagtcgttggtgaacccaagggtgggttgcttcattttggtaggagtgggtaggagaaaaggaaggtggatagagagaaagcaagttagaaggaaaaggtaaggttgttgtaaacagccttggcttatatcctccaaaaacacaggggcggaggaacccttggggataggggaacctggaagggcgtcctttggaacctaatgtaggcagttatagttctgtaaagaaatatgcaaggctctgtgcaattgattgtaaaattaatagcagctaccctattactctgttagataaatctcaactacacatttgatatgttctttacaacctggcggtggggacagaacagagggtggattgaggaggagggagagtagacagagaaaagtgaagtgtaagaaagcagcaaggagagcacagcgcagagctcgtctcctggaggaacattcccatctggtgagcgttttgtttattgcaaggtcagtttgcatttggataaggcgaggcagaagggcactgatacggaagcagagggaagccggctgccactgcccctcattggctgaatgaaaggcggcggaagaggagcacctgtccagcaaggctgacagtcctgcctcctgggataagcagattctcagcctgcagagtggtctaaccagggaggtagagtggctgctttccgaactccctgcttcctgctcatttgcctcatgcatggaagttgtaaacagtgtgagagttgaaagccacaccatgggaatgccttggtgtccaccccacctgttgccaggaaccgagcactgggggtccatgttcctcacacgagatccccccatgatgtccacctcccaaggatttcaagctcctgtgcaccctcaggccgcctctgcaccaagcaaagtgacccagccctgccaggcggggttgcctgttttaggaaactccctgcagcagcctaggcttgctggcagtgggatgccacctccctctctctccttgatgaagggctgtcgcagcttcctcatcacccccagacctccacatagatgccctgcatcattgccttctttccttgaagcaggcgccatccacaagagcaaggcatggctttctgtgtattcggtcctgacccccttcccaacagcttcattcaagagccttcatccaaagctgatctgaaaacacctttaaattgccaagcatcattgatagcagcttcctagagcggcagtgaaagagatgcactgggggaggagaggaaaagagccagcatcaattagcaaagagaaaattcccagtgttttgagaaaatgactcagtgccacaccagtcagtccaggacggcctcttctccgtcttcagttgttgagttgtgatacacttgccccgcgtgccaggaggactcagggtcagcgtttgctgttccctcatcttgggctgaagaaaggtgccctgtgtgctttcagggggtgacacagagaggcttcagcatgagcttctgcacagtcttacgaaccacggagttttggtggggagcctggagccaaatttgagtaacagaaatgtccaaccggggcatgcagggcaaactattgtctgttctgctttgttcttaataacactgaaacggttctaccatttaagtcccttgtttcatcacataccaatcctggtcttcctgggtctgaagtccctccctctctccctgccctttcccaccttactgaacccaaatcagaagcatccctgggcattctgcagccgtgtctgtccctgcaaattaagtgtgtttgaagtctgcgggccaccttcagatctcaatggctgcacctccctccttcaattcgggtctcactcaacctcagctttcccctcttgccacaggtttttcccactcggctttcacgtttgggattgagagccacatcagccagtccaacatcaatgggacgctagtgcc

SEQ ID NO: 2960 - DNA, 162987 bp, human
ctgcggcgctcggagcctcccttgcgatcccacggccgggactgcccggagtgcatgggcgcgggccagggacgctgagcggtcgcgccatggagggcgccgagccccgcgcgcggcccgagcgcctggccgaggccgagacgcgggcggcggacggcgggcgcctggtggaggtgcagctgagcggcggcgccccgtggggcttcaccctgaagggcggccgcgagcacggcgagccgctggtcatcaccaaggtaaggcggccgcggggcgcgggcgctgacagccgggagctggccgccctgcggggcgcgtcgaggtaggggcgcgggaggggcggtaggctcgcgcccccgggtctggcgcgcgcgtctgctggggtcacctgccgggcctgggcgccgggaccggcgtgggcgtgtgatcctggcggttccccgcgcctcgcagagtttaaatggctcctgcccggagtccctttcccctccccctccctcctccgggcaggggcctggccgggtcctctggcgctcccgggcccgccagtggcggcctgcacctgcggggctgcctggaggccagcgaaggaacgtgtccccgagccgtccccacctatgtttgcctctctggggtccctggttcggcaccccttggacccgtgcctgtgatcactacgaaatccagagtagcagctgtcgccagcgcaacttctcgattcccttcagcccatcaatgtttactgactttcggcttccagtcccagatccactgcgcactggatacctgcgcaaacttagagaaacctgaaagcctgcttcctaagagcaggacccgagttctaataataataaagaaattccagatgtatctcatcaggaatgttgtgtgtgtgtgtgtggtttgctttagaacattgaattttattgtctcaaaacaaaatccatctggaaacttaccagttgaacctgtatgaacttgtaaaagcaaacacataaacaacagtccagtcaccctgtgttctagttaaaagtgtgtagtggtcattttctctgggaagggttgagtcggacctttcgtgtggacgaagttccttttaaaatgtaaagattcttggcgactagaagcgtttgaagataatttactggttttctcggctttcctgcctctccacagcaggaagaaattaagtgattcctaacccgccgcactggtaatcagtttgggaagtgggatggctttgttgttcaaatagcaaatgagacaccagcgtcttccattctatattttctgtcgcttttatgattacaaaactttgtggagggatttggagaagccttgtttagctttgcactaaatttttgttgaactcaggaaagaggttgccattgttataaatttgaccaatgtgtaatcttttatcacactggcttctttggaaacatggtggacagtcataaagtgtgtatactctgcccagccagaacactcctcttttttttttcttttatttcttttcttttctttctttctttcttcttttttttttttgagacagggtcttgttctgtcagcctcctgagtagctgggaccacagatgtgcgccaccatgcctggttaattttttaaaattttttgtagaaacggggagtttcaccattttgcccaggctggtctcgaactcctctgcctcccaaagtcctggcattacaggcatgagccactgcgcttggctcagaatgtggattaatccaagctttgaatcttcctctcccaaaagctactgaaaagtcactggggctcattaaaaaatagctcttctaatcgtttttttttttccacttgtaattaaatagttacatattagagccctggaatactgtacaactcacttgctatttagcagactctgatttggggatagcttgcattaaggtaagagcgcaccttctctttatgataatgagggtatcatttgaaagcctcatgggagtgcgtgtagtagaactgggaggggtgtcaagaacaaggctggttcggtcctggtcttcagatggaattttatcagcccattttatagatgaaacagctgtggcccaggcagggcaaatggtgtatcctgaggtcacaaactgttgagtcctgggaaaggccctaagaatcagactctggccccagtgttcaagcctgctgctccccttcagtcagtgccatctgcttgggtctgggatctcctgcaatgccatattgaataccttcgtcacatcggttaggtgagggtttgccagccttggcattggggactttgtgagctgaatctctttgctgtggggctgccctgtgctttggaggatgctcagcagcctccccagcctctacctgcttgatgctactgtcacctctctccaggtgtgatgacaaaaatgtctccagacattgccaaatgtcctctgggggcaaaattagcctggttttgaatctcttttgttagattaaccatatatcacctttgctcttaaaggattcttgctcttaaaacttctgtttctttttgaatagactggcctttagggtggtgtgtttagaggcctctggcattgccagtgtttgcatggagagctgttttcctcccacgcgttggccctgagaataggctttatttacatagtcaaactcaaacaaatacttgcttcatctgcattttttgtagctggagaaaggaaattgaagcaggaactcccaagtgctgtgttttatgggcatccacagtggctgttcagaatcaggactgactactctctgggtctagtttgaagctaaagggataccaacttcagaggagtagcattcttggaatttggggtgcatgcatgaagcccagcagaacctccgctgacagatggcgacaggattcatcactcctcagtacgtttctgctgatttctgccttgaaattttgctacagttggtggaaaaaatgcactcaaacccatatttccatgctgttgttagagagggggcaggaataacatccatgctgtaggaatctatgtaacggaagtagagatggtggatatatgtgatcctggtgggttttttgcatgtttctgttcccatccattcaaccagtggaagtcttcagtggggggaggggaggggactgatttctaaaatgtcactagagtggcttgaattccacaaagctgtttgggggattcatgaggaagcgttaaatacaccagctgggtgtcagcagccccctgtggcctcaggaatgtttgttaagggagggaaggaatgaagccccagcctctcctgttcactatttcttagagtccgctccctcccccaaaaagaatgccagaagccttagcccgaagctccaaagaagacagtaacttgggcctggcctagccccaagggcagctcctttgggaacccattgattttcgggttgccattgggcaccagagctgttgtgtgcgacaagactgctgtggtctgggacgcttggaggtcccccccacctgactcacccaccccagggcttcagactctgagaacatttctctggattggagacagagctttgaaatgtcctttccagtgtgaatgccaaagacggaatcagggcatattttggggggcgtgcagccaggtggcaagtgtcttatgtaaagtgttagctgagtccttgattgcagagggcacagggctgagactggtggttggtgatgggcaggagtggaggccccgcgcctctgatgtaccttacttattggtttggaaagggggctctgcattatgggccatgccaagtcacctcgtgacccgaggaccggggagatcagagtgaccaccctggtcgggatcagttcttgtctcatatgccattatattggctcccaagagccaaccaagctctttgtgaaatatcagtaaaggttttgaaaaagagggacctgatgaattcagcagtgggtcaggagcgggtgactctcaactttgtggctgctggtggatttttgtgcccagatgcagtgtgcggtcaacatctgcacgagggagtgctgctgcttctccaggtgtctgagaaccagtgggtgagggcttggatctcccttgcctctgccatctctaagtgatgtccgagttgtaaagctttactcactttttgatgccagctaccatgttttcttcagctattaggataagtgtcattataaagatccatctgtatttaagaattaatagtaaggttaaaaaccaagaggtgagctttctttcctgtgctgaaagaccctttcagttggtaggcccgccttgccaactggctttcaagtctatctttattaccttttcccagcctgtgaattaatgtgaccctgctgaattctcatccttgttctccggcgatgttttgggcaagagtgtggagtcaggcagtgagcctcaagtcctattccagggtctgggagctggaggctttgagggtcagctctgggaggattcttcctctcttagacattaactcagcttgactcacgcctatgaatccagagccttctgcgattatgagaagctgtaaacataagctatgcatctcacttctgtaccaggatgcgttcggtcttcatggctcagttatgagtatttcttaacatgtcgtaacatttatcttttgaaaaaaaaaaagaaaagaaaactagtttgcccaagagctaaaggtagaatagtatgataatgaaaggctcagaacaagtagcagttttcaccttgtcctaatgagctgggggtttcttaatctacctttgtaattcatggtcaaaaaaactggcttgccacttgggaagggctggtttttctctttggaaagcattttggagttgtttgtccccttgccagagttgttttgtatcagcatgcaaataaacctggatttgtggccaagttcttaagggcagtggagaaaagctggggctctgtggaacttttcttcttgcacaccgggtgcagcggaaacattctacacgataatgttagaatgtaaaagctgaatggactttttattcaggtcttcttttactttcaagcactgtagtcagcagtggggcaattcatgaaggataaattctgcaggtttctgcaagccctcttcctacacatgcaagccgaaaactttaacccacatgaaggattttgaaagagttctgggttgcctgttgctcttttaggcctttaaaaaaatatcaccagtgccaggcacggtggctcacgcctgtaatcccagcactttgggaggccgaggcgagtgaatcacctgaggtcgggagttcaggaccagcctgaccaacatggagaaaccctgtctctactaaaaatacaaaaaaattagccgggtgtggtggtgcatgcctgtaattccagctactcgggaggctcccgggaggcagaggttgtggtgagctggagatcgtgccattgccctgggcaacaggagcaaaactccatctcgagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaataatcaccagtatctgatacagggagggtgtattctggaggaattgttgtcctttaccttgtgtgatgcagtatttgggctgtcctgtagtagagccagcctgttcccattatgggtgtgaatgttccagcttctctttgggggaacatgtcttagaaggataatactatatcattaaaaagaaaaaattggacaaacctcatttggttgaaccttagaactaggatgttctgaattgcaaagcaaaggtaacatttttttccccagataaggagcccctgggctgtttttttgtgttgtttttttttttgttgttgttgttgttttaaatccccagcgtattaagttgcaggcaatgagggctgcttcttttggatggaaagggaagaaaaacagcatcttggcttggctaggaagggctgggattatctttcttttggcaaaaggtgactttcagatcaaaggcaaattgttgaggtcaacaagaacccaggcagggtagactctgtgtccttgaaaggtaacacttcttactcatagaagggaaggggcaagcatgatagcgtatttttttttttttaagacagattcttgctctgtctcccacactggagtgcagtggcatgatcttggctcactgcaacctccgcctctggggttcaagcaatcctcccacctcagcctggcgttacaggcgcacaccaccacgccctgctaatttttgtatttttagtagagacagggtttcaccatggtagccaggctggtctctaactcctgacctcaagtgaaccacccgccttggcctcccaaagtgctgggattataggcatgagccatcgtgacacgctaggagtgtcagtgtatcttttatgaggttttattttatcaaagtggctcttgcacagtatgaattatcaagtagttcttcaagggtgcttatatgctactggtcatttggcctgactactgatcacttccccctccctagagacaactatcaaaacgtcttagctgatttcttttggtatttctgtccatatccctaaatgatggcttatattgtatattgctgcaacttttgtttattagcttgttcttcccaatgtaggatattaggatgtagccttttttccactctttttttttttttgaaagtctcgtcctgccactcaggccagagtgcaatggcatgatctcggctcactgcaacctccacctctggggttcaagcgatcctcccacctcaccctcccgagtagctgggattacaggctcgagccaccatgcccagctaatttttatatttttagtagagatggggtttcgccatgatggccaggctggtctcaaactcttggcctcaagtgatctgtccacctcagcctcccaaagtgctgagattacaggcatgagccactgcgcctggcccttatttccactctttttcattgctcatctaccctcccccaactactcaggcacaattcttggcccttcatacccctaatgtgattacatcataattttttggtgtggggccatcctgtgaattgtaggatcttgagcagcatacctagcctcttcctttctttttttttttttagacagggtcttgctctcttgctcaagctggagtgcagtgtcatgatcacagctcactgcagcctccatctcctggactcaagtgatccttccccctcagcctcctgagtagctgtgactacaggtgcatgccactatgcccagctaatttttgtattttttgtagagatggggtttcaccgtattgcttgggttgatcctgaactcatggcctcaagtgatcctcccaccttggcctcccaaaatgttgagattacaggcgtgagcaactaaggctggcctcttccccgctctgaggagcatggggttaccaatattcagtgtttattttggttgctattgctatcactgctgagtctgggggtacatactgtggagtcctgataagttagcatcaatgaagaagggaccccagggtgggggagaacaattgttctgagaaactgctaaccacaaacaactctgcgtgtagcttctccagcatgatcctataaaacttccctccagcccctgcctctttgcaaccccttctctgctgtgttgcctgttgctcccttgcaacatactttttctctaataaattagtcttctcttctcttctcttctcttcttttcttttttctgagatgtagtttcgctcttgttgcccaggctggagtgcaatggcgagatctcggctcactgcaacctccgcctcccaggctcaagtgattcttctgcctcagcctcctgagtagctgggattacaggcgcctgccactacgcctggttaattttgtatttttagtagagatggggtttctccatgttggtcaggctggtctcaaaatcccaaccttgggtgatccgcccacctcagcctcccaaagtgctggggattacagacatgagccaccgcgcccagccataaactagtttttctttaactgactactgtctcagtaaattcttttactgcccgtgactctggccccagccagtgtacccacaacacaagtttctgcagtcactagggttcaggatagttttctttgcttaattttcagtgcacttatccttgattcatccctcaaaccctccccagtgatgaaatatctcttaatatattcagacacaccgggggtcatcttttgagatcttctctgtctgaaaacagcatgatttttatcttgacagtaaattgtttgggcgtagtcctgaatggagacagttctcccacagcactctgaaggtggtgtccactctgctgttgtgcagtattgctggagggagatcagacgtttttgtttcttgatcttttgtactaggtctactttttccctctcatttttctttttctttctttctttctttcttttttttttgaagagacagggtcttgctgtgttgctctggctggagagccgtggctattcacaggcacggttatagccacactacagccttgaactcctgtgcttaactgatcctcccatctcagcctcccaagtagttgggtttacaggtgtgtaccactatgcccagctctcttattttgcatttctttgtatttttgttcttcctggaagattttgttcaacatcatcttctaatctttccattaagttttaaatgtatgtcctcatttttccctcagattctaaacttttaaaatttgtttctcaaatgttcctttttcataccatactgatcttgtttcatgattcttccatatctgtgacagtattaaactggtctctaaaaatgtcctctttttgcatagattgtttctgagctctgcttttgttgtttgttttggctgctttcttccctgttagaggttgtcttcaaatgtctagtgctccttggccgtctgctggtattgaaggttgcgttccccaaaatgctgtttggacactccgtgcatgggggtgagtgatcaggtgaagctgtttccctgggtattcctctaaggctgtatctttctctttttttttttctggaggggcagggaggcggccatgtttttgtcagatactttttttctacttaataaacttctggtgtagtacaggttgaaaagtaatgggaagtctgccagttgaggggatctctcctttgctcagctgggcgagggtgatcatctctgccccccaactttggctgtagtggttccagtttggagggaaggttaccactaggcagaggaggcagtgcttgcttgcttgcatccggagctggatcttgctctcagttcctaaccgtttctaatcagtaatcctctgtctgtccaactagaatcattcctattttattgtggtatcatggggattaaatgaggcaacacataaagctatctctagtaaattcaaattccccctcacttctcttcctcactttccctactcaatcctgattcattaagaatttggaactttgggaggccgaggtgggaggattgcttgagcccaggaagtcaagacaagcatgggcaacaaaatgagaccccatctctacaacaaatagaaaaattagccaggcaaggtggtatgtacctccagtcccagctacttgggaggctgaggtgggaggatcgctttgagccaaggaggttgagggtgcagtgagccaagatcacaccactgcactccagcctgggcgacagagtgagactctgtctcaaaaacaaaaaataaataaaaaataaaaataaaataaaaaatacatctaatgcccagcatcagtacatttcctatgttatttgtagcccaccagaagtgattctttcctctcctctaccaaaaaacttttttccagaataatagtgtttcttatttttataatattaataaagggagtagctctttcagatcaatgtggtattcagagtagggtttttatttgtttttttgtttgttttgatatggggtctcgttctgtcattcaggctggagtgcggtggtgtgatcacggttcactgcaacctcagtcacctgggctcaagcagtcttcccacctcagccccccaagtattaggactacaggcacatgccacctcatctggctaattttttgtattttctgtagaggtagggtttcgccatattgcccagggtggtctcgaactcttgggctcaagtgatctacccaccatggctaccgaaagtgctgagattactgatgtgagccactgttcctgggccagagtagggtgttaaaaaagtagttttgggaagtggcaatagtgggaaagatgaagattcagtatccctgtgacaagactctatttcttcactctttcaatctttggagtagaaaatctgttagggtttagagtgggacccacaagtgtggcagaaatgctgcctgcccgagtccttgttgcctcctcctctcagacactgttgggccacatttcccagcctccctagcagttagctgtggcctcctgacgcttctaccctggggagtgcagctgcagccatgcctgccattttacttttccccttctggctgcctggaatgaagatggccgcagggcagagttcatcagcgtggatccctgaatgactgcagaggtggctgcccatgctatggtcaccatccatggtgagcaagaagtaagcctctgctgtgtttgggccattcattgtatgttttttggattacttgctgtaacagactattctcacaaatgaaatgctgggagaaatcagaagttttccttctagcaaatatacccagctttaagaggcggaatatacggtgcttcttttacacccatgctggaaggagtgaggaaagcatcactgtgggtgtccaattagcatgaagcctattccctgcacacttattatataaaatgagacctccacgcccattggcgtctttccacctccttacccttttctctcagctggtaatttattcacccccaccccccacttgctcttccttctcctccccggggatgatttcctgggagccctggagcattggggcaggaggccgggagaatgcccagtctagataattagtcctaggtggggctggccggaggcacagtgggtggggtgggtggccagctgctgttaggatgatttcagggattggaccttcctcctggtggtggtgtcctttctttaactgccttggttaaaatgcaaatgttgcctgggagggctacacattgtcatcattaacagaactgccttcatcagattaattaattatagttctgtatggcagacttttttccccctggtagtagcacccagacacatgaattagaccagcaaagagaggagagataaagttgaaagccagatgaaagccaagtaaaactggcctcgggaggaaggtggagctggcggagtgggagtgctgaggaaagaccttgtctgttcaggtactggccgcctacaaagaggagttaggacagcctgtggaggaagctggtagggagagcaggggcccaagtccagctgaaaaccctccctggacttgcaaaagaggtgaaagagattctttacctatggcttgcagattctgaagctgacgaaattccacatctattggtgttaattgtgcatctgtttgcaaatttgtaaacatggtgatatttatctctgctaattgtataatgctttgtacagtgtcttttttcttgttgcacaattaaaatgaaaaaaattgaaaataaaggaaaagattgatccatagcccaaaacatgtaataatcttatttctgaaagtacagctgtattgatttttccccatctctgtggaattctttgctttgaacctcgtagatctaatttttaattgcttgaaaacccttaagaattacattgtcaacaatctttggaatcagatgaaaggagtttaattgtgtgtatgccacttgacgttttaagaaatggtatgttttgttgtggaatatatttttataatttaggtttttctagacaggcatatttttaaaaaccctaatttctggaaaacggagtgtactttatattggtcaaatatgtcagtctttcaaacaactatgcttttttgtatgtgcagcttttcttaacattttcattatgtttagatgccctgaatcttgaattaaagtttggaaagaaaacatctggacttgaaaagataggcctgctgctgcttcaatcatatttattttgtgttgatttaacgacagagctctcacatgctgatgccattagggtttgggacggagccatttccactccccctcctcatttttagtggctggtgttttggggacaagtaattaaaacttgtaccactattcatggttgtgaaatctcaacacaaaggtaaaattcctgaggatgcacctccttgtaccctgaggcaggaacttgtttgcctttacggagagtttaattcttttttttttttttttttttttttttttgagatggagtctggctctgtcactcaggctggagtgctgtggcatgatcttggctcactgcaacctttgcctccccggttcaagcaattttcgtgtcttaacctcctgagtagctgggattacaggtgcgccaccgcgcccggctaatttttgtatttttagtggagatggggtttcgccatgttggccaggctggtctcgaactcctgacctcaggtgatctgcctgcctcagcctcccaaagtgctgggattacaggtgtgagccaccacgcctggcctgagagtttaatttttaattcttaaattacccattaattaattaccattaattaagaatttttaatttttaaattacccatgttgtaattgcttcactgaaaaaaatgttcaattcctatgaaaactctttatttccccttctttctatttttacagtggcttacactggttcttttcctttgccatctactagaaggttggatttcttgaaggtccttttatctgtcctctctctctcatctaggtggtctcatgtgcttcctcgagataacgtgcatctgtttgcaaatttgtaaacatggtgatatatggtgcctatagacaatgctcatatctatatgtgcagcctcaacttctcttctttttttaattttcaatgaccattttaccaaatcaacttttcgtctgaactctgagatggcccttgtgtgttgctgaggccctttaaactcagcacaatccaaatgggaatcattcatcttcctttaccttctctaattctgaatttctaatcttgatcatcagtttatccccaaatctagaagtcgtccctgatgccttcctccccttaacctcccacagccagttgatcaccaatcctttggagcctaaatacggggtgtgcattgctttcttctcatgcccagcgtcactgcctccagtggtttgctccagtgactgcctgggcaatcacagtagtctgtaacatgcatactgctgctcacctcttcacatgacagactcttgagacctccagtagtcggtgtgccaaaacagtggtctacttctcatgctcttgctggaaaagcctcagtaattcctcatgggacaccttagctaggtatagaaggcttatttattttatgtattattattattattattattatttgagatggagtcatgctctgtcacccaggctggggtgcagtggcgtgatcttggctcactgcaacctccgcttcccaggttcaagtgattctcttgcctcagcctcccaagtagctgggattacaggcacctggcaccatgcctggcaaatttttgtatttttagtagagatggggtttcaccatgttggccaggctggtcttgaactcctgacctcaagtgatccacccgcctcagcctcccaaagtgctgagattacaggcatgagccaccatgtctgtccactttatttttattttatagagatggggttctcatctctgtcacccactggagtgggtggtatgcagtggtgtaatgataaatcactgtaacctcaatctcctgagcgcaagtgattctacccccaacccttgcctcagcctccgagatagctgggactacaggcatgcggcaccatgctcagttaattatttttattttttgtagatacagagtctcactgtgttgcccaggctggtcttgaactctggcctcaagcaatcctcccaccttagaaggctttttatgttttatcgatcctgcctattttccaccctcgtttgccagtaactcttcatgtaacactgtattagtctgttctcacgctgccagacatacccgagactgggtaatttataaaggaaagaggtttaatggactcacagttccatgtggctggggaggcctcaccatcatggcagaagaacaaggaagagcagaaggatgtcttacatggcagcaggcaagagagaatgagagccatgtgaaaaggaaaactccttataaaaccatcagatctcatgagacttattcactaccatgagaacagtatgggggaaactgcccccatgattcaattatctcccaccaggtccctcccataacatatgggaattatgggagctataattgaagatgagatttgggtggggacacaaccaaactgtatccaacactttagctgagtatgaaaagttcttcatgctttagcatctgtcttttccctggcctcatcttctgctgttacccaccttgatccttcagtcctgcattgtctaatatggtggccatttgtcatatgtgactgttgaacagttgaaatgtagctggttcaaattgagatatactgtaaattaaaatatacactggattttagacttagtctgaaacacaaaagatgtaaaatattttaataataatttattatgttggaattataatattttgactacattgggttaagtaactcaaatatattattaaaattaacctggccaggcatggtggctcgtgcatgtaatcctagcacttgggaggccaaggtgggccaatcgcttgagcccaggaattcgagaccaggctgggcaacatggtgaaaccccgtctctacaaaaaaatacaaaaaattagccaggcgttggtgactggcacctgtagtccaagctgcttgagaggctgaggtgggaggatcacctgagcccaggaggttgaggctgcggtgagctgtgattgtgccactacacgccagcctgggtgacagagtaagaaacaccctgtctcaaaaaataaaaattaaaaataaaaataaaattaatttgacatattcctttttactctttgaaatgtagctcctaaccaatttgaaggtagatgtgtggtgctcttagtctgttggacagctccgttttagcctttttttttttctttttttaaaagagatggggtcttaagctatgttgcccaggctggacttgagctcccgggctcaagtgatcttcccacctcggcctcctgatgccattggcactacagtcgtgcctcaccatgcccagctcgctgcagactcttgttaggcaaagtgtggtttttaggtcagcatatccgcatcacctgggagctcgttagaactgcagaatctcagcccctgccccatacctgctgaatcagaacccatattttaacaacgtgattcagtcacatggtaaaaagtttgctgagtgctgctttagagaatgatttgctggtctcccagcatcctctgttatttgaggctttgcagaggttctgagacattcacagttttgtggaaggctttgctcagaatacatcacccaggcgaagtggccctaactgtccatccccagtcatgtggaatgccctcggtggccctctgtaatcattggtcttgcagcatcctcaagcctacttgacccgggaggtccctgagagtggggactggctctgtttcattgctggtatcgcgggcatattgcctggcatgtaatagatcctcaaatattaaagtcctttaaacacagcttacacgtagccttgagatgggatgaacgactgcacattgttacactgttctgagcaccgttaggtcctttgtccccttcctttttatgaggaccatctaagacaaggtaacttgggctgagagtgatctgtctggatcatgcaggtcgtacatggagtcaggatccctgaagtctccatctgggtgacatcacagctgcagatttctttttttttttttttttaaatgaaacagcatcttgctgtgtcacccaggctggagtgcagtggcgtgatcacagttccctgcagccttgacctcctgggctcaagcaatcctcctgccttagccccctgagtagctgggaccacaggcacacaccaccccaacttctgacttggttttttgtttttttttttttgtggagatgggggtcttactatgttgcccaggttggtcttgaactcctgagctcaagcagtcctcctgcctcagcctcccaaagtgctgggattacagttgggagccaccacccctggtagcatcccagctctttctccctctttacctccttgctaaacaagacactcaagcctatcttactgtgtaagccacatgagccatacaaagacttcttaaaaataattttttaaaaatttgtaggctgaaaagattttagatttttttttctaaaacagaaatgcacacagcagccttgctttgcggtaacccttggttccatgggtatgggactggctcaggtgccagaggctgggtggagaggcaggcctccatgctgtctctttggtgcctgcccccaggactccagagaagggtgcccggcgcttttcccacccgatggtgctccgtgcctcctgtcaggaagaaagcagaactgactgccacacactaccagattcaggagcctctcctgtcttcctgggaaggtggttttgatgaggtactgatgaacttgggcctggtttttacaaaatgaacatagccatcagttgtgacattgcacacagccaactcttaggaggggccgccatcacagaccacctccggacacagaagtcaggattttagggttttctcctgtgcatgcagtatactccatgggcatacaagggaaaagcagtgctggtgagaatctgccagcactgttgggcagcacgggttctcgacaggtattgttttatgtgcgtgtggtggatataaggaccaccaaccagtctcgataacaaatctagccgtttaaacatccacagacattttaacggtcctaatctgtggtcactcacagtgtctggccttgggaagatggactgggtgggttaaggaaggcccactgggttaactagatcgtgcccgggttgggaggatggcacgttaaattctgtggtgtctgatgtctctttctgttagctccccgtcttcctttgacaactccccagtggatgaggtctttggagaggtggaggctgaaggagcatggctcatggtgcagcaggaggtggtgtgtgacttaacactccttcccaggactctgagtctcaagcagggcaaggctgggtgcagtcagctctgtggcctgctgtggctgatgggccggggcccagagacaacagcttggatgcaacggtctacaagcccagcctccccaggctccttgtctctggctcatttctgaccctttacctaagactttcaacaatccttacattcctggtagcatcttagtgaatcaccctttcgcttagatataggaattcatttccgttgcttgcaaccaagaaaaccatagcctgaaacagcctagtaggaagcctgcagacctgagatcagtgggaccttaccactttgttatttgtggccctctggaaacgtgccatctgacccactgcaaggaagagtctctgcttcagaaggtcagaggagcggcatcctgagactggctgtggtgagctggtgggtgcagctgtctcctgcacactgacctgggtggctgtccccagacctctgaaaattgggaggaaccagggtttccttttactttaccctcaccagcactgcccagtctggagccctggagggtggaacgttgtaggaatgactcctgggctctgtagaacccctactgtatgccagcagctttgcattatgccgtgagttcctgggctctgggaactgctgttgtcccgtgtcaccaagtcacatggcattggagtggtgcagtcagaatccacatagcagccaggcacagtggctcatatctgtaatcccagcactttgggaggctgaggtgggtggatcatttgaggtcaggagttcgagacgagcttgcttggccaacatggtgagaccctcatgtctactaaaaaaaaaaaaaatacaaaagttagccaggagtggtggtgtgtgcctgtaatctcactccggaggctgaggtagaagaattgcttgaacctgggagacggaggttgcagtgagccgagatcgcaccactgctctccagcctgggcgacagagcgagactgtctcaaaaaataaaaaataaaaaaataaaagaatccaagtagcatctgccaaatctccactgtgctccaggcactgttcaactttatgtgaacttcacagtggttctgtggggtaggtttatacagttgttattggtgctatgatctgaatatttctgtccccccaaaattccggtgttgaaatcctaacccacaaggtgatggtattaggaggtgggggccgggtgtggtggctcacgcctgtaatcccactttgtggggctgaggtgggcagatcacttgaggtcaggagtttgagaccagcctggccaacatggtgaaaccctgtctctactaaagattaaaaaattagccgggcatggttggcaagtgcctgtaatcccagctgctcgggaggctgaggcagaatgtagggctgatactggagttgggtcttctatagcggagggaagtcagggatggaggccaagatgggctgattttcctgctgctgctaaaaggaaaccaattaatgggagaagacttgagttgggacttaaggagagtatctgttgtggttctcacgagttggagtggcatcgcttgaacctgggaggcggaggttgcagtgagctgagatcacgccgttgcactccagcctgggtgacagagtgaaactgtgtctcaaaaaaaaaaaaaaaacaaaaacaagaggtggggtctttgggaggtgattaggaatggggtcagtgcccttataaaagagactcaggtagttcttcctcccttccatcctgtgaggacacagtgagaaggcgcctcctacaaaccaggaagtaggtccacagcagacactgaatccgccatgtcttgaccttggactcccagcctccagagctatgagcaatacatttctgctgtttttgagcctcctagcctgtggtgttttgttacagcatcttgaactaagacagttagtgaggagcgttaggcttagagaggttgagaaacctgcccgtggttatggcagggccagtctcttcactcgcacagcaggcacatcgctggggcccatgaacatgttctagttttcacaagaagaaaatgaacttttaggtccccaaaaatgtttcgagataacatttcaatatttaatgatttactatataatattaatatatataaaataatcaaatacatcaagttaaacagattaattgaaatacattaatgatctagattgtgtgtatatatatatgtatgtatatatatgtgtatatatatgtgtgtgtatatatatatatatctgtctccttgtgccagcacaatcatcacatgcaactttaatcctttttttttttttttgagacagagtctcactctgtcgcccaggctggagtgcagtggcactatccgggctcactgcaacctccagtgtatatatatgtgtgtgtatatatatatatctgtctccttgtgccagcacaatcatcacatgcaactttaatccttttttttttttttgagacagagtctcactctgtcgcccaggctggagtgcagtggcactatccgggctcactgcaacctccacctcccgggttcaagcaattctcatgcttcagcctcccaagtagctgggattacaagcctgcgccaccatacctggctaatttttgtatttttagtcgagctgggctttcaccatgttagccaggctgttctccaactcctgggctcaaggtatcctcctgcattggcctcccaaagtgctgggattacaggcgtgagccaccacgcctggcccaactttaatccttttttatggagatggggtctagggaaggcctgccgggccctgggtcgcagctggcaagtgaaggggttgggttcccacccattctgtctggattcaggagcctcatgaaggtccctgcctcgagtatgtctgagcctggatgatcccccagcagggtcacagccagccccgtcgccatgcctagcgcataacagatgctcagtagatgtttggtaggtgcaggaaagccagcctgtgaaagggcgctcatccttcctgcattcaagcatcaagcctggtcattctgctgctttgtttcaggcgtgcgagtttgggggcaaatgtcagagtgtccccaggagcaagcaggttgcacagggggctgtttccatgagcctgggctgaggggacctgttgggaggccggcagccctgggagacaggaacaggcttcaggtgtttctaaggatcaaggccttggcgtattgcaaagacattacaaaatcaggcttccagaggcctcatagcaacaggcgtgtcacatagcctgtgctgtgccacggaaataaaacccgagttcaggactgcatgctgcctgctggtctaggccgtaaaaaaagctgtccatgccccaacaaaaaagtaaagcagagaaattagactcctgagattaatttgcttttctttcctgttttccacattgcttgtagcaaggtgatgcttttctgtgaaaaggcatttctcactgtctaaagggagcccttctgtgatcctccctgagagcagcccttctgagtgtcctttcctgcccgccctaggctgccaggctcctgctgctaacttgactgcttctgaagtctctttttaaggttcaatgtcaaggggaggtcagagaggggcgtggttcagcaggaaaagaggaagagagcctgacttgtgaccatcctgggtgccaggcacacctgagcacatgcagccccgagcttttggcctggacaagcccaggcctggcaccgcagggagaactggtctgtggattgtctccacagcctgatttcctcccagactttgccccgcttggagcattccgatctccggtgtttgagggtttcatccagtaaatacggtagtacttcaccctctcagattaaaggtgtgctgtgcagcctgggagttcctttacttgggggtggtcggggaggctgaaggaagccttcctgcacttcttttttcttgagttttttaattattaaaaatggagactgtgcgctgtggctcacacctgtaatcccagtgctttgggaggatcactggagcccaggagttcgagaccagactgggcaatatagtgagactctgtctctacaaaaaaaaaaaaaaaaattagccaggtgtggtggtgcacacctatagtcccacctacttgggagcctgaggctggaggatttggcttgagtcagagagttggaggctgcagtgagctatcattacggcactgtactccagcctaggtgacagagtgagaccctgtctcaaaaaatttttttaaaataagtggatataatggttgggcgcagtggttcacgcctgtaatcccagcactttgggaggccaaggtgggtggatcacctgaggtcaggagttcgagaccagcctggccaacgtggtgaaaccctgtctccactaaaaatacaaaaattagccaggcgtggtatcaggcgcctataatcccagctactcgggaggctgaggcaagagaatcgcttgaacctgggaagcggaggttgcagtgagccaagttcgcgccattgcactccagcctgggggacaagagtgaacttcgtctcaaaaaaaaaataataaaaataaatggatgtaattcacatgtcacaaaattcgccatgttaaagggtacagtttagtggtattttttctgtatattcactgacttgtgcaatcatcactttaattccagaacatttttatcaccccaaaaaagaatccctacatccattagtactccctcccctttccctcccttcccccaaatcccacccccacactgatctgctttctcttattagtcagggttctctagagagacagaactaataggaaatatatatgaagaggagtttattaagtattaactcacatgatcacaatgtcccacagtaggccatctgcaagctgaggagcaaggagagccagtccgagtcccaaaactgaagaacctggagtctgatgtttgaggccaggaagcatccagcacgggagaaagatgtaggctagaccagtctctccttttcacgcctttttgtctgctttagattagatggtgcccaccagattgagggcagatctgccttccccagcccactgactcaaatgttaatctcttttggcaacaccctcacagacacacccaggatcaatacttggtattcttcaatccaatcaagttgacactcagtattaaccatcacaagtccaccccttgtcaatgtgagatcgtacataatcttcaagtaaagacaatggtaaggtcataattacgcctaacatgcaactatcctttgtataaccagaaatgcatcattccccaacccaaatactattacataaagctgataatacttaaatgctgatatgaagtcaataaatctttttttgagacagagtctcgctctgttgcccaggctggagtgcagtggcacgatctcagctcactgcaacctctgcctcctgggttcaagcgattctcctgcctcagcctcccgagtagctgggactacaggcgtgcaccacgatgccagccaatttttttgtgtgtgtgtttttagtagagacggggtttcaccatgttttccaggctggtctcgaactcctgacctcaagtgatccacctgccttggcctcccaaagtgctgggattacaggcgtgagtcactgcgcccagcctgaagtcaataaatcttatgtcacacgataagggaaaagaaaagaaaataaagatattttcctagcactagtacaagtgtatacatgcgcaaacatggttttagcaaaaggaggaggaaatactcatgacaattgcagtccccatgtctgcagctggtcacatggttgtagctggtactgatgactaccctcttctactacccattctgtattccctttgccttcagcaagcaccttagctggttgtgtgtttttttttgcctggtggagtgacccaaaccttcattcctgaagggtctgggtcatttgtagtccggcctggattgggctgttgtagtgtccccttgaccttaatcacagggcatggtaatactaagagacgccctaatgggtctcctgtattgcatgcatactcttccctagttccattgcggagtagtagactgattttatctgatagtctgggtcagtcaccccagccaacactgtaactcccttcttagcctgttgacttaaaggtaggaggagcccaaagcacccaggtggcaatctgaacttccagtttaatggaatcattgttgtgtctcctggtggcagcgttcctccctctggaactaagaccccctaggccagcagaacgtaatgttgcaggaacaggaagcaaaaattttgctagtggatcactaggggtgatggtgagttttgccacttctacttgcaccccttgatttctggactcgtgaatcctggctatgggagaaacagtaccatatattgggcgctgattcagagcatacatggccttctgaagaactttgccccagccctgcaaagtattgtcacctaattggtgttataattgtgacttcaaaaggccattccaccgttctattaatccagctgcttcaggatgaaggggaacatggtaagaccagtgaattccatgagcatgaacccactgccacacttctttagctatgaaatgagtgccttagaggcgatgctgtgtggaataccatgatggtggataaggcattccgtgagtccacagatggtagtcttggcagaagcatcgcgtgcaggataggcaaacccatatctggagtaagtgtctattccagtgaggacaaccctctgcccttgccatgatggaagaggtccagtataatcaacctgccaccaggtagctggctgatcaccctgaggaatggtgccatatcaagggctcagtgttggtctctgctgctggcaaattgggtacccagcagtggccatagccaggtcagccttggtgagtggaagtccatgttgctgagtccatgtgtaacctccgtccctgccaccatggccactttgttcatgggcccattgggcgatgacgggtggctgggaaaagaggctgagtggtgtccacagaaagggtcatcctatccagttgattattaaaatcctactctactgaggtcacctgttggtgagcactcacatgggatacaaatatcttcacagtttttgaccactcagagaggtccatccacatacctcatccccgaatttctttgtcaccaattttccaatcatgcttcttcccgtgaattcagcccatgaatcagtatataatcacacatctggccatttctctgtccatgcaaagtgcacaaccaggtgcactgctccaagttctgcccactggaaagatttcccttcaccgctgtccttcggggtgtcgtagaaaggggctgtagtggtgccactctctattttggggtggtgtctgcatatcatgcagaactgtctgtgaaccagaccctagtcttctcttcctctgtcagctgatcatagggaactccccatgagactattggtgcaggctgggggagagaagacagggtggcagagtggagaccatgggcatttgagccatttcctcatgtaacttacttgtgccttcaggacctgcttgagcccgatcacgtatataccacttccatttgatgatggaatgctgctgtgcacacccagctttatggctagatgggccagaaagcatccagttcatgataggtagttcaggtcgcatggtgacttgatgacccatagtcaaatgttcagtttctgccaaagcccagtaacaggccaagagctttatctcaaaaggagagtagttgtctgcagaagatggcagggccttgctccaaaatcctagaggcctccactgtgattcacttatgggggcctgccaaaggctccaaacagcatccttatctgccactctcacctcaggcaccattggatcatacggcccaagtggcagagcagcttgcacagcagcctggacctgttgcagagccttctccagttctggaccccattcaaaactggcagcctttcgggtcactcgataaatgggttggagtaacacacccaaatgaggtgttgcctccaaaatccaaataggcccactaagcgttgttgtgcctctttcttgcttgtaggagaggccaaatgcagcaacttattcttcaccttggaatatctcgacaggccccataccattggacccctagaaattttactgaggtagaaggtccgtgaattttagtcagatttatttcccatcctctggcacgcaaatgtctcaccaataagtccagtgtgtttgctacttcttgttcactggatccaattggtataatatcatcaatgcagtggaccagtgtgatgtcttagggaagcgaaaagcaatcaaggtctctctgaacaagattatgacacaaagctggagaggtgatataccactgaggtaggacagtaaaggtatattgctgctgaagacaaattgcttctggtgggccttgtggacaggaatggagaaaaaggcatttgccaagtcaatggccgcataccaggtaccaggagatgtgttagtttgctcaagcagtgaaaccacatctggtacagcagctgcaactgaaatcaccacttggtgaagcttacgataatccagtgtcattctccaagatccatctgtcttctgcacgggctaaatgggagagttgaacggggatgtggtgggaatcaccacccgtgtgtctttcaagtccttgatggtgacattaatttctgcaatccttctggggatgtgacattgtttttgatttactctttttctaggtagaggcagctctaatggcttccactgggcctttcccaccatagtagccctcgccctaccagtcagggagccaatgtgggggttctgccagctgctgagtatgtctatgccaattatgcattctggcactggggaaatgaccacaggatgagtctggggacccactgtaagtcggacctgagctaaaactccattaattaccatacctccataagcccctacttcaactggaggaccacagtgacgttttggctcccttggaatcaacgtcagctcagagccagtgtccagtagtccccaaaatgtctgatcatttccctttccccaatgcacagttaccctggctaaagtccagaggtctcattggggaaggatgggagaaagagtcaccacataaattgttcgtaatgtagtggggtccttcctcaaggggacctggcctcctcttcattcaagggattctgggtctgtaaactggctcaagtctggaaattgattgaggggctgtgattctctgtttttataattcaaattagtcttttgtccattcgacccagaagttttctgcttatataaattcagtaggaaggcagtaggcttcctatcgatttcccttctaggaacaccatgattaattagccagtgccagagctgtacacgagtcagactattctgattgccgctttgcctctgctgtccattatggtagctacgcacaccttgcctttgacggttgagtgtcatcacttggctcctgccacctcgggatccaattattcccatcatatttaaattttgtagttgcgtgactgcagttcccaccattagatctgacatacagggaagaacaattacagggctcttcaaagatgcaggtgctgccctcacgaatctattttgcaaggcattggttaagggtatgtcttctggaccctcccagctgggatgagtaggtctaaagtggctaatccactccaccatcccaatctccctaagcctttggatcccttcctctacattaaaccaagggagatcaggcatttccagctcactcccagtgggccatcttttaatccatagttcagctaaccaagcaaataaactcttagaacctttttttaactccccagctgcaacattaaaagcagagtccctacttagtgggcccaaatcaataaattcagcctgatccaactctgtgttctttccaccattatcccatacccttaatatctattcccatgcctgttctccaagatttctgtttatatcaattatagaactcaaatggttcttttcgagtgtagcgcacctcctcatgggtcacattctcaacctcacctctaggggcctgctgggactttagtgataggtctagaagcaaacaggggtgtcgggggtggctcctgagaagaatcaacatattttgcctggcaattgcctcaggggaggccatcactgttgcctcaggcagcacagggtttatctcctcagacaaaggtggaaaggctgatggcagccatgggtcagggaagggatgttgccattacaggggatggggaagctgttccttctggcaaaaaaggttcatcggagtttacaaactcagtgtccccagcttcatcagggttctccctcaccgtccccattccaagttgcagggtcctattcttttcgaatcaatgccctcactttaacagtagacacctggcgaggctgtgcatgcatctttcattgaaggtcagcccctcgcatgataagagcatgtgtctgtttttccacaatttcagctctttctctacaggagataagactctcactcagggcaatcttagcagatttgaggctcagtatctgcttttgaagccgggagacagaatccccaagttcatcattttctttcatcactttgcccactgaacttaggagcaaccaaccaacttcattatattccttggttttccacatatggtcaaaggtattatgtatagagtcactaaactccttgcctctcatgagcagtgaatcaggagtgtcaaatgcatttattttgcataactctctaaatggtttatgccaaggactatcagtgttctccatactatgagaagtggagtccttagcattttggagtctaatcatattaagcaggcaactccagaaacctcaacccacaaaagaacttcatccttaatattctgttcctctagaaccactctttgtaccaaaatctgtattagggttctctagagtgacagaactaataggatagatatacatattatgtgtgtgtgtgtgtgtgtgtgtgtgtgtgtgtgtgtgtgtgtgtgtatataatatctcctatatatctcatatgtatatatcatatatagagatccattatatatatatatcctatatctatcctatatctatatcctatatctatatctatatctatatctatatctataaaggggagtttattaagtattacatcccacaatcacaaggtcccacagtaggccatctgcaagctgaggagcaaggagagctggtccgagtcccaaaactgaagaacttggagtctgatgttcgagggcagaagcatccagcatgggagaaagatgtaggctgggaggctagaccagtctctccttttcacgtctttctgtctgcttaatatttgctgacagctgattagattgtgcccaccagattaagggtggatctgccttccccagcccactgactcaaatgtaatctcttttggcaacaccctcacagacacacccaggatcagtagtttgtatccttcgatccagtcaagttgacactcagtattaaccatcacagttactatgtacggatttgcctattctggacatttcatgtcagtgggatcgtagaatatgtggtcatttgtgtctggtttatctcagtataatgtttggagattcatccatgttgtagtgtgtatcagtcattccttttcatgtctgaatgctattgtcctatgggaatggactgcgttttgttcatatcctttgatggacatgtgggtggttctcctttgtgattcttgtaaataatgctgctgtgtggacaagttttcaattctcctgagtattttccttgtgtttcaagctttttaacctcagtgccccaggcatagcgcttgtgatttcctgagcacatgggtggcgcatccctgatgaatcaaaagaataggattggtcattttggcttcacggctgttgaagcaaaattaaaactcacaatttcaaaggtcataggatttttgtcctgaccccggtgggtgtgggcccctgcagggctccgacagaggtggtcagcatgtctgctgagccttcaggaagacatgcctggtcaccggcatccttgtggtccttgtggtggcagtttgtggttagctcagccttaccccctgctgctgctgctgctgctgctgctgctgctactttctgagcaggagcatgggagtctttcaccctccctgcgaagtggacatggggttgattctggggttcagacagcgagcggggtccctgtagcccaagggtgatagtgctcgggacggtgtccccccttagacatgagctgctctcttgtcatttcccactccttcacttcccagcaacaacacagcttcagaccaaaatcaaaaccttcacctcttcatcatttctggttatatttcagaaacccgtgctatagggggatccctcaacaaacttaaattttccagatttaggggacattggcagtatcttcatcataacattgtagggtttgtaaggttttctgttgaatatttttctttttcttttttttaagagacgttgtcctgctctgttgcccaagctggagtgcagtggtgtgaccttgcctcactgcagccttcaattcctgggctcaagtgatcctcctacctcagcctcctgagtaggtgggactacaggcacccgtcacccatgcccagctaatttctgtattttttgtagagacaggatttcacgatgttggccaggctggtctcaaacccctgacctcaagtgatccacccacctcggcctcccaaagtgctgagattataggtgtgagccaccacacccaacctccctctaactttttttttttttttcagtatgtctaaacattttggaattgtaatttaaatcataagggcaaaagctgaaaattaatgcttaggtttactagtaagtgcacccttccctgtttcccccaaataaaatcagtttattttttaattgtaccccaaagcaagttctctcagtacgaagcaactactgcgtacacacaaaatggttgttaatgtaataacttccctggctcacccaacgtgcagtgcacacgacttcaaagactacaatttagggcaagtatacatgaaatgagaaaacaactctctaagtttcaaaacctgctgttaaattatttctaggacactcaggtcatatttacttctcagtaggatgttgcactgtcatttggttatcagtctacctcgcagtgtacattaccagatgccaattggagggactagagataaaacttatgtagtactatttcttaatgggctgaataaggtaattacaaataagtttgccttacatcctgttgaagacctctttacagcctcagtacctaacaatatctagcagcctccaagaatgctcatcaggtgaaacgatgatgtaacatttgaaaatggagccagatacttcagcttaagtcattcagagccaaatatctgaagaatggccaaaatcaaatctttatttttataactgtataaatgtgatccaaatgtgtccaccaccagtttttcaaaaagaaacatgctataaataagcaaactacatctgctcactgatgtgtgtatggactccctggatgtctcattgagcttaattacagaccactcacagtaatggatttttagtgtatagtgtagcttgatgttaagccattttagcttttgcgcatacatgttgtgctggctggtaacggagaagaatttgcagcattacaatgttaagctaggttgtatccatcccattaaatggcatcaatatcaatgtcatcatccttgttgttggactttacagtttcaactttaggtacactggcagtcttctaatacaccacctcaatgttctcatcttcatcttcttcaccaccagaagattcttcctctgcctccattttataaatggttctactttgacacgaatctctttggcaggttcttttgagacatgtttcttaaaggcctttttccgaccagctgatgacgacctcttcttctaaaaaatctacatcatacatctccttcaagatatttggaatcttagagataagctgagcttggtgcattgctaccccacacgtaaagccatgaagaaggtaccattgagcttttttgttgttgtgacaaaatcataagaaatggtgcctgtatttcttatgtgttctctaatctcctctttaaaaagaacttcagtcagaacaagagggcccatggctttaacatccagtccttctgcttcagtaacaatttctttgtcacataaatcaatgataccctcttctttctttttcttcacaaaatcaaacaggatgttggcccgctcctcaactgttttttccaaatcatcatggagtatcagaacttttgcatgatcactgatttcatccattctgcacctttgagcttcctcagttgtatcttccccccagtcatcctcctcttcttccactgtatgtggaggagggctaatttctttggtggtggtgtctcactgctggatacggagccattttccttgtctttgccctttatatttttcttttccttttctttctttcctgtaccactgtcactattctcaggtgggtttttgagaatgaatgtgcagagtttatgatgtgtgtcaagcatgcctcgatagccacaggctttataagaattacctattgtttgctgctttggcttgacatgcatatctgtttcaggattctcacattcaggacagagaacaaattttttaatgagtccatccaatatgtcttgcagcttattggcctcctgagatccattcacaatgtaacaatgtatcccaccaaaatacttggtgggataccttggaggccaattaagcgcctttgcagtgtcagtcatgttgactataactgtcttgattccatttcctttgccctcaaccttggcaatcagacagggcatcttgtaatagaactggtctgatatgctggggttgacgttgacagacattttggcttattggtggctttatcaataagatgaagagatctttgattgcagcttttttatatcttctgtctggagaagaagggatgacataaacaactgcaaaagttctcggtctctaatgtgaaaacattttcaccactgaggctgtaagcgtcttgcttgtatgctatgtttccccaatacaggtactaatggctgcgcaaaagctcttctggtgaaggcctccctgctctcccacgcttgaaaagcgctgtccttcatgcttccctgtcaccttgctcctagcaggcatcacgtcgagtccaccctgccagtttatctttttttttttttttttttcttgagagggagtctcgctctgttgcccaggctggattgcagtggcgtgatcttggctcactgcaacttccgccacctgggttcaagcgattctcctgcctcagcctcctgagtagctgggactacaggcacctgccaccacacccagctaatttttttaatttttatttttagtagagatggggtttcactatgttgtccaggctggtcttgaactcctgacctcaagtgatctgcctgcctaggcctcccaaagtgttgggattacaggcatgagccaccgtgcctggctccctccacctttaaaattttttttttttttcagattatgtttttcgagcctcaagatttattttattgcagtattttttttttttttgtaaatatgaagagttgtccagtagagtctcatcatatgtcgactgaagctggcaccatcctatggcccacagaggcttctgtaactgggtcttcaacatgtggccctccctccatcctttcccaccctctttgctccagccacagccagcttccagcttctagaagcagcctgcattcctcccccacccttttttaaatagagtcttgctctgtcacccaggctggagtgcagtggtacaatcatagctcactgcagtcttgaattcccgggcttaagcaatcctcccacctcagccctcccaagtagctgggactacaggtgcaccaccgtgccctgctaattaaaaaggttttttttagagatgagttctcaccatgttgcccaggctggtctcaaactcctgggctcaagtgatcctcctgccttggtctcccaaattgctaggattactggtgtgtgccactgtacctggccttcctttttcttttgaaaaaatccttaggttttaataaaattccacgtcctccattctctgaaatctgtatgaagtaccagaagtctcaatttgacaatagacatggtcaggatatttctaatgtttggatgatcctctgcaaactagaggccagcagacttctgtaaagggccagagagtaaatatttttggctctgtgggccaaattactcctctgtgctgtatagcatgaacgctgctgtagacagtatgtaaatgaaaggattgtgtgccaataaatctttatttacaaaagcaggcattgagcagtaattggcatcctggctggggcttgctgtccttggtaagcagtggttttcaaagtatggttcccagaccagcagcatcagtatcccctgggaacttggtagggatgaaaattcttggaccccactctagacctaccgaaccccaaaccagaagttaggaatcatctgggtgatgctaatgctggctccacacagcagagcagttctctgtacaactgctctacagagatgtggcctgtctgccatttgtattctaattagcatgtgcaaaacctcggaatcacggttgctgggacccagggacctgaattttaacaactggctcagatggttttatacacactgaaatcggaaccagtttctaaagcagcacttctctgaaccagtagaggacgtgggggaggcgtcagggaagtttttcaaactacagcctgagcttgcttggggtactttgcaagaaggagggggtaaatgtggaaaatgggagcagttgtggctttttgttagcttattgtgaactctgcccctggtacctggtctgggaaggtggatttatttcttttctcctacatgtaatgcgtgttttgaaacccaggaatttctgaaattttaaagcctgttggttgtaataaatattgcaccccaccacatttgctaccacatttgcgaacttttatttagtatttgaagtgaaaacgggttgagaaatataccgtatgatccattggtatcaaatatcttgaatatgcaaatgcttcaaatgcttgaatatgcaaaggcagcaaaatggtggttaccggggcggagtgcagaggggagggtctgccagcaggcgtggggtttctgttggggtgatgaaaatgttctggacttagagagtggtggttgcacaactctgtgaatatactaaaaaccctttgattctatactgtaaagaggtaaattttatcgtatgtgagttatactcaagaaagcagttatttaaaaaaaggaaatgggtcgaggtgtgtgttcagccttattcttgaattgtagagacctcactgagaggaggctgaccctgaaggcccctgttagagcccatcctggggcagttcttcagtggccctgaattcgtgtcacagggatcatcactaagctgtgatttttggtgctggatctgacccaggagcagacaggcctgggaaagagtgtgtgttgtttaaggagcctcacctctgagtgggtgaaccccgattgagggagaaactcacatggtgttcctccagggcatgtagctggaaggccccctgggctgaggagctagtggcagcctgcaggttaggggaaggggggaggaggctgcagtgggggaggtgggcaggagccagggccttgctccagggcagtgggagccatggaagacttttaagcagggtgtggtggcaaagaccacttgtaatagaagggcaaatgggtacaggagttacagggaggaattaggaagccttgtcctaccagcagtgatagagaaaagttaagggatgcgagtggtaccaccacggcacagtatccgcatctggtgcagggatggagaatcctggtgcctgaacacacgtgtgcatctgtgcatgactgcttgcctctccctccctccatcccatctgcctgggggaggcgagggctgagcagggatcagtcctgggagtcctggctcctggatctgtgctcagtgccacgcaggtggcagctccagaaagctctgcggagggaatggccaaatctggtgcagaccagctcctctctgcccaggtgtggctaggctgcttcaacatgcttgcttagtgccaggaggaggaggaggagtgctcagtgcctccgggcaggagcggacctccctggggctctgtcccttctctgaggactcccagcaaacactggcagcgggggtcttcaatgcactgtcctaactgcttgggcaggaaatgaagcaatttgttggaaaaactcaattttgagaataagaataataattcttcttcttcttcttcttcttcttcttctccttctccttctcctcctcctcctcctcctcctcctcctcctcctcctcctcctcctcccttctcccttctcctcctccttctcccttctccttctccttctcccttctccttctcccttctccttctccttcttccttcttcttcttttcttcttcttcttcttctcctcctcctcctccttctcctcttcctcctcctcctcctcctcctcctccttcttctcttcttcttcttcatatttttagagacagggtctcactcttgctcaaactggagtacagtggcatgatcattggtcactgcagccttaaactcccaggcttaagctatcctcctgcctcagcctcccaagtagctgggactaaaggcttgtgtcaccatgcctggctaatttttcgatttttagtagagacaaggtcttgctatgttgcccaggctggtgtggaactcctggcctcaagtgatcttgtctctgccaatttcatgttattcttaaacataagattttatttgaatggtcaccataaatagatcttatttttgtagttatgtcttcactgcatgtaaaattgtatagtgtgctaggaaaacagaatcaggtagtagttacttctcccaggaagaggcaggatctatacgaagtcatttttgctttttgctttgtttttggtaataatcatggaattatgctccagatttacatggagaaacaacattttttttcttttttcttttttcttttttctttttttttttttgagacagggtcttgctcgtttgcccaggttggaatgcagtggcgcaatcacagctcactgcaacctccacctcccaggctcaagtgatcctcccacctcagcctgctgaggagctgggactataggcatgtactaccaagcccagctaattttaaaattttttgtagagacaaggttttgccatgtttcccaggctggtctcctgggctcaaagtatcctcctgccttggccttccaaagtgctgggattacaggcgtgagccactgcagcgtcccaagaaataacatttgggtatgaagtgaatgaggctcgtttacattccaggttttcccccaaatctttttagtttaaacaacagcttaaaaattaaggtcggccgggtgctatggctcacacctgtaatcccagcactttgggaggccagggtgggtggatcacctgaggtcaggagttcgagaccagcctggccaacatggagaaacctcgcctctactaaaaatacaaaaaaaaaaaagctgggcgtggtggcaaatgcctataatcccagctactcaggaggctgaggcaggagaaactcttgaacctgggaggcggaggttgcagtgagcggagatcgcaccattgcactccagcctgggagacaagagccgaaactccgtctcaaaaataaataaataaatagaataaaatacaataaaagatcatggatttctagtaagagaagagaatatgtaagctggaaagcataaacctagaaatcttccattccatagattttgcccctctcttcctcccctccccacaaagaaataagtcatttggagcaaagcaattgcttaaacttttcttagctggtttccggagctccctgggaagaatgagggtggaaagctggaggggcgttctgggtattggaatgcaagccagtggatctgtagcccgctgtgcttctgggagcctgacacgacacacaaccggcacacaaccgttgtgcccttttgaactgtgcagggtcttagctgggctgggcagtttgacacggctgttttcaccatcaggacgttcacttatggttgagtacctggcaagggtagggagagaggaatgttcccagccatctcctgcgggacacttgggcggctttctccctgggacccccatctcgagatggcctcgggattgtggagggggtggcaggggtgctgggtttgctttcatgaaagagcaaagcagtttcccttctacttatcttgttttcagatgtagtggaataagccaggaaatatttctcctggatgaaaggtcattcttcttacattggaagctttggaaaaatctccctaaatatcaaaatacaaaggttatggaataatatgtgcttcgaatagcttaagtggttaaaaaattctctttgcagctcaatattaaaggaaaaataatagactgttcttggacaaaaatgaaagggatcacgaagaatgtgtttccagccagcttcctgcactggggttattgcaccaggactgtctccctagtagaggccctgtttactatgttgcttagtccttgcttcacaaaagcaatatttgaaccaataatcccacaacagcatgacattttaacttgtaagactttgggttttcacaacatggtgggagtctgttttggtattttgttctataaattcagttggggctgacaaaattaatgaactggcattttagagaaagtgacattgtaacttcccctcctcttcgcatgtttacatccacactgataaagatgcaatcttgtctgtagctcattctccaggaacttgagtgtcaaggacagtctgcacggcccttgggaaatgggcattccctggcattgagttgttaattggacgctgagtgctcgagctgcatttatggttccatatgtgggtgtatgtttgtgtttcagtgaggaagatagtagctgcttccctcccacagccttgtggaccctggctgcacatttgagttgcctgtttgacgctgtctgaccctttcttagccagtttctggagctccctgggaagaatgagggtggaaagctagaggggagtcctgggtattggaatgcaagccagtggatctgtagcctgctgtgcttctgggcacccaacacgacacacaaccgtgtgtgttcccacagaacctctgtgtgtgtctgaagccctctgggtgactccacctgtggccacagttgggagcaagcctgcctgggcctccgcctcctgcaaatgtgatagtccccacccagggtgggtgcatgtgcctctcacggtagcaactccatggcttgcctgaggtgggccaggttcttcgggggctaatgtctcaccgccctgtccagttctggttctcagtgaatgtgttatgccatcatgacctttgtcactttcttccccttgccttgtttttgcacattggaatttgcaagcgggtctgtggtcatccgaagttgtgctcttcatgcataacctggcctccacgcctcactgctgggctcggatgacacaggtgggagacttctgaatattagaagtttattggaacatctaaattgtattctaaataacctttttctttttttgacaggtatcattttcctttttttttaatctctatttctaagaataactttatcttcagctcttatccatcatttaaaaacaataacaaaagaggctggatgtgatggctcactcctgtaatcccagtgctttgggaggctgagctgagaggatcgcttgagctcaggggttcaagagcagtctgggcaatatggtgagaccccatctctacaaaaaaatacagaagatgtagctgggtgtggtggtgcacgcctgtagtcctaggtgcttgggaagctgaggtgggaggatcacttgagcccagggaagtcaaggctgcagtgagctgtgattgtgcctctgcactccgtccagggcgacagagagctaccctgtctccataaaaaagaaaaagaaaaacaagaagaaaagaaaagattactatgtacattctcatctttcaaagaacgaacaagatttgggaaaatgcaccaaggctcaaacgcttttgaaaggtggacagtggtagagaatgttgagtctttgggcctctggtcagcttttaaggccagggtgaaaacagacccttggaaatgttactgtgtattcagttaaataaaagaagggggatgactccattcctccagtgcagtggtgaaaccttggctgtgctccctgggggagctgcgaagcgctattgatggccaggctgcaccccaggccagttagtcaggagatggaggggcaggggcaggtattggtgattctaaagaacaccaggagagtccagtgtagcctggatggagggttatggtcttacatgttagccttgacatttttctttttctttttttttttttttttgagacagggtcttattgtgtcacccaggctggagtgcagtgacgtgatctgggctcactgcagcctcaaccacccaggttcaactgatcttcccatctcagcctcccagagtggtgggattacaggcatgagccaccacgcccagctagccttgactcttgttggcaggttaacagacaggcaccaagcattctctgcaaagctcatggtgaacattgagtccccccggccaggggcctgcctgagtttaatgaatgggtgtgttttctgagctcgagggggccacattggttctctttggtttgaggcgagggagcacgtcaacctttggtcaggctctggtggccaaggtgtcacaggaagggaaaaggtgtagtctgtgctgaggctggggccgagggattttcaagcagaaggagctccagggagtatggaatgcactctcctgccttggggagcagggagaccaatagacccaagcagttctgggaaagtaagtggtgctgctgtgtggggaggtggagcaaggaggagggaggaggccttcctccgctgagagaatagggtccttccgggtcggggtggttgggctgcattgtatggggtactagcgaaggacctagcaggtgccaggctaaatgctttccagcagggcttctctaagagtgctcttcccatcagcagcatcagcttcctctgggagcttgtccaaaatgcagaggctcaggtcctgccccagtcctgccctttaagggcagggtttcacactgctataaagaattacctaagactgggtaatttataaagaggcttaattgactcacagtttcacttggccgggaaggcctcaggaaacttacgatcatggtggaaggggaatacgcacatcttacgtggcagcagtcgagagagagcaggcaagagcagggaaaactgccttataaaaccatcagatcttgtgagaactcactatcacaagaactgcatggcgggggaatgcccccattatccaatcaccttctacctggtccgtcccttgacacatggggattatgagaattacgattcaagatgagatttgggtggggacacagaaccgaaccatatcaagggccttctcgaaggatgcttctgatcataggctggtgcttgggaacctcagcctgatagactttctcttatccattcctcatatgtgttccagggaagaagttattgttcttcttcttattattattgttgctttagtgacagagtattgctctgtcagagtaagccttacccaggctggagaccagtggcatgatgttaactcactgcaacctccaactctcccacctgagcctcccgggtagctgggactataggtgcctgctaccattcccagttaatgttatttttttttgtagagatggggtctcactatgttgcccaggctggtctcgaattcctgggctcaagtgatcctccagccttgcctcccaaagtgctgggatcacaggtgtgagccactgtgcccagctttcctgtctgtctatatctgtctatctgtctcttcatccacacatacaattttacgaatggcaaagcaacggttatttctattttgaacaggcaaatgacacctcagcagggtgtagcgtaaggaccatagcgctatctttgagttagtaaaccagatgctaatcctttgtgttgattgactttggatttaaaacctttgagcacaattttcacatatctgaagttgggaaggtaatgcttcctggggttgtttgtttttgtttttgtttttgttttttaaacagattctctctctgttgcccaggctggagtatagtggcacaatcttggctcactgcaaccttcacctcccaggttcaagtgattctcctgcctcagcctcctgagtagctgggactacaggcatgcgccaccacccccggctaacttttgtatttttagtagaggcggggtttcaccatgttagccaggctggtctcaaactcctgacctcaggtgatgcacccacctcagcctcacaaagtgctgagattacaggcatgagccaccacgcctggaccctggggctgagtagctgtcgccagtctacacatgccagctgttaccagcagcactagtcagagaccccacttttccagtgcccttgcagtaggtgtgattgctttgttggctaagagctgaccccagaggtttgtggtgacaaggaccagagccatcctttggaggtggagttccaatgatgcccaatcatgatgggggccgctgttgatccgtacacactccgattccttttcagcccttagggtggcagggacacattgagattctagggccaagagactgggagccagtcctagtacaaggcatttttttaaatatatggaaacaaggatggtgaatctggaagttgagaaattgcggttgcctgaaggtgactcacaagcgaaggtatttctaagccagaagaaagtatgattcagattgaaaacagaactcacacctgccggttgcggcagagtgatctgaacatgctcattacgacagtctagttggggtaggtacaaagcttatttatcatgcatgctttcaggatgagaaaaccaagggctcagatctaatacaatattattcaggtttcaggttcagttgatgcttttaggagagcattttggcccagttttttttatttttatttttattttttaagaatcattagctaatggtttcagaaaatacattagattatttcagattcacactggcatgtcttgggctctgcaagtctccctctctcacacacagtaagaaggtggccttctgcagtccaggaagagacccctcaccggaacctgattatgttgccatcttgatcttggacttcccagctccaggctgtgagaaatacgtttctttctttttgtatgtgtgctgggattacaggcatgggccaccgcacctggcagaaatacgtattgttgctattccctgctcccctctgcccctggtagcctctattccactttctggttctatgagtttaactgcttgaatctctttttgccatgtacacggagcagggggagtgctggcgcctggatggtggcctgaattttcttgctgcctagagtcgctgatccaccacagccatctgtctggaaagtggggtcagctgaattggaagtggcatcctgatgaatttccgacatagagcttgataattcttatccttcacccaaagattaaactggaagaaagcagcttgtggctaagaaaattgatcagtttagctgttacagggtctcaagtgaacccctggtttcttttttttttttttttttttttttttttttttttgagacagagtttcactctagttgcccaggctggagtgcaatggcgcgatcttggctcaccacaacctccacctcttgggttcgagcgattctcctgcctcagcctcccgagtagctgggattacaggcatgcaccaccatgcccggctaatatttttgtatttttagtagagacagggtttctccatgttggtcaggctggtcacgaactcctggacctcaggtgatctgcccgtctcggcctcccaaagtgctgggattacaacccctagtttcttagataactgtccagcctgttggcaaaggccagacattaacaccatgtgttgaatgcatgggtctcacgagaggcatcttgtgagttctgagtttaggcagaaggcgagagaagtcagattctgttgtgcgttagaggaaggcttaaggttgaacccatggaactacacacaggagagtggggagggaaactgaggaaaacactgacttttgtcagaaaagactgtttcagaggggaaaccgaaatagctggttagtgccgtagatgtggtttgtcaacatggcactatcgacatttggggcttgatgattctttgctgtggggacttttctgtggattgtaggatatttagcaacatcttggcatctgtctccaaatgaggacaaccaaaactgtttctagacattgccaagtgtctaggggatggggaccacagtcactgtgtcttggtctgttcaggtttctataacaaaagaccatagaccagttgacggtggctcacgcctgtaatcccagcactttgggaggctgaggtgggcggatcacctgaggtcaggagttcaagaccagcctgaccagcatggagaaaccctgtctctactaaaaatacaaaattagccgggtgtggtggcgcatgcctgtaatcccagctacttgggaggctgaggcaggagaatcgcttgaacctgggaggcggaggttacggtgagctgagatcgtgccattgcactccagcctgggcaatgagagcaaaactccatctcaaaaacaaacaaacaaacaaaagcaacagacatttgttgctcacagttctgggggctggaaatccaagatcgaggcgtggcagattcagtgtctggtgagggcttcctggttcacacagtgccttcttgctgtatccatgcatggtggaaggggcaacagagctctctggggtccctttaataagggcactaatcccattcatgaggctccaccctcatgacataatcacctcccaaaggccccacctcctaacaccatcaccatgaggatcaggatttcaacatatggattttgtgggtgggggaacacacacattcagtctgtagcacacgccagttaggagccactgctatccactgtcagattctccctaatgtgtcatccttcccttggccttagggctgggacccctagggaaccttagttaaggtcttcgcaccttcttctttcgtgtgttctctttgtgctgaagtttgcttcaggtgtttaagagagtctggtccttgaagaggcaggatgaccttggcaagacctggaggagccaggggtgcctgtccagaggcagggagctccttaggcctgcacagtggggcttggccagggatccatcctcaggacttggttctgctatgggaggtaacgcccaccctgtgtctctctagcccgccgagcccctccctctgcagcacacccctccttgctggtcttgcactttgtgtttgtcagggagcatgactaggttggtggggagtggaaaggaaatctccagtcctgagggatgctgtcccgtggccatctcttggtcgagtcttttggaattgtgtgctggctccctcgaagtagaatgcatgtgaccatgtggcacatgcaggcttagtagttaggaaaccgtttacccagtaggcacatgggatagggagcgggcacagctagagctgggagtgccccagcacactagacgaaccagcaggagcctgcatatgaaccggctgagctccccagctgaccgctgagctcacttgcaggtcaatgtgtcctggggcttgcttgttgaacactaacgtgtgtgcaggttgcaggggtaagggtggggggcgggtgcacctcactctgagcccgcttctctgatggcccctgcttgctggtctaccaggtgttcctctggccaaggtcaaaacctcagatatttgatatttcttgttttgtgtataggaagtactagaaatctactttgtaatgggtcagaggaaggggaaggacttatttgtgttggtttttgaagcaggaagtggccacatgcaaaggttttcctgtgactgggcagtcacagaggggagatgagatgggaggaggagttgccggcacaatggaaagtgctttacttctacttaacaaatgtcttctcgcgtccttgtggagaaggaaaacagcaggtggccctgggactctgttgactaggaaatgacagacggaacaaaaccgcagcctcagagcaagcatccctgagccccttcactgtctgtgtgtgggaacacattggtcctcattccgtaacgggaatctgccagttgtggagcgggcgttttattacctgtgaccgccccatgttgaaatgaatacactttttgtccagttttctctctggctcttgtgttagtgtagtgacccgcagtctctcctctccaaggcagacttccacattttcccaaagtgctggaaattctcttctcctaggtcatcatgaagaaaatgaatcaaaatactgggagatgtttgctctgcaggctacttttgtttaaaactatattatgaatcactgtacacattttcagctaccccacccctgcatcggacctcctaattagggacctcataactaagcacttagttactaggacattgagcgctgaaggactccactgacaatgaagagacacacaagtagactctgtgtgtgtgtgtgtgtgtgtgtgtgtgtgtgtgtgtgcatgcacgtgcacacatgataacagaattccagacaactccagacagccagaactactttggttgcaagtgacagaaatacagcctagaccattagcttccgtgggagagggactgcattaactccccagctagaaagtctcgaggggcttcaggcatgctggaggacccactgtgtctccctgtcccaccccactgagatccgacggcctccttcctgctggcctagttctccagcacatttcccacagtggccacacgtgtccctgggcttgtgttctacagacctgcagcctcaaaggaaggatatgttcctccctgacaagcctcgctgaggttcccatctacactagtggttcacaattgggagtgactttgctccccagacatttggcaatgtccagaggtatttttggttgtcttaagatggggggatgccactggcctttgtgggtggagagcagggatgctgctcaacatctgccagtgcgcaagatgccccccacagcaaacgggggtccatctcagtgtggtggtggtgctgagccaagagctgcagcgctggacctgtcaccctatcccaggactgtggcccccagcatgggttgagtcccatgcaccaggagagtgctggggaagcctgtcaggaggaggtggtgtcctccagagggaggaatctgctggaagaaaagagaggctcagacactccgtgtggtgttgcatgtcctccagaatgttgtgcgcatgggaaatgctgtataggtgcctgcagaaccgagccggcaagacagggaggcagagctccctccaaaacagggagcagagctcggtgctcactgctttgctcaggtgttgccaaggcagctcgtggaacttcacctggaagaggtcaaggggaagccatgggctcattgcgaagtaaattggtgttgctcatcagtgctcttggccattcctccccagtgctctttctccaccttatttatttatttatttatttatttattttctttgagacaacatctcacaaaaagtaaaaaaaaaagaaaagaaataaaaagagcatctcactgttgcccaggctgtggcacaatcatggttcaccttttaccttgatctcccagggtcaagagattctcccacttgggttttccttgtcagggagctgagccaggtagagaggggtgtttgcaaggtgcactgcccgtgcctgcaggatctgattactggtgcagagcccatggtttagctttgtgctggctttgttctaaaacttcacccagcatctgccactgtgcagaaacaggtggcgctccatcaggaggtggtgctgtcgtgtcctacccaaggtgccagtcaggggagtccctgttcatcctcattgattctgatgtccagaatcttacagagaatttttttctttatgtaaagtaggttttattgtgttcaccttgaaaacaactcactgatgggaaaaaacacactgacagtgttgactgcaaatagagtgacctcatatcatttcaaactgggagtcaggaaactagacctgcagggcagagaacctgtgctttgcagttgcctggaggaccagaagtccacaggaagaaagggccagttgaatatatgcacggacagatgtgtatggggcaaataattcccggggctctgtctccctctcttccctcctccctgtccagcagttttaatgtttcgagccttgctgttctaaggaaggaagcaagagcagcagcagcgtcatccccttggaagcacattagaatgcagggcaatggggagaaaccatgtggctgcactagcgtttaggaaaacgttaattcttatgccatcttacagggcctggctacaaaaagtaaaatgaagaagaaaagcagcattagcatacaccattgtatacctcaaagaagggttgtgtttttagcaccagcgtgggccaggaggattctgattttagaaaaccaaacttttaaggctttgggagagcacctgccctgccctaggggggtactgggtgcagaagcccagcactgcttttgcccgacctcactggctctcttcatgtttttttttttttttggttgttttgagtcaggctctcgctctgttgcccaggctggatggagtccagtggaaccatcataggtcactgcagcctccaactcctgggctcaagtaatcctctcatcactggagtagttgtgtgccaccacgcccggctcagttttctgtttttgtttggaggctgaacacagaggttccctgaagaaagttggttggagctggagttgttctagaacctctcactgtcaagtaaagaaccctgctgagcagctgagcctggaagcttcttcgcacccctgagcacctttcctgagccacgtacagcccacctgaaggcatctgcacacctggagagcggggaggggaggggcagcagacccgggcaccagatcagccctggcccaggcccaggcccaggcccaaggcagccgtctttgcacggtgcagtggggagtggaaaggcccatgtcccctctcccagctcctctttttagtggacagctgcccttgggtaaaagtggaccatgctcagcctcagttttctctctaaaaagaggggaacccctggcagcatagtgtctggagtctgcagggcctcagagattgctggacacatagacagcgctcaacagataggaactggaggtttctaagaacatttctgggcccggtttagcatctttgcaatgtctgtgtgccctcgcttctctccctctctagctgtccttcagcctcagcctcagtctaccccccagcttctctctctctctcttttctccctctctaccccctccttctcccttctctctctccctttccctcccactgtttttcttttacagctttatcgagatatgtgattttctttctttttttttgttaagagacagggtctcactatattgaccacaccggtcttgaactcctggcctgaagcaatcctcccatctcaacctcccaaactgctgggattacaggcgtgagccactgttgccggccaatttctacactataaaattcacccattttaagtatacaattcagtgatttatagtgagttcaaaggtgtgcatccttcatcatgattcaattttagatcctttccatcacccccaaaagattctttttattcctttaagccatcccttctggttcccaccacagccccaggcaaccatgaatctcctttctgtctctggacttgcctcatttggacactccctgtacatggaatcctgcagtatgtggtgttctgtgactggctttttgactccgcatcatattttcgggattgatccacattgcaggtggtatcggtactccattcccttccggtgccaagtgctggtccttggtgcagactgaccgcatggtgctgaccagtgtgtcagctgatgcacggtctcattgctttcccgtgccaccctgacaagagtggttcccacttttgtgggcacacgggagggggtctcggctctggaagtgaccagctttgtggtttgtggggaggctggtcgcataagtccttagaacatcaactgtcacttgggagccgggattgttagcataggattgttcaaaaaatctaataagccaaatattttaaaaacgtgtttcatgttgcctctctctgacctcaggaagtaagtcactgtcaattattgtcgtgtgagcaaaaatctccagcttccttcaactgacagttcaagggatagaggcttctagaagcatgttctccatgtggttctcctgatgatgaaacgtgtggtgtgcacatgtcccatcctgccctcccgacagggcggcatgcggaaggaacataggggaccagccctgttttggtggcggggaggctcacaggagagtgggcgctgggctgtgctctgagaccgttccttgtcttgcttggctttttctttggccaagtggagacagcaccaggtggccagactgtgttgggcctggtcgtgtgcttgatctgctgtactggggatgtcgcctcatacccctgtgcccagctccttgcggctgggtgggtctccttcaccctcctgtccttgctggctcagtgtttgtgtgcctggccaatataatgtgtggcaggttcctcacatccttcttgggccaggcggggtgccttcgctagggcactgcagcctcagatggtggtagcacctgcccccatgtatggatcaggccactggggcatcggggtcaccattagtcagcagaacagctggaattgggtggtcctggacatttccttgggaagcaagagcactgagtaagctgaagacttaaatcaggagtttttctgtgtgtgtgtgtggtttttttttttttttttttttgagacagagtcttgctctgtcacccaggctgaagtgcagtggcacgatctcggctcactgcaagctccgtctcccgggttcacgccattcttctgcctcagcctcccgagttgctgggactacaggtgcccgccaccacgcccggctaattttttgtatttttagtagaggcagggtttcaccatgttagccaggatggtctcgatctcctgacctcgtgatccacccgcttcggcctcccaaagtgctgggattacaggcatgagccaccgcacccggccttaaatcaggagttttaaggtcacgagctggctgggattgggttgttgccaacacccacggcagctaaaaactgcttaagaaatgcctgcttgtgggacttgcagggagcctgggaattcacaacccctaccatatagtagatcaagccttgactactaaggaaggaggggttatggtaatctgcaggaaagtatctcagtagtgacgaactcatcatagtatgtcgtatagcctttgtttcttctcaaaacttttacagcaagttcaggatggcttcatccagacacccgagttaagcaagcaagcaagaaacaaaaagccttaaataagagaagttgaagacagtgtgccccttcgtgcctgaatttggctaggaaaacattggcatgggagcgccaccaagggctggcacattctctgggccaccttcagaggtttaacttctgtgtgagagaaaccatccactgggatgcagcttttacgccacatactgccggattccacgtacagggattgtccaaaagaggcaaatccagagacggaaaggagattcgtggttgcctggggctgtggtgggaatggcttaaggaatacaaaggatcttttgggggtgatggaaagggactaagattggaccctttccttccctgtcgcacgtggaaggaaatcagaaaccaagcaagagagctgggggtatgaaaggaactgtgtcattttcttgactgaaatttcaccaggtggcactgggtgttgagatacatatcactgagcaatatcaggtcacacaatacaggagtattgtttctgtcacttccgaattggtgtgcttgaccccaacagctattttgtatgcattatgtgggcaaacccaagtgggtattgttgggttttcatagcaacgaggcagcagggcagagacgcgtttttttaccatcaccctctgtggtgtgggtgcattatgtctgagccattggtcatcttttcttgtcacccacatctccctgggtctggaatctgaccagaaaggaagccgcatttgctcatctgacaagtcctaaggtcagagagctcccgcctccatgaaactatcactgtggggcagatgatgagcaaaccacacacccgaaacatcacacatgcgcccccttgccatcttctttctcctgcctgtgtccccagcccaagcacggagctgctttctgtccctttaggtcactgtacattttctggacttgtatgtagatggagtcctgcagcaggtgctcccttccacctggctcctatctcttggaataaccattctgagatgtgcccgtgttgtcagatggatcaagagctcattgctttgcattgctgagtattagtgcagtgttgggtagcaagttacatgctggtggcattttgtgttaatattagaggctagtttttagaaaaccgttgcaaggagagcccacagggagaacaaagagagtgtcctgtgaaagctatctcttgaccctgatggagagaagggcgctccagcctgtgcagatgtctgtttccggtgccatcgagctctaacttcaaccttgactctgctttccgagtttgggtaagacttgtttcctactctatttgaggtcatcggagaccatcactttatcatggatgggaaaagttttcaggtgatgaagggctgtgctgttgatttggaaagaggacacaagactggacacttcctttcagggtaccatttctaggccctcttgatattttaatatgttttaaaaattaagagaatgtctgcatatgtactagaggaagtcctgttacacaggaaatactctaaattcaactcacatgcagttggttcccattttcaattcttgggaatatgttagaaaacaaaaattttaaccttggagttaaaatctgttgctattttcttttctttttctttttggagacagggtctatgtcactaggctggagtgcagtggcatgatcatggctcacctcctgggatcaagcaattctcccacctcagctccccaagtagctgggactacaggtgtgcgccaccacactggctaattttttgtattttgttgtcgagacggagtttcaccatgttgcccaggctgatcttgaactcttggaatcaggcaatccacctgtctcagcctccgcaagtgctgggattacaggcatgagctaccttgcctggcctgctattttcacagatgctaaatgaaaacactcagaattctatgaaatcattcagactataaaatattctttagcaattcaagctgctgtttatgaggtgggctgtttatagtagggtagatgcttctaatctaatgtagaattgcagctgcagcatagaaagggaagaagaattgagagtacaccaagatgttaaatgtttgtcttttggttgtggaatatgggtgagctcccccctcacttctttatacttttatataatatagaactcttggttcttctgtagtgaatatttatttttaagaaagcagataaatgttgcacataacttgctttggaaaacttttcccattacggttacttgaagactgaaagatttttgttgttgttgtttttgttttttgagagggagtcttgctgtcatcacccaggctgggagtgcaatggcgcgatcttggctcactgcaacctccacgtcctgggttcaagcaattctcctgcctcagcctcccaagtaactgggattacaggcatccgtcaccacgcctggttaatttttgtatgtttggtagagatggggtttcactgttttggccaggctagtctcaaactcctgacctcaggtgatccttccgcctcggcctcccaaagtgctgggattataggcattagccactgtgcctggccattttttttttctatttttaaaatccttcatatcttccatggcagtaaatatggtaaaataatatgtatgtgaggatttttataatgcataaaatattgtagaagataagttcttgtacatgcttttgaatcgtttcatttgccttctctctttggcttacataataaataatgaaaactgcagtttctgacttgggccatctaacattcctaggaagggaaggaggaggcaggagggagacactggaagaggtggtagaatcacagtagcttttgtttttgctgcatgccagacacaaaatgcgaactcacattatccaggctgatgagtcctgcaggtcagaccccacagcataggcaggcagttatagttggaggccttccctcattgctaagggagttccttagcagaccaattcggaatgagttatgtgtaaaaatgagcacagaatgcttaatgcagtgggccacagaatcacatctgatgttcaaacattctaatgaggctaggtgtgatggctcatgcctggaatcccagcactttgggaggccgaggtgggaggattgcttgaacccaggagttcaagaccagcctgggcaacatagggaaactgtctctccagaaaaatttaaaaagaagcaaacaaaaaaataattagctaggtgtggtagtacatgcctgtagtcccagctactgggaggctgaggtgggaggatcacttgagcctgggagttccaggctgtagtgaactatgatggcgccaccacactccagcctgggtgacagagtgagactttgtttctaaaataaaaacatcctaatgatgtgtggtgatgctgtgttgtatactgtctgcatgctatagtcatttggtaacctaattaagattttaggttgtaaatttttcatttataacttcctgagattcatttcttttaatactcgttaaggcaacataaatttagagtttggatcattttcctcttaacttgttgttttacttcacgattgctgcatttagaaaacttttaaaattttatttaaaaaaatagataatcccaaggtgttgatattacaggtgtgagccactgtgtctggccagattcatttcacttaaatccctgaagatccacatgggattctgacagatcgctctgagacatcctcctgttgtttccttttcaccactgcaggtctccacctgccctggtgtccttgggaggaaacccaccgtggtagggcacacagcggctgacttgtcctggtaaatcataagcatggtgggctccgcaggtgcctccctcctttctgtccttgagtctgaagccagcaccttctttgatgacacaaacgtctgtggtttagggttttcaaaggaattccccctcttcctctcccaccacaagaaaggctgctgtggggagccggtagcttgcaggctgggttgtctggtcgtttgaattccacaagaaagccaacctagctgtcctggcttggggcgaggcgggagggcaggagtcctggatctgcctgtgtctgtctgtccctggctgtctgcccctccctcctccttccctcccctcttgcttggggttgggtggggtctgtcttagggagagaaggagggcagggagggagagagctggaatttgaccccagagctgtctgcagcttcccaggagcccttttcagaccctgtctggctccttagaaaggctgtgtggctcctgcgtggcagggccacctcattaaaaacaccggctcaggggagggtgctggtcactcttggggccaaccaggatgtttgcatttgtcctatgcacacagtacaaagttgttgttttttaaataccattttagaggagttttagctctacagagaaatgcagagatagtaaggagaattctcacctcccccacactgggcttccccctattgttttttttttttcttccaattaccatatatccctgccatcccctattgttaacatctcacatcaccatggtatatttgtccaagcaatgaaccaatattgctacattatttgttgttaactaaagcccaaactttgttcctatttccttagtttcccagtttcccattaatgtccttttctgtcctgggattaaccacatgacttttttttttttttaactgagacaaggcctctctctgtttcccacgctggagtgcagtggcgtgatcatagctcactgtggcctctgccttccgggttctagggatcctccagcctcagcctcctgagcagctgggattacaggtctgcaccactacgcccagctaattgttttgtgtttttagtggagttggggtttaaccatgttggccaggctggtctcgaactcctgacctcaagtgatccacctgcgtcagcctcccaaagtgctgggattacaggcgtgagccactgcgcccggcccacatgacatttagtcttcctgtcaccttaggttcttcttgactgtgacagtttttcagaccttccttgttattgatgactctgacctttttgaggagtactggtcaggaattttgtagactgtacccctcttgggattcatctgatgattttctcatggtagaatgaggttatggctttttgcaaagaagaccacagaccattctcattacacacgatatgttttgttttttagttttgattttctaacttttcttaactgtaggaattaatgaagatttttccacaattcctatgctttggaaaatttcctttgatgatgaaatttctttagggaaaaaattatttttcttctgaaagtgtttaggcagagaaactttgttactgaaatattagtgatcagagctgctaagttatagcaaatttgtagagataattgtcccagacaggagggtctgctgagtatgtcctgtggatatgttatttatcttattctgtgctgttgtgcaccctaaaaataaatattttaggctgggcatggtggctcatgcctgtaatcccaacacattgagaggccaaagctggaggatctcttgagccctggaattcaagaccagcccaggcaacatagtgagacggcatctctccaagaaatttaaaaattagccaggcatggtggtgtgcatctgtgatcccctgcttgggaggctgaggcaggaggatcacttgagagcttgggaggtcggggctgcagtgagccatgatcacaccactgcactccagcctggtccacagagcaagaccctgtctcaaaaaaataaaaaaattaaggccggatgcagtggctcatgcctgtaatcccagcactttgggaggccaaggtgggcagatcacctgaggtcaggagttcgagaccagcctggacaacatgataaaaccctgtctctactaaaattataaaaaaattagctgggtgtggtggcgggtacctgtaatcccagctattcgggaggctgaggaaggagaatggcttgaacccgggaggcaaaggttgcagcaagctgagatcgtgccattgcactccagcctgggcaacaagagcgaaactccatcttaaaataaataaataaattaattaattaatttaaaaaatggtagatttcaaaatagtgtttgaaagttcttggcgaattggtgtgctcctgcgttcctctcaactcccactcttgctcagttgcctaccatcacctccaatctcctgatgctggatttgcaagttaaagtatttctctagcgtgggagttggcaagtgtcttctgttaggagcccgtaaatgttttctgtttgggccacttgttctctgtgggactcctcagggttgttgcagtagcaggaagcagccacagccagtgtatacatgaaggtcgtggctgtgttccactaaacctttattcaccaagcaggtggcaggccaggtttggcccaaaggctgtagttggccgacccttactttattgcagaagtgtatactgccaggacttttttcttgtttttgttttgctttgttagggagtctggctcatttggcccatgtttatggggcactgactctgttgtttagcaagcgctgtgttgctaaagaatgttttcgagagatttagacccacccagtaaacctgaacaagaagccagcctgagcagttagccggggtcacagttctccataacttctccccctgcttcctgctggaacagctcacttttgaaatggcaggggagtcattccaagctagcatctcccatcccaccttgtcacccacccccacccacctttttgttttttctggaaaacaaataaaggcttttattgtatctacttgggcaggatgaggggagtggtagttccagagacaaaggactcagagccaggacctggccctcacctctgcgcacaccagcccacactggctcccgtcaccctcctttctgtccgtctctgctcctctctggtctcaccccgtctgctgcagacagtccctcttcatgagttgagaaacataattcctggcagctgcagtgtcgcaaccccttcctctacattttgtggaatgaacacagctatgtaactcgctacccagatcaagagatggaacattcctatttatgttttaggaatgttctagctccccaggggtgcccttgagcctccccaaccccccaaatataggactgtcttgaatgtccacactatagatgaggttagcctctatttggcctttatataaatagcatcatctagtatggactcttttgtgtctagctttttcagtcaacattacttttgtgagattcattcatattgtttctggtggcagttgtagtttattcatttttgttgctgtgaacctcagtttgtttggttttggttttggtttttgagacaggatctcactctgttgcccaggctggagtacagtggtgccatcagggctcaccgtagcctcaaactcctgggctcaagccatcctcctgcctcagcctcctgagtagctgggaccacaggtgcatgccaccacgcacagctaattcttttatttattattattatttttgagacggagtctcgctctgtcacccaggctggagtgcagtggtgcaatctcagctcactgcaacctccgcctcccgggttcaagtgattctgctgcctcagcctcctgagtagctgggactacaggcacgtgccaccacacccagataatttttttgtatttttagtagagacggcgtttcaccgtgttagccaggatggtctcaatctcctgacctcgtgatccgcctgcctcagcctctcaaactgctgggattacaggcatgagccatcacacccggccaattattttatcttttatagacatggggtcttgatatgttgcccaggccgctctcgaactcctgacctcaggcatgagccactgcctccagtctgtgtgtttttctaaagaattcttagtggctaaggaaggttaagaccttcctatcgtctctttcatctttccccagagatgagccattttgaacatggatttggcatctgtgccgcctctgagcccatgcttggctgatctgtggttggcgtctgccttccagagaattccttgttttcccacagtccctttgcagctgtttcatggagcacggggacgcatgctggctgctgccaccagctctgatggctatgaaggtttgagacgagtctcataggtgaaatctgggctctaagacagcccaccttttgaaaggacaattcagccaccagaatatcatcttcgatctgctggttttctcattttggtttccaaaagcctttagccattgttattattccgtgcttgtcttggtgttagctcagtatccatgaaacccgacaaacctctttctagaatgaggccggcaaaccagtctcataatgttcaaccccagtgaagaggaactaaacctcaaaattgttgtaccacaaactctattggccttttattggtggggattttgtttttattacaagaggggtgactgctacagtggcctttccggcaccaggccgtgcctgacggatgagaatgctgtgtcataaacagtcttttgcaatgactaaccgtgctgggttggaatgcagtgcacaccaaaggaaggtaggacttttagtggttgtcacaatagctgtgcgaatccaaatatggctggaaaatgtcaacatactctccagattatcagctccgacgaatgtaagagacatagtgttagggggatgtctggataagttgaactctaatcagagggaaaagggggttggaggaataatgaatgagggaaacacttttattgggagaatagcttgcaaaacggccagttgcataaagtgtcctgtcctaagaagtcctagtgtaagcctcggccagtcctaaaatatgaatgagacctaggacttattttacgtattgctgttatccttactagcacttttggagtctgcattctggtaatgcctaaatgcttgtgctgagttacatgtggaaacagctctacacaacattccctagtctcttggacacttacagtgttggccagtccttttctcgtgattttttccctctgatttactcgtgttgtaacaaagttatcacttttttattgtttctctttgctttcatcctttgcatctgtggctgctcacttgctatgcccagggaaggggaagatggagaaatagattatggatatggcactccagggcctgtttaccaacaacctgaaaagcttatattctcagcaggtcaatactccccatgtctgagggcgaatgttgtgtggattaacaggcaaaacatgttgcatagatttgcagatccacgtttacagattccccactgtatactgaggccatcgaggaacctgaatttgtgtatcccttgtggctattgatatgttgctgaagtcaagtcaggtatgtattgaaaagcatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgactgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaagaaaagcatgttctaagtatctaagtatttaagttctacatgtctagagataaaactctctttatacggggatgtgaggagaggaactaggaggagactttatcatgtgctgatttatgctctgccggtaatgagccatgcagccctaagcatgttacctcatatctctgggacgaataaagtgtctgtcctttggccaattttttagcttcccgaatcagtttatcgacaagatggggacatgcaggtgtatctgccagggttaggggaagctctcaatagtaacgtgtgctgagaaccagctggtgccctgcgtgagtgcagcgctccgtgaagaacattgtgttatgaactcctgggatgcctggattcccttccattcatccactttgttcacctaaagggccagagcaaacaaccgtccactcaggtaaacattcccaccccagagcgaccgtttgcatcctccaggagttaacagtacagctggactcacccgtgggtctcctggaaggcactgtgtcggaaaccgagcttctctcctgcttcccttgctgtggcctatctgggaatctatagtctggagcatcccagggcggcctcctttggcagatggtgtaggagtgctgcaagccctcctggatgcacccaaggacccaggaagatgggagcgtggatctctgtgcctcagcacagaggctgggaggagagacagcaggcgccggctggcaggagcagtccatgtgggagcttctgtgtactcccacctctgcttcacctcctgttgatctctcctccctctgcagcacattctgccctccttccccagactcctccccacagttcgccctgaaacaaacctttccatgggattgattttagaggctgcccatgtgggaccagggctgcagcttccctatgggggtgctggtggccttgtggcacttgctaagctgggcgggcgtggctaggagtttgagcagtaaccaaagtttcctctctgctgagtgctcctggggtccatccctctggggtgatggcaggcagctttacacgtcgccttagagcatgtctttatttgctcctggatcaagaaccttttgccatcaatgtagggctgagcacccccaccaccacacatgccctgtccagatatctcgctctggggtagaaggaggcagttgtgggaagaagtttcctcatcacattagctctaggtaatttcagagaactttgccaatctcttccctagcttgtaggtacaatgaagataacaccagcagacaagataggatactctttcttgagtttaaaaggcatcaaaatagttgcatgcaatttagcaaggaatggatacattagattgtatttaagagagtgcctgttgctgtacagtttttaacaacacgttgaagcagagcaggtacctctcagatactgttttggtggggaggattggggacagtggtttcctgctgtcacactggggagaactgaaggagagaacactgctgcacctgagcggagactgacacttttgaggtgagcaccctgaaccttgggtgtgtattgtccctctcatacctgctgggcatcttggggccaggctgggctgcgtggcagctctgtgggatcattcccgtctgcagcacccgggggcgctgctcattgtgtagaccaaaggccagccagcggagatgcccacttgctgaccttcttacatgcctgcttttctgctacaagctgtcattttcttttattgattggttggctgtcattttcttttattgattaattggttggttggttgacaggccacatcactgcagctttggtatagtcacttctctaatctttccaaaaagtcgcttcaggttatgaagtgagttagcggcctgctccctggttgctccatgagagttcgccctctcctcacagttgtacagcgggccagcattgttgtttggcttcctggctcatatgccccttctctgtggcaccccatgtccttatgaaaatgacctaagccaggcgtggtggtgcacgcctgtaatcccagcactttgggaggccaaggcgagtggatctcttgagctcagggagttcgtgaccaccctgggcaacatagtgagatctcgtctctgcaaaaaatacaaaaattagccaggtgcggtggcacacagctgtagtcctagctactcaggaggctgaggtggggggatcacttgagcccaggaggtcagtgagccgagatcgtgccactgcactccagcctgggctagcggataagactctgtgtcaaaaaaaaaaaaaaaagagaaaacaaacagaaaaacttgtaccctggtattgataagtcttaatgggagggcccctgcctctcaccacagccttccggaagtcagccagatccctttgtttccagcccctggtagaccagcgtggccttatgatcccctctttgtcagtctcatctcttcctctctctttttttagagacagagtctcactctgtcacccagactggagtgcagtggcagaaacacagctcactgcagcctccacctcctgggcacaagtggtcctcccacctcagccttctgtgtagctgggactgcaggcacactccaccaagcctggctaacgcttttaatttttgtagagatcaggtcttgctatgtggcccaggctggtcttgaactcatggcgtcaagcagtcctcctgccttggcttctctaagtattgggattataggtgtgagccaccatgcctggcctctttttttattttgagatcattatagcttcaggtggcaatacagagagatgccatgggtcctgtacccaggttccccacgtggcaacagtaccttttttgtaatatgatggtaacaatgtttcaaccaggatattgcttttttttttttcttttttttttggatagagtctcattctgtcatctaggctggagtgcaatggcgtgatcacggctgactgcagcctcaacctcagcctcctgggcccaagcaatcctcctacctcagcctcctgtgtagctgggaccacaggtgtgcgccaccacacctgacaaatttttgtatttttttttttttttgtagagatggggtgttgctgtgttgcccaggctggtctcaaattcctggtctccagtggtccttctgccttggcctcccaaactgctgggattttacaggtgtgatattgacatagagaccgtcaagacacaagacatttccatcccaagaggttccctcacattgccccttttaacttctctcttgctataaagatatcaagttcaaaactttattatatagtaaaactctgttaatcaattgttgaccgtttaaactggaatttaactgagagccaaggatcttccccaggtgactgaagtctgatgtatcccttcaacttctagttttgaattaacaggagttcagtgtatttggagagaggcctgtcactcccttgttctgttcctttaaagagttatggtccagtagagagggcacgctcgttaaaagcagtctctcgtgaagtggatcaagatgtgttggaatgtaaggcatgactgctagctgctgagcaattcacatactttggaggaggttagtgcccatgaaaaggtagatgcggtaatcagaaaaaactccaggctacctccgggcaacatatttggctaatgctttgattaattgaaacatttaattaactagattttttccccatgctttgcttttaggaaggatccttcactttctgccttggcaggggagtggggaccaaagatattaccctctgattcccagaccacctgcaggcgttttccagctgggattagtctagctccttgctggcttttcatggcacctgaagcttagttcttattgccatcaccttgaaggtctgctccgagctgggtctaccaaaggctttctctttctgttatgcctggtctccagtggtccttctgccttggcctcccaaagtgctgggattttacaggtgtgatattgacatagagaccgtcaagacgcaagacatttccatcccaagaggttccctcacatcgcccactttccccctgggatacccagtgcaccttattggtgcaaaaatttgtatgaattgcaattttaaagacagtcgaatttgacctgcaataaaaatgatgattgtaatttgtcatggcagaattgtaaagctagaaaagatctttaggattgaactgatcattttatggataaggaaactgaggcccagaaaaggtcattggtttgcttctaatgtgtgtttctatctctggggagagctggaaacataccctctttagccagtggtgcccagcccactcaagttgttaacaatggatggatgtagacctactatgtgcctcactctgcattctccggtatgcagtggaaccaatctagaaaagccggcatctttacagccttgagagtgtgcttctcagtgggattgtggatggtttcctctttaataggaaagcctgtttttatatagatgtatttcttgggtgctgacagacccagcaccaccagctcctaagcgagccccagtgttttctgctggggacaggatccagaagcatcccgtggaggggttgggtaccccagatccacctgccaggactccgggagaggcgtgtgtgagcagccagtgagcccccagctgtggaggactgaggcttcctgatctccttctggaacattcagtggccacaccagcagttctttgtgctcacttactagcccatttcttgtagcaaatggaggctacatctgtttcgtagggctgtcataacaaagtacctagcacaaagcttaaagcaacaggaatgtgttgtctcatagtaaagaggcctggaggccagaagtctgcaatcagggtgtctgcagagcctctttctgaaggctctgggggaagagccttccttgtttttcctgcttctgtgactccaggcattccctgacttgcagatgcatcatgccaatctctgcttccgtctccacatagttctcccctgtttatctgtgtccaaatttccctcatctgttgtggacaccgttattggattagggccctccctaattcaggatgacatcgtcatcaccagttacacctccaatgatcctatttccaaataaggccacatgtacaggttccagaggtgaggcttcaacatatctttttgggagacataattcagccccataacaaagggtaataaaatgttttgagagagaatctaggtacagaaaagtgctcacatggtagcatagacattgatgaattttcacacagcaaatcatacttgtgaccccacccagatgaaggaatagaagagacagtcttagaaaatagataccaaattccatgccttatggagaaagccaaggctcgttagtctggtttgtgcttttagggttaaatcaggtacgttgttgacacttcagaccaggtacacgtagggatgtgggtattatgctgcaaatcacaaaggacagtttcactttttaaccccagtggcttcctgagaactctattgtaaagcgtactgttataaactaaattgcattttgaataggaataattagatttaagttagagattctgccaaaaattgctttatcagatcggacgtgagcagttacatcataaaaagaagaaatgccactcaaacctgtgattgccagtttaggagaggctttgcctcttgggccattgcttcatgttcccattttgggtgccttgtctataaaggggaggaaggggtgtcgggatggctctctgggttggatagcgggaggagactgcagcccacatctggttccagcctcttgtcacacagttgagggagtggagcccagctgagattgacctgctgaaggcacctggatgggggtcatagttgccatccctttattttgcattttctcgtgttttaaagctttggtgcccaccgattccagccctgctgttcttgtgaaagtcgcatacacagagtgactgtcacagcaactcattactcttcacggtcctgagtttgcttttctgtaaaattgagaaagaaataattgcctgacctctcatcccacgattgtttttaagagtgggaatcacagcttggggggcagggagttgagagcttctgctgtagtggtgtgagcaacacaggatggccatatttaaattgggattgtactgtggagagttatattaaattcataaggtcaggagaaacagaaacacgggagttgggccttattgcagactcctcctcggtgattttatttggagtaaacggcacacgtaatcttagcatgtctcatgtcaaaatcacttcaaagaatgccacgggtgagtctgcggcagatgttcagggcatctttttaaaggagaaccaaaaaattaaaatttatttcctttttaattgtggctgttttaaactttgttactttaaaaattacatatgtgtaagtggtccactctttttaaaaaaaaaaaaaaaggcatcctcattgttcaactcctggacacagggagggaaacatcacacaccagggcctgtcggggagttgggggtagagggataacattaggagaaatacctaatgtaggtgacgggttgatgggtgcagcaaagcaccatggcacgtgtatacctatgtaacaaacctgcacgttctgcacatgtatcccagaacttaaagtatagtaaaaaaaaaaaaaaaaaaaaaaaaaaggcatcctatcatatcttggcaccctcgatgtcaaaatgtggtaaaaaggacctttgcccattgtgttatgcattttagctctgttcagaatctgtcactgttacctacgcttattttgtttttagaatttgggggcagaaattttttttatctgtcatggaaaatagctgatgccccaatttttgaactcgataaaaatcccaactattcccatattaatccagatagatagatagatagatagatattgcatcagattttgtccctaaaaggactgagtacagtacaggatgtggagtgaaacaaggctgctacggtttcagaaacagctttggagctgagactttgccaaggaaagtgggaactgctctgcgccaggaagaagcgatgaacccatccttgacttgtacgaccatcgggtgtgtcagccgccttgtcgctgtgctctgcaaactcttgcccaccacgaactaggcacacgcttaactcagtgttgtggcagatggatgactaattcgggttttaacttggaaaagcagaggtgggcagattccaccatcctggcagaaggttgcatacccgccaaagcgcactaaaaatcttcctaagttactcggctttagctgaggctgagtgctgctgtctcagaagaattaattactttgaatgggagtcattttttaaagacttaagaatgtttccttttttttttttttttttttaaagcaaaaccgaatgaacttgggggaaataaatgctttgcctttgagagttgtctgctggaaaaagtcaacaaagggcttctgggttttgttcagtggtgtcttgattagagtggcataaatcttaagtactttcagaggaggcttacaaattagagaatagtttggctgttttggtttgattctaacaagagttcagcatggagaaataataccactgatgagatgaggaatgtgtttagcataataaaaaaactacctccgtgtagccccatttttcgggcagatgcaatttgtgtcttaaagaaaaacataaaaacagccagacattatcatttttctttgcttgttcctcagacgcattaatagattatacccctcaatctattgggattgagatgttttatattttaattacacaagtgaacaaagttttgctgtttagaactattctgttgagtgttggtttttaagttataaacattaaaggaaaaatcatctggacttatataatgatgagtcttgagaaatgtcagtgttttctgggaagagttgttccattcttctaactgcctcactggggatcctggactggagcgtttgcccctgggatgcagcgccggggcacccctacttctgggcaagaggctgtgctgttcctggcctccgtgactcttcaggcctttctctcccagttgcatggtagctgctgcatccccacgcatcctgtctttgtttaagaccagaagaaaagggaaagggtggtaccagacatttctgcccctttgattgcagagacaaaggctctcctcaagcctgcagctgacttctgcctttcccccatccgctgggaccgcacatgccaccctgcgctgcaagggggcacgaggctgctccagtctccatggtggattcagatattaaggagggcagggctgatggctgccagggatcctctgatattagtaatgggggagagaggaggacgtcagttccaaaaggtgcggtcttcctggagaacgtgggacttgaatgaagccctgatagagaagtcaaatttgaagaggcagaaagaggacacgaaggtgacatgctaatgaagtctaggatgaagagaaacagtgagggaacgttgagaacaccaccttggtgtgtagggatcctgcatgacactgtggattctaacacaaaaataatgcggaaggaattgatgtttatacagagtggggtgtgagtttcctgcaccagagcatgccagttggtggttacacgtttgacccttggacatgattttagggggagtggggatggcctcacctagttttattttttaattaagaatttttttttttttcagagacatggaatcttgctctgtcgccctggctggagtgcagagtggtgcagtcacggctcactacatcctcaaactcctggtcttaagtgatcctcctgcctcagcctccagagtagctggaactacaggcacacaccaccacaccctgctaatgtttaaaatttttttgtagagatagggcctcaccatgttgcccaggctggtctcgaactcctggcctcaagtgatcctcctgccttggcctcccaaagtgctgggattataggtgtgagtcactgtgtccaccgtgctttcacttagttttaaaagcaaaaagattgtgaacatttgcagacacagggagattacccaccccgcccccgaaattccagattttcagctgcattaaacacattgcaaaattcgtgcatcctggctgctcatttccccatgagcagtcactacccccgacactgggtagtggctgctccttcagaaggaaggaccctgtcccttcaccacaatgcccagtgctcgaggctgtagaccccatcctgagggtgtgtgttctatacatgcagcccctccacttgcagcggcccctcccagcctctgcgagcgctggcgtgtgcactccagggctttatgttttccccgtgttgccttcttaggctctgctgcctaggctgtgacaaaggcatccctgaagagagttgttcaaaaaagaaagatagcccttgtgacgggtgagatcatccatatgttacccaataaaaagtcaaaggcttgaggggccctttgagttcactccagagaaaggtgcagcagcctcggctcagtgccccctaggcctccctgacgttgcacggcggcagcattagattatctcactgaacaaggcccgtccctttgaaatagcagtaggatgggaatgtccattaaagtaaacagctgtgcgttctgagaagcggggacactttgttctaatggccagcagttccttttcctgtttcttggttgcctatcagttctttcagatcgccttttcactttgaaaatgcaaaattaagtaatcccagttatctctgtttaagcgggtgcttcagtgatgtgatgacttgctttcaaaagctcagtgaggccgcgcacggtggctcatgcctgtaatcccagcactttgggaggccaaggcaggtggatcacctgaggtcaagagttcgagaccagcttggccaacatggtgaaaccccgtgtctactaaaaatacaaaaacaattagccgggtgtggtggtgggcacctgtagtcccagctacttgggaggctgaggcagaaaaatcgcttgaacccaggaggcggaggttgcagtgagctgagaccgcgccactgcactccagcctgggtgacaagagcaatactctgtctcaaaaacagataaaaaagctgagtgagaaggggtgaggatctgggcaggtctgcgttctgtgttggctggaagcctgctggcggtgctttgactaaacaattcttgatacttctaagatggacttgaggccgggcgcggtggctcatgcctataatcccagcattttggcaggctgaggtgggtggatcacctgaggtcgggagttcaagaccagcctggccaacatggtgaaaccttgtctctactgaaaatacaaagattagctgggcgtggtggcaagcatctgtaatctcagctactcgggaggctgaggcagggagaattgcttgaacctgggaggtggaggttgcagtgagctgagattgcgccactgtactccagcctgagcaacagagcgagactccattgatggacttgaaagaccaggaatatggtacaggttttgttttttcctcctgtagtgctaagatgaaagcagggctttagacaacgtcgcttatgttcgatgattctttttctctctgttcatcctctccagaaacattgcctattgcattgcgaccagcttttgtataggaagggaagaaacagatatcatttgggttttgtcatcagtgagatgctagtcttgttgtgggatgagaagcataagctggtaactgtcagcagggttaggagcagatagtggccatgtgctccaggcactagggaggctgggagatgtacagagtcccttggtggagacggtggggttcaagatggcgtcctgagggctgaatgtgggcgagctgggcagagtgtgtgcacagcagcgatgggggtgcatggtgtttccagaggggacccagtaaacaaagctctgcaggcaagaaagaccactttctctagggaggaaggacaaagggcctgttgttgcgggtgtgtgatgtttgggcagggtggggatggtgtccagaacagcaaggcttgttttacatggtggtgagtaggacttgattaaatgcagtgcctccctccctccccctcacctgatcaaactgctcttttgcgttgctgctagaggcgagagagaagatgatttgcgtgaggaagacggctgcctgtttcctgccgtggtaaatggattttacagggcaggaggttaaagcgtgactttagaggtgccttggttttgttttactgttccacatgagccatgggtgaccatttctaatacgttatcctttctctggaatattggtggttctcccctgggggcagttttgtcctccaggagacatgtggtaacatctggaagcatttgaattggtcacaactcggggcaggagggtgctactggcttctagtgggtagaggccagggatgctgctgagtcccctgcaatacccagggcagccctcacggcaaagaatgatccggccccaaatgtcaatagtgctgaggtggaggagcgtggtttggagtgtcctattgtttatccatgttttatctattggacatttgggtaaaataacccatttgtagctcttacagatggtcctggtatgcacattcttctgtgggtcttgtggttaacatacatgcacatcactgagtcacttggtctgttttcccagtcatgtcaatatttttttttgagacagggtctcactctgtcacccaggctgcagtgcagtggcgtgattttggctcactgcaacctccacctcctgggttcaagcgattctcttgccttagcctcctgagtagctgggattataggcatgtgccaccatgcctggctaatttttgtatttttagtagagatggggtttcaccatgttgcccaagctggtcttgaactcctgacctcaagtgatccgcccaccttggcctcccaaagtgctgggattacagacatgagccaccgtgtctggccactcatatcaattttggtattcaccccgtattcaggagttgaaggtgtaggaagcagcgcaaatggacattgacagacgagtggataaagagaatggagagtgtacatacagtggaatattgctcagcctcaaaatggaaggaaatcctgttacctgtaaccacatggatgaaccttgagtccatgatgttagctgaaataagccagtcctacaagggcagatactgtatgattctacctatgtgacatatctggaatagtcaagttcacagaggcaggaataaaatgcaggttgccagaggcaatgggggattgttcattgggtactgttgtggttttgcaagttctagagatctcttacacaacaatgcgattatagttaatgctactgaactccatgcaattaaaatggttaagagaacacatttgatattatgtttttgttgatgctgttgttgttagagatagggtctctctctgtcccccaggctggagtgcagttgtacgattataactcacggtagccttgaactcctgggctgaagtggtcctcctgcctcagcctcccaggtagctgagattacaggcatgtgccactgtgcctgactaactttaaaaacaaaatcatagaaacttggtttcattgtgttgcccgggctggtctcaaaactcctagtctcaagtgatcctcctccattggcctcccaaagcactgggattacagatgtgagccaccatgcccggcatatataatgtgttttttaataccacttaagctctgatttcctcgtgttatgatgaaaacggatactttgtcactgtccctgagagtggagcagcatagcctaggttccactggcagtttggacatgaagaaattataacaacagcagaataagttgtaactgtacttgtagcatactttagagtttgcaacatattttcataattgtttcactgttatcctcctggtcgtcctaggatgtaagacaaccagctcttaccaccatttttggggtgataaaaccaagagtaggaagcatttctccaaattgtgtacgtaagtggcagaggcaggtcttcagtaccagatcattcctcatcttttgaaacgctccgtgcccccaccctctgatgtgattattccctcctgtctgccaccaggggatcctgtgcatgtctgtcactgcacttgcctcatgggatttgtatcagccaggatctagttaggagacggaagccacacagtagttggaacaggagtgcttcataggaagcgggatttcgtggactgaccaaatcccaccatgcccccgtgcttacggcttttctgtttacagaagcaaggttgaacagttgcacagagatcgtgtacatgcaaagctcaaaatatttacattacggctctttgtgaaaaagtttgctcacccctaatgtaaagaactattaacttgtggcagtttattatctattatcgacgaattattaactagtagctactataggtaaggagaactctaaagaatacgagaatagcagatagagggagtggccactccctccagggctggggcacagagtacctgaggaaggaataaatttggaactattctccccaccccctccaaagctgagattcgaatctcgatggaagatggctcactaggtagtggagaaagtcgctgagggccaccgctggctggagagtagggagccacccccggcatgccactgaagctcactaggaagctggctgggggtgtctgtgggactcggtggaaagccaccgaggaattgtctctaaaagtcgctgggaagctgcccgccagagcaccagtggaacttgctaggaggccgcccttggagcttagtgccactgtgtgtgccacatgactgccaggtcccactggagcaggcagggaggaaagcacgctggaatgatgaaggcaagccctttccaccgcccgcgtgcctccaccgccctctgctgatggtgctcaccaggtgccagcactggagaaacgcccacagggtcctgctccaggatcaccatgtgggcagtgaaggtgcatttgggatgcagaggcaatgcattgctaactggcaatgttgcaacaggttgtcttcagagctgcactgtaaattcctctgacacacgatggtgttccagaaatcctccctgaacgttgctccccattaaccatctcttaggtggatctcggcctgtgctctgtgaaattcagggctgacatggtggtcaggatttggccaagtcctgaggccccaggatctttgctacatgtggagaggaggcacacacctttgggctctatgctgacctccctccaagaagactgtcaccccttgccacagaatgcacactcttcttccggtcccgtccagttggcctgcattctgacgctgcagctctcacctgcccagggcacattccacccctgcccgtttctcccagtcactcctgggacagtcagcttgccttccgttgctctgtagaaatgctgtctgccaactcagtctccaccacctccagatcttcacctcatctccctccacatttttgggagccacatgcccccttttcacctagccgatcacccagccgtaggttttctgtcatgacactcccttggcctgtgtgtccattagcatggctttgtcacctggtgcagccacgtcctcgtcctctcctcatgcctcatcctcgcgcctctccttgccatggtgcctcgtgtggtgcagccctcattttagggagagatgaaacaagggctagacctttgtggactgaatacctccttgagcatctagttccaaaacacacgaggagggttttggtttattttgttagtgttatttattatttttttttggggggggtgtatatttcttaagagatgggtgtctcactatgttacccagacaggagtgcagtagctcttcagaagcgtgggcatagcacactgcagcctccaactcctaggctcaggtgatcccgccatagcctcctgaggagcttttttgtattgtattatcatttttcttgctttcttactaattttgtcaactatgaggaaaggaattttttctttcctaatagagattttattgatactttggaagatcaatacaaagctgtttcaatgtgtatcctgttgttaatgtccttacagaaaatctaaagagctgtgtcattggattcttttccaggtactccagcgaccttctagctgaaaacttggaggcaaattttccttaaaaggccaggaattaggattttttgaagtctcagcacctttgggtggtggtttccatctttaggagcacgagtctgtctccgggcgaaacttcagtgtagatgcatgttctcaggatatttcacaacttgctgccttgctggatgggtcacatttccttccccaagcgccggtaccttcagatgttgacgagctgtcacatcagaagtcacagtcactcaccgttatcagcaacactgcatactcaagttttcagcctttcatagcacattaacagagagattaggaaaaccgactgccacgaccagaagactttcagggtgcatgcctctctgatagggagagccaggatcaaggagtccttttccttccgaaacagttctactaaaaaacaacccatgggctcacacctataataccaacactttgggagaccaaagcaggaggtcaaggtagtaggattgcttgaggcctggagattgagaccagcctgagcaacatgctgagacctcgtctctacaaaaaataaaaataaataggccgggcgcggtggctcacgcctgtaatcccagcactttgggaggccgaggcgggcagatcacgaggtcaggagatcgagaccatcccggctaaaaaaaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaataaataaataaataaaaataaataaataaaaaattagccaggtgtggtgacacatgcctgtagtcccaccttcttgggaggctgaggcaggaggatcgcttgagcctgggagttcgaggctgcagtgagctgtgatcgcaccactgcactccagcctgtgcaacagagcgagacccagtctcaaaaacaaaaagcaaacctatgagtataagtaatttaagctgctcaagacatattaaaggcctgaccatgactgcaaattgccagtcagtatgctttgtgctgtaggatatgaaaactgtccacccagcctagcacccaagacagtcaaagcctctcataaaatatataccaaaaaacaactagcaaatgatttcacctcttttaaaaaaagcatttatgcttaaaacatggaattaggtgggattctctccttaaaaatgtttacagaactactaaaaaacttgcatttacaaaacagttgctgaaagtattcccctggcatatatgggaagggagacaggggctgctgagcagtgtatgatagtaatcaggtttctttccctcctgcttcctgggagcctggactctacttgcatttagactccgcttcctgcaggtcaatcttcaggttcctgctgagccacttcagcccatttgccctttgctcccccttttctcttttgtgctttttttccctaaggatttatcctttcctgctgccttttttttttttttttttttttttgagttggagtctcgctgtgttgcccaggctggagtgcagtggctccatctcgactcactgcaagctctgcctcccaggttcacactattctcctgcctcagcctcccgagtagctgggactacaggtgcccgccaccacacctggataattttttgtatttttagtagagacggggtttcaccatgttagccaggatggtctcgatctcctgacctcatgattcgcccacctcaccctcccaaagtgctgagattacaagcgtgagccaccgcgcctggcctcctgctgcctttttgggcttcatttccacttctgcagaagcaggttgagccgacagcctggcggacctctgggctgtgccttggccacccctggggctgacctgaccttccccttgggcatcttggcggtgcctggtgcctgctgcccaaaagccttatgaatctggatgcaccgcaactcccttccctgccctggcctctgggaccacagcaggggccaggaattttttttttttttttttttttttaagtctcaacacatttgggtggggatttccatcttctaggggcttccctgttatcggagcacaagtctgtctcacagagaaccttcagtgtggacaaggtgttctcatttatttcccaacgtgtctctttcctggatgagtcaggtttcctttctgaagacgccgagctcaataaattaagcagactgagaggtgacttcagtgcttgtcctcatcatgcagatattttatctctggaaagcgaagcattgttgaggtggtcagaattgatcaattgcaggtgtgactcatagcccttgaaatatgatattggacttaaaaaaaaactgctttctctcctctcattttgatttctggtcactgtgattttccaaatccctcaagctgaaaaccctgcggcaggtgacatgtccagatcttccttcccagcctctggagttggtgcattactcccgtgatttttctctgcctcttaccccaggagttctgcagagatgtaggggtagtgcccatcagggtcgttgtccttgtcgttttattcttattgccaaataaattcatttgtgtgtgactataagacgagtcttccagaagcagctgctgtagtgatgagttcactcctccactgccatggctgccttcgctgggcccccactgcctgcaggacagcgtccagattcccattccagggcggggtcctcgtcttcccccacttcggccctatcttcagacactcccctgcacacacactcatgcctcaggcctcctgcctccacgcccttcttcacggggaagcctctgcggaaggccttcccagctttttctagttgccgtttctatttggaggccttcttatctccacccgagacagagggtcacatccccctcatgctgccactgcagggaccccattcttttcagcgtgagcctgctcccccgctgcactcaggatgcccttgcccttatgggacttcatttggattgtctcttcaacgaagtatcaacaactttgttccataaaagactttgattaactgtttttttcctgctgttcctagagaaaacatttccatgagaacaatgaggcattctgcacgttaggagacgttgaactctaatcggggccataagagtgagtttccacacagaatatcagttaataactaaaacaacagtatttgcccgggtgtgtggacttggtgctttgggtctgtgagtgcccatagcatggcacctgggccggcatcgtcatgggtcggggatgattgacttcctagctttttgtagaggggctttttgaggttagagcaagtgagagcaaagatttttcctaagtactacaggacagaacttcctcatttgtggctctggcactccacagacattaagcggctgtcactaatcggtgcagtgccaagtgcttccttaccttgtagacctgggactgtgacaaaatgagcatcattgtgatgctatcacgcatgcggcaccttccctaaggtgcctaattaagcctaattaattctactgaacttgagaagttcagtggggcaaagagaatagaatggaggttttcaaagctgctgctgcttttctgactacttttccccatagcaccataaacatgtagaggtactttatctggataaggaagccaggggaaaaaatgaagacttttatctcccaaaccaaaacacatttttgctgggaaatataggtggagtgtggtgggggaaggctgatggatgttgtggaatgcgtccttcatatctagaggggaagctttaggaatccttgcagatgagaagaaacagcatcatgttgtcctttgcagtgaagtcagagcaactgacagccctttctgagagtccttcaggacttgcttacacacgtgcttgtgggaatgagacacattcccaccgaaaaccccacccggtcaccactgagtcagacacagaactgtgtcaccctgaagaagtgctgcttcaaaagctgtcccaagaccctgcaagccatgagtctttatggttttgcctaaagattttcctgtgatacttaaattcaaacatgtcattgtggagagaaggacacaacttcatttatttttatttttatttttatttttatttttattttatttatttatttatttttttagatgaagtctcacgctgtcgcccaggctggagtgcagtggcgcaatctcagcccactgcaacctccaccttccgggttcaagcgactctcctgactcagtctcctgggtagctgggattacaggagcgtgccaccaagcccagccaatttttgtatttttagtagagatggggtttcaccatcttgggcaggttggtctcgaactcctgacctcgtgatccacccacctcagcctcgcaaagtgctgggattacaagcgtgagccaccgtgcccagccttttatttttatttttttgagacagggtctcgctctgtcacccaggctagagtgggttggcatgataacggctcactgcggcctcaaccctctgggctcaagtgatcctgctgccttagcttcccaagtacctgggtgcctcctgagtagctgggtgccaccatatctggctaattttttaccctttttttttttttttttttttttttttttgtagagacaggatttcttttgttatattacccaggctagtctcgaactcctggaatcaagcgatccttccacattggcctcccaaagtggtgggattccaggcatgagccactgctctcagccctagacacaattttaaagttcactatatatcactcttatactgggtcaaaatagtttccttgattttattttaatttttttaattttaatttttcaagacagagtctcactttgtcgcccaggctggagtgcagtggcatgatattggctcactgtaacctccacctctcaggagcaagcaattctcatgcctcagcttcccgagtagctgggattacaggcatgcgccaccatgcccagctagtttttgtttgtatttttagtagagacagggtttcaccatgttggccacgctggtcttgaactcctgacctcaggtaatccgcctgccttggcctcccaaagtgctgggattacaggcatgagccaccgcacccagccccttgtttttagatattgaggaatgcataactttttattatggtaaaatacacataatatgaaacttatcttcttaataattttcaagtgtactgttcagtgatgtgttaagtacatttacattgttgtccaaccatcaccactgtccattttcagaacttgtcatcttcccaaactgaacctctctgcctattaaacactaacttgccattccctcctctccccagcccctggtaatcaccattccactttctctgtctatccttttgatgactcaggtacctgaattcaatcgtatagtgtttctccatttttgactggtttatttcacttagcataatgtcctcaaggttcatccatgttgttgcctgtgtcagagtttctctccttttttaaggctgaataatattcccattatatgtgtatgtatatgccatattttatttatccattcacctgttgattgacatttgggttgtgttcacctagaactcataattgtttaaaggcaaaaacaaaataaggctctgtcctttgaaatttattttttattgttgttgttttttaatgcaaatttatgaaaaaagtatcaaggttttttgttttaatttttgtgagtacgcagtaggtgtatcgatgtccttagaaatttgtgatgatagaattatactttgtaaatgtgcatttttgctcatgtttgtaaccccagcactttgcgaggccaaggcaagtggatggcttgagctcaggtgttagagaccagcttgagcaacatagggagacccccatctctacaaaaaaaataaaaactaaaaattagctgggtgtggtggtgcatgcctgtagtaccagctattcgggagactgagatgggagaattgcttgagaccgggaggtgcaggctgtggtgggccgtgatcacgccattacactccagcttggatgacagaatgtgaccctgtctccaaaaacacagtgcatttttggacacttcaaaatacaggctcaattagttttctaagcagttacttcatcagcatgtgactggtattatttttctcacaattctgttactttagtcaatatttttatgctttgctttactacgtaaaatgttggattcttccccttagtaattgtctatgcttttctccagactcattaaaggtataaattaaattctgagttttacaccatgtttcctttggcagtggaattaaaattgggaaaaatcatctatattcatagagattaatggtgaagtctcttaaattagatacatgtctataaatatatattaattgttttcttttgctgctttactctggagcaaattttccaaaattgtaacgtgaagtacagtttagaggagaaacatctactatcagaatgtacttaaagagaccaatcttttcacctctttgtagtaaattggatgtttacattgtcatgagggtatctctcttggaagaaagaaattattctttattctgaggtcagttatagacagtttcagctaaaaattatgaggaactgattggttatgtctaaaactttgagttgggtttttgatacttgacttgttttgtatattcgtgactataattaatagcatctgcatggcaggtaagctatgttatccattgtgaatacaaggaaacgaggaaaaagagaccagaagtcttagggtccggagttggcagccatggatataacacgtggatagaaaaacacttctgtggtctttcaacaaggtggaattcccgacaggcaagaaaagccactaaagacccgaaggctccaaaacaaaagaccagctccaggatgccaagatcttccttggaatccctggacccccagatgtctgtaacttgcctccttatacacacctcatttttactgtctttcccaccctgcctggatactcttatttggttcagggggcaatagaaataagcaaagtcagccacatcaacacttaggctttctagcatcgaaatacagatgtgcgggcgtcattccagccacagcacttagcagtgacctagagaaacagatagcgcccttcatctctgatccatcctcctgaggcacagccctggaagaagcctttcctctgtgaagaaacctggggggagggttgctccagatccccagcctcctggccggccccttggtctccctcttggggcatgtcgaaacccagtctcccccaggtatcgcctgccttttgctatcccttggctgtgtgtgcaaccttagtgggtggaagcttatttacagtctgtaaagacatcaggataaaatcgtctagaacttttgaaaccagttggtgactgaaaaaattgctgcatatttttgttaggagtgctttttaaaatttgtttatggtattgactagcagtgaataattgctttattcacaaaagttcacttgtcctcagatctaggtggagatttcaggaaaatatgcagcttcagaattgaggcattgtaagttacttagcacctagcttctcctgaccccccaccccaagaagtaagcttgaatccaaaacacttagcttttcaactgccagaagaatggacggcattagcttcaggctcactcttggaagttgttcttgggttagccatgacatgcagctggctagcagtggattcaaaggctgtatgctgatgtgcttgtaaccagtgatttcttctcactggttttcctagcagtttataaagctttttggtgtaaaacagttggcaaaccatttttggaacaagcccagtagtaaatatttttggctttgtgggccaagctactcaattctgccctgtagcaatatgtaaaccaatgggtgtgactgtattacactaaaactttgggtggtgggagggggaaagaaagctggctggattggctcactggccacagtgtgccagaaaatggacagattaactggaatgaattgctgttgagttctactttactgtataggaaaatctaggttaataaaagttacagaatgtaggccgcgcacggtggctcacgcctctaatcccagcactctgggaggccgaggcgggtggatcacgaggtcagaggagttcaagaccagcctggccaatggggtgaaaccctgtctctactaaaaatacaaaaattagctggacgtggtagcgtgtgcctgtaatcccagctactcaggaggctgaggcaggagaattgcttgaaccaggaggcagaggttgcagtgagccgagatcgcaccactgcactgcagcctgggtgacagagcgagactctgtctcaaaaaaaagaaaaaagggaaaaaaagctgtagaatggatggcattcaagctgttacggagtcagtcaatacacattgggaggatactgtgtttagcactgagtagtgaatatcttaacatacacggcatggtataataatcggattagggctatgacaaaaaacagatacgtgttagcaaggatatggagaaattggaaccttcatacaccgatggtgggaatgtaaaacggtacagctgctgtagaaaacagcctggaagctcctcaggttgttaaatgtagttatcatagggcgcagcagttccactttataatagccaaaagtagacactgatgaatagataaaatgcggtctgtccatacaagtgaatgttactcaaccataaaaagaaatgaagtactgctacatgctacaacgtagataaacttagaaagcatcgtgctaagtgagagaagccagacccaagaggccacatattgtattactccatttatgtgaactgtctaggacaggcaaattcatggacacagaaagtacatttgtggttgccagaggctggagggattggaaaccgagtagtaatgagcacaaggtttctttcggggttaggggaaatgccctaatattgatggtggtgatggttgtacaactctgaaaatactaaaagccatgctttatttgagtgaatatatggtatttgaattacatttctataaagctattacaaaaacagtctagttccaggattaatgtatgagaaataattaataagtaatttaaaatggtcaaaaattattgtctggttaaaggagatctagaaaatgaatcagtatcttcaggtcccctgttttccattgtgtgtgttctcaagctttcccattccctggataaacaggagtcgtgtccagggaaggcaggccagggtgaggggtgtagtgcatccctgatcccctgagtggtaataaggtcagcccccagggcccattcccgccaagtgtgaggtatgtctgctgcgttccgaggacctgctctgcctcaggaattgctgctcgtggaaggctcatggaacatgcttctctgttacagattgaagagggcagtaaagccgcggcggtcgacaagttactggctggagatgagatcgtcggcatcaatgacattggtctctcagggtttagacaggaagcgatttgcctggtgaaggggtcccataagaccctgaagctggtcgtcaaaaggtaagatctgagcttcctcccacatttaccacgacacacaggaatgagtggaacatcaaagtgggaagccagttgtcctgcccacatcactacagagatctcgattgggacatgcacttagagttatatgtctcggccaagcatgggcccggcatcaagagtctgaacggttcctaattttattacgacgatttttataaattttaatgtattaagtggatttgaatactcgtatctttcctttgtttatatgtagattattttcttggcaggcagaaaacggtgcttatgctcccagtgaggtgacatgttgttgcctgtcttgtacacaaggtggcaggccactgcgctttctgttttcatgctagaaagagagtgactgtcacgaagatgccagccaccaagggtttagagcactgtgctgaggtctggagggagggtctggagggagctgtctgtctattcctgtacattacgtgtcagttggagcttggatggttttaagaggttagaaagtgaacttggggacatgatgcttttatatacaggaactaaagcaatactccaggtaccacaagagtgttggtgatatgtcgctttcaaagagaaataactctccaccttggttttaaagttggcttattaacaggcaagtgcttacacatccctcttgacaaaattagcatgttcttttgaaggctggctgtaaattttaattaattgacccacatttatttccatttttagtacagacatgaagatatcttccttgttttgaaaaaacaaaaatttttttttcaagtctggtcaagtgaagtagtgtgcgtggagaggaacaaagaaatctgtaactggttgtgactaattatttgtaaacaccgctgcactcaaaccagccaagacaaattcctaaaggcttttttgaagtgggggtgggtggagatgccaaaacagtatccaaagaaaagattcagaaatgaggaagggccagacgtgctggctcacacctgtaatcccagcactttgggaagccgaagcgggaggatcacttgagcccaggagttcaatcgagaccagcctgggcaacatagtgggaccccatctctctctcaaaaaatttttttttaattagctgggcatgatgatgcacacctgtggtcccagttactcgagaggttgatatgggaggattctttgagcctgggaggtcgaggctacaacgagccatgattgtgccactgtattccaggctgggtgacagagcaagaccctgtctcaaaaaaaaaaaaaaaaaaaaaaaaaaaaaaggggaggaaggaaaaacattttttgcctcatgaatttagcaaagtcaattgtaagtggtacatgctattcctgagcacccttttaacaactctttgtagatcagaaagtaaaatctcagaatggtggtttctgagccattggggagggtggggcacaagaggcaccatgacactgtgttatggttcctctgtgatcaccgtcttaaccctcctatagcagcacgtttgttcttacacgattcagttaacttagtggaatgccggtggtggtgagggaagcttgttctgcagaggtaagacgaggagttataaattggctctgggggtcatcatcccgctgccaaggctgactgcaactcccttttcttctgtctcctgtactgtctcgttctgggctcccagagaccccaaaaacactgggctgtgcttgtggtcttactgtgtgtctcttctttgatggagacaccagcttagtcagcatagctggccaactttgtatcaccagggcatagctatgcgtagaaattcctagcatgggagttcctgagtcggaaggtgtgtccgttgtgaatgttcagagacatttctgagtttctcagaccctttcacatcatctctagcataggatatttgtagtttgtttgtttgtattctctgaatgtgataggtgaaatatggttttctatttacatttgcatttccgtagttatgggagtgaagtcaggtatcattccatatgtttagaagcaaggtagatgtgattctttttttgagctagaagtacatatttagtgataaagatagacagtctaaaatctgttcaaaggaaagccatgccacaggagaactggttggtgggaggagagagcgaagcctcagggcatctgctggctggtttcactgagtaggtacttaaaagactcttgggaaaagggattaaacttttgccctgaaggatctccaggagccactgtgtagaatccccattttgtgttctgcagacccactttcctttaaatgagagatgtggacaaaatgataatgtggtttaaatagaattttatttaagtagtatgtgtaacgagatataaagcagcggagtttatttacaaatttttatttcccaacacactttcaataaccgtgttaggaaaaaacccacaagctgtttttcctctgctctcacacaacactcaacacagaagacttctgtgaccaaatgtgcatagaacttctaatactccaactacctttatgtggttttccttactacaaaagcaccaatgggtgctttcaaaattgttcttcttaaagccagaacacgtattcttctctatctaaatttaaatctctatttaaatctccccgccctcctctttctccattcctaggcaaccactaatctgccttctgtctctatggattaggtagcattttctggcattttatgtagagctccaggatggagcatgtacccttacaagtggctagttcatgaaaggaactctgcaggtagttcatagattgagacaccaacatattcatattctatattgctctgcttaaaagcgtgatcaaatggtaaactagcttgcccaagccttgtttgacttgttgcaattgtctgcccccatctgcaaaaatgtgatgagggaaagaggtatatacatctctgtgtaaagcacaggaatccgtggttttttgtttgttaaagacaggttcctgctcttttgcctaggctggagtgcagtggtgcgatcatagctcactgcagcctcgaactcttgggctcaagcgatcttcccaaagtgctggaattacaggcgtgagccgtcgcacctggcctctccatggttttttaaacatgatttgaatagtggttcacggataaactcccctccctgtagtgacagctgctacacgtcttattttgtaggctcattttatctttgtatgtgtggggaccaggggaccaggcagccaggataggattgcgatgggccactttcacaaagcggtggcatcttgtttcacaggcatgggcaacgtggaccttgtggtcgttgagaagctggtgctgggaaagcgatgcgggaggagacaggcggatcactatctccgcagacaaatgagggccagcgcttcctctcgcccagggcagtgggagctggagacaaagaacttgtaacaatcagccctaccaagtgcatgtatgttcttccttgtgaggtccaggtggcatccacggcccgagatgtcaggggaggggtgctgcccaggagtcagatctgtcggttaggtcaggaggagaggctgaggctggcagttttgcttttctctttcttcccaggcggtttgttgttctgtctctacttggcaggggagtgctccttgcaggaaagttcagggcagacatgtagccttttattatgtgtatgtgtgtgtccagtttttttccactgcactgttttcctaggtgcccaggcccacccctggagagtcctgggcaggtcttgaatggatctgggctctggaatcttcacacagagccacaggctatttcgctgggcattagcagcggatctaccgcttgctggccttaagcacaagttcttgggaaggttaaggccagaaaccgggtgaccctttggcattttcctcattaacttagcccagttgggttagtgcaaaagggaggtctgcctgatgccctcaagctgctccggaggagaggaagcagggttgggagggtggggaaggaccgagaaggggacggcagctcctagcttagctgggctcatcctatccactcggtgccagggaccgtggctgttgcctgttgctgtcttctctctgaaatctgcgttaacagctctagggacagagtcatccatttttctcccttcagaggcaaatggctgttaagttcagcttctaaaaagcacctgtaatttcaaacaccctagggaaaatttcttttaaatatcacatcataaattattttctaaagctttgcaattacccttttggctttttccccaaatatgcattataatattagttttgtttacagcaaatccacctgccaccttgtcacagaccccactctgggcagtttctcttgaaccggtcatgtgttgcgagtcattttgtgggggccaaatcgtggatagggttgattcatgtcacttcctgcctctttgctggcagccctaaaccctcttgtgaatctaattacatccactaagcttgcattcaggagcagcttagcagcagagggaagggttttctgcatcaggctgcaagggtttgcgagaccatgtggtgtggtcctgcatttgaagagaagaggctgcatgtcgagggagagcactcatgtttgctaggagctggtttcttacaacatgcgtcccgtcttgggcattgctaaggtgccctgactgctgctccaagcccacattgtgctgtgcccccctctgctgctggctccttggagctgtcctggagcaggtggccctgcagccctaaggttgattagcacagatgttccgggagctgctactcgcaacggtggcagcagtaaggggccgcctaagacgtcagcaggtttacacccccaccccactcccccagcaccccaccccctccagaactactcctgaggcagaaatggtgcatggtcagatggagggcatgctccttagtggggacactggaggacgtcaggtgaaacccatgccttcgaggctgtctgatgtctttgtctgtgattcaggagtgggtatttctattctgtgagcatttggggtctaatggctgtttgctactgtgcttattttcttgttaaaacaaaggagaccctgactggtttaggctattttccattattgtttttatttcatttatttattttattatgagtgaaggaaagaaaggagagagggagggagggaggatgggaaggaaggaaggatgaaatcttgctctgttgcccaggctggagtgcggtggctactgacaggcacaatcatagctcactgcagcctcaaactcctgggctcaagtgatcctcttgcctcagcctactgagtagctgggactacaggtgcatgccaccatgcccagcttattgtttttatttttttttatttaattttattttttctatttttttgagacagagtctccttctgttgctggagtgcagtggcaagatctcggctcactgcaaccttcgccacccgggttcaagcgattctcgtgcctcagcctccccagtagctgggactacaggcgtgtgccaccacacctggctaatttttgtatttttagtagggatggggttgcgccatgttggccaggctggtcttgaactcctggcctcaagaaatctgccccacttggcctgccaaagtgctgggattacaggcgtgagccactgcacccggccagcttattgtttttattaagtaaaatcaggagaaaaaagaaaaccacatagatcagaattgttttattttggggaaagttacttctattggggttttgccttagtgtgtggtttagctaatttaatcagatgaatcaatgtttgcaaatagtgatggtttctaatatagtaagacttacagagaatgtttagcttatttttgtgttgttttggggtctctggaggacctgtatgtgctatgcagtgggatccacactgtacaggttaagtttattttgaggttcaaggaattgagaagttagcattagccttaacgatgaagtttaaatgacttttatttttttatcggttccacaaatgatgtagacttttattttttaaaacagagcagctgtaatgagatccaccaaattgaaagccctgagctttaggagaaaaggttgatctacactggttgaattcccagtttgctattggcttggaaagaagagtgttctggtgagattttgagagcagactctgggaatgtcctctcttgagacttgagggcgcagggatctggggacaggtcttggtgtctgtcatctgggaggtagtgtcctgcgagaggcagcagcccagcagacaccaagggcccctgggatcacgtgctgacctcttagtgggcttagcagggcaggaggcccacatgtggcttctgtccagtgtgccactcgcccttgcagtcacccctaaaggacaggtagatgaggcctttgcaggtcgagacgtccccaaaggctctgtctgtcccacatggagcacactgagcgggtcccctctctgtccatcccgtccttggctgtggtggcactggcacgctgtggcatgctctgccctgcactggccgctttgtccagatggagacaaacgtgctttcagtgtgttgccaaggggcagggagaggtgatattggcagagccatgagcgatggctgcccggcaggtcataaaggcggagtaaatgtcgcctcttcttagaactgtcacctcaagcccggttaccactaacacccattggttccaaggtgggagagtttgggggaagaaatgaagtacccgacacagccttggccctttctacaaagtgaggggcataccttatctgtaacaaaagcctgttttttttgttgttgttgtttgtttgttttaatgtcacttgctaatttattcacacaaagaaaatgctccataatgaaaacaacttcatcccatgtctccctcccacccacacacactcaaacccctcctgtccccaactgcaagatgcgttcctacgtcttggctatctgaaggtacttttagaaccaaatcctcataaaaaccatttagaatagttgcctgataacttggttttattgttaaagaaagcctgtttgtggcagttagagtccaaaggcctttggaatggaatggagtggcatgtttaaggagagtgctcagaaggctttgctgaatggtagtcatgacagcattgatggggaggtgaagtgggctgattaaataactcgagtagttccgacgtccagaccatgttttggtaaggtagccagcgtcatggacagggcaggtagcaacagttctctgcaccacggagggtagttgtaccatttactctgctggttgtgggtgtgcttgcctttaatagtacggaaagcaaggtcattggtctgcagttatagtaaatgacaaagaagaggaaggaatcagatctttcttcagtgatttcactactttgatttgccaactatgacatggtggtttattaaatgtaaagacacagaggaatgttctctggctcaatgcccttgcaaagaaaaggatgcctgccaccctctcggtgagatgataagtgatcaaataagggaagatttttatcagccattcggcatatgtcgatcccatgtgagtggacgtctggcttaccatagtgaccacatgtgcagtggtatttaatagttctctgaatgtgtataggatctgtaaaaagtttggaataaaagcacaagcttcctttggagaaatgtgatttagttgtaatagcatttcactactgccacattcagttcacctgtggtggtagtgcctgtaactttgcattcagaggaattcgtggaccttcctccctctgcctccccgattttgccactgagtttcatctcttttcatggtctgggctcaatgtttctttgctgtgctgtgactgtaaagtctcttttattggttactttccctaaacctcgtatctcttctctataccttggtttttgtttttctatgaagagtatcttcttaactcttctagtaccttgagtaaccatgggctctgggaagggaatttgaggacaaattgagtaaaaatacagtaaattattatgggctttatgtaatgagcagaacatcagaaagggctaggtggggatattgtttgctgagctctagtgggcagaattccacaaagggctaggggagattgtttcttgaaatctctttcctttccctttgcgtctatttacatggctagagcgctttatacatagcatagcatttagagaacagcagtctgcaatcccttgttgcttttttttttttttttttggtatggcttttgccatgtgtatactgatatgttgactcaacaagttaaactttttgtgtcttttttcttatatccgtggtgttcatccttagggctatataaaacgagtcatattaatgactgcacacttgaatgtgctgagtttctttgccaacaaattcattctgttgaaacatagccaggaaattgtgtgggtgccctttttaaaacatcaagctgaatgaaatgatgatttgacacctggggcatatatatggttgaacacaagtggtttggatactgggacagcgatcgtctttttttttccttttctttccaacagtaatgggtttatagaaatgaacattacagaggttaatgggaaaaacaagtcattcgggtctgctccactcctctgttctgtgccgctcggttctgcctgtggcttctgtggcattcctctgcagtcttttctgccataggacccaggttgaacaccagaggtggaggccagaggcggggcacgctcttgctaggggtgaggcaggcaggctggccaggtggagagcaactctggggctctcaccccacgtgaatgctgctgctgggccctggcgtttgcttacaatgaggctctgatgtctcagtttcagctacttaggtcatttgggaatttttatcttgcctcagttctcttcatgtttaaaagcaggaactacttgcctcttatctcctaggaccatagactttatcagacatgatgtcaccattcacgcaggcattgccgcaccactgcctgggaaaagacactgcatataaatcttcccacagtgcctttagggggcgacttttcttatagaaaatacatgcagagttaaccatttctagagtgctctggcgtacttgtatacattcatgtgatgtatgtgagaagcactcccaccacgtggttaaaatcattcctttaggtcccgtcttccaggagcttgcagctgagtgggctgaagagctctcacaagtgcggactcagagaggaaggaagggtggaagttgatccaggaaagtctttgctgaggacaggccagcggagcgatcctttgtagctgagccagttttgagaggcagatataaacgtctgccagccatactaggtgctccaaagctggaagccatagctggaagttctagtgagaacagtagagggggaggcttgggagagggaggtggaaacgtaggatggggccagcacccagtggctcacacacagctgctcaggtggtgcagacactcctgtcccactgcagcccagacttccttggtcttggggaaatgagaatttgctttatctgccaagaccctagatgctacagacgctgccggcccagggagcatgctctgagaacccctggactagaccacagagaacctaggagcatggacttccttttgtggaaactgggagcagctgatggttctagagtgagggcaagacctggccagggctgtgttgcatgcagggagactgatctggcaggaggtgcaggcagactgggagaggaagaagccttccggaggattggcaggaaaaggaaggaagcagagtcagagctggggttcatttgatgtttgcagagaggtggtttttgtttaaaggattagaagagtgtgagcaattgccaggtaaattcccttctccccagaccctggggtctgacatcaggaagcttgtcacagtccctgaggcccccagactgtttccagggcttcccatcctggaccggtatctgcaaggcctttccaactgcagactcttctttcaaaacctgctcttccttatctccaagaagcccttagaaactattatttatctgttttcccacaaaacgttcctcagctcccagtgtaggccaaaagccccccacgtatgtaataccaccaacaccccccgccccccatcgcagtttccaggcagggggaccaggtgggcctgtgtttcagaccgtaggctcccagcaggccaaggcgcctcccctcccagaccctgccttggcctccagccagtgctcttactgtgcacttagttagctgggggcacgaaacacaaactatttgtcttgggaggaggtgcttctttgctttcttctaaaaggttaggaaaataacccaacactcgtgattttttttttcttttctttttttttttttttttttttagtttgagggaagggaaggaattctgctctttgtgaataataaagatttcattgaagcagttcttgtaataattccttttaaaaataaaacaggatatttgatatctaatctgttctttctttttttttagagatggagtcttgctctgtcacccaggcagaagaacagtggtgcaataatagctcgctgcagccttgaactcctgggctcaaacatacagctgttgttcttaatgttcaatgacatcctagcatttttttatatttgtgttctaaaccctgtcctttaaaaaaaaaaaaaaaaaaacccaaacactacctagcatataaaattactctaaaaaattgaagtaagtttcaatgaagtttggtatacaatccatggggaagggatttcaggggaacccaccattagaatgaatcattccatctggagtaccagaaaactcgatattgtcgataccatggtgttttgttatatgaaaggaatagtatgcattggctaaacattatgttttggaagaatgataatggcctgggctgggtgtggtggctcatgcctgtaatcccagcactttgggaggccgaggtgggaggattgcttgagcccaggagttcaagaccagcctgggtgacatgatgagacttcatctctttaaaaaatttttgaattaaataaataaaatttttaaatgataatggcttgggagaatgatcacaaaaccaggcagactggggaaagaaaggcactcgtcaagtctgcaggatgaaagggaatacacagaaacatgtctgtcctgcacatgagacccacggttctagggactaggtggtttaaagtgtttaaagagtgcgtggcttgtgcaggaggaaacaccacagccttcagtctactcaagtccttctgggagcccttgaaactcagccagagggaccgggagtgtaggcgggctctaggtggcgccagagcactctgtccccaactccacgggtctgtgattgagcgaccagcatgtaggggctgaaggtcctccccaccatctccttatcaacaccaatccagccatttcagaggtgccaacaaacagaaaccactctgaccccggcttgatccccaaatacattcattatgcaccaggaaattcagaagacttgagaaaaaaagcatatatattagtaaattttcactgtccacagtaaccaagatatcttcagttaaagcagaaagagtgcaactcttttcactgtgtgtcttcatttgcttatttaaaaaattatccctaggccaggtacaggggctcacgcctgtaatcccagcactttgaaagaccgaggcaggcagatttcttgagcccaggagtgtgagaccagcctgggcaacataacgataccccatctctcattatacaaaaagttagcttggcgtggtggtgtgtgtctgtggtcccagctactcaagaggctgaggcgggaggatcacttgagcccaggaggtcgaggctgcagtgagccatgattgcgtcactgtactccagcctgggtggcagagggagagcctgtcaaaaaaaaaaaaaaaaaagccacaattcgtataagaactgctgaccgtgtcatatgtaagaacacatatatctgtatattatctttttaaaaagcagcttctgggtttgttttcattttttcattgcctcatacagcattgctcattctcttcagacagtttggaaagagtgtgtgcttgtgcaggaataaaccaggtgagatgcattttctgaaggcatggaagtctcacttccaggcaggttccctgcctgcctccgacaactcccacccaagatgccttctgcacatgcattcccgtccatggggagccctcttccatgccatcagcctctctggctgtgacgcccctgttcggactgtcctatcttcctctttccctggcctgcattttgacctcaaccctgtatctttttgtccccgccgatggacacatccacagggatgtcccatagctatgggagatgcacaatatacactttgggtttttgttgttgttgataattatggtaaaatacacataaaatttaccatcctaaccattgtaatgttcagtagcattaagtgtattcacatcatacaaccaatctccagaaacttgtttcatcttgcaaaacagaggctctatatgcattaaacagcaacttctcagtctcccctcccccaccccctggcaaccaccattctactttctgcattcatgattttgacaaatcaggtacctcatataagttgaatcatacagcatttgtccttttgtaactgtctaatgtcacgtagcataccatccccaaggttcttccatgttgtagcatatgtcaaaatttccttttcattgacaagtaatattccattgtatggaatagaccacattttgtttgtccattcttccacccatggaacagtatacgttttgactaaatggccagctgttaaagtctgtattagatataagctgagtatcatcattatagaataaacttctaaggtaaaagtaaatctgaaatgatattattattacaattttgttttaaaacataatgttccgatttcaacagaatgattttggtccaggaacgggattgtttagccttctcagctgctagaaggcttctgtggtcactgccttattcatttgcaacactgaattaattcttattttagcctgaggccagtggaaggttgagatgtattttgggttttttggctaactgctggtttaggttaatgttaccagcaagctgctgtctccccgatgtaactgaccaagctaaagggctaatttctcttcatacttggatttaaggaatcggtgcatggggatgattcattttatttgaaacagttctgcaaactgaagctttgtgtacatggggaggaagatacttcctggatattttcagaagcagatttaaggccgagcatggtggcgcatgcctgtaatctcagtgctttcggaggctgaggcaggagagttgcttgaggccaggagtttgagaccagcctgggcaacatagcaagacctcatctctacaaaaaataaaaaattaaaattattatgtttttaaaagcagatttaagatgattactctccattttgatcatctttgctgcatgaaaagtggccccaaaattagtggtgtcaaacagaagttctagttgtaaaattgagcacaaagcaattggcctatacggaggtactcagaagcatgctatgtgttagggctggctatttcaagatttaaaaatatgctctagaaaatctctaaaaggtagttatctgcacatgatagaagggttggggagggaggcggtgtaaacagtcactgtgctagggttgcaggcagcagacagtcgcaggggcgtagcagcattcctgccatgcagctgagatggggttactacatctctaagccagtgctccagctgcagggctgcagatgttccatatctgtgctgcccaggcagtagccactacccacatgtggccattgagcactcgcaatgtggccagaatgaccaaggaactgaactttggattttgtcactttgaataaattaaccacttatgaataaggataagtgacttccctcctccctcttgactcgtcagtggctacacccgggattgatgtccatctgtccagggccaaagctaggaatagaggcagggcacagctgcgactcactctctcccttcccccatgacaggggccttccgcggggctggcttgagcagcagcagatgcccagaagctttgggccttggttctggctgctggctgggttcctcagtctttttccacgttgcctctgcaggggccatacgtgcaaatgacttccttctctcctgtgtctggtgcgtggggccaggaggttgggcgacagctggggctgcctggtgtcgctttccatacggccttatccacgtggctcacttgggcttcctcatgccatggcatggcacggtcactggattcctcataatctgtcacacgtatatattttttaaaagacagggtcttgctctgtcccccaggctggagtgcagtagcgcaaacacggctcactacagcctcaacctcctgggctcaaatcatcctcccacctcattctccctagtagctgcaaccacagatgcgcgccaccacgcccggctgatttttaaattttgtgctgagatggggtcttgctatgctacccaggctgatctcaaactcctggccgaaagcaatcctcccacggcagtctctcaaagtgctgggattacaggtgtgagccacagcacccggccatttgcatgcatactttgtgagaacaaaatctgttgctaatattcttatatgtgcttgctaatgatagtttatctgggagaacttttattgtacccatggagaactgctgaccctctaaaccagctagtagcccagttattcccgaagcagggctgaactagcgtcgtcttgagtgtcagacgttttcttttcctagccttctctttttctcccctttcctccagtttcagtcagtctagtttattttcttcattaattaactataaaggaagatgaaagaagttgtggatgtcatagcacagagaaagccagctgaaaatgaaattcacatggccagaaccttccttacgaggattttgagaaattccatgaggtacagtctgggttttacaattgctttccttccatggggtgctgaatttgtcttttatactttctctttggttcctgggaaactgtcataaagtcagcatgttccacattttgccacccgtatacttttcctcgttaaaatgatctgagtcatcgaaaggtttgtgttatacatgcttttcagttttattttgtaaaatgttctttattgcataatgttctttaatgtttttgcctgctgggaaaaacatctgatctccacaaagtatttaaagaggcccgcttgagctcgttctccattcttgattgggttatcagctgtcagttctgtcccaaattagagaaatgtaaagctggcttcctaccatgaggctggagaagtgagctcgggaggaggatctcacgcccagcagtgttcccctggaggccctattgcattaccgacatccattgggatttctaaccagacacacctcatcacatctgggcagatgtggccaagacactaagaagccacacatgggatggtggggactgtggcgggggagcccaggaaagctcgtccatattcaggagccctggctgaagggactttagccttttggtgtgggttgtcatgactccctggggggatctttggttgactaagaggctcaggggaagatgcggctactagtcttagttaaccagaaggtggctgtctttactttgttacctaggtaaatagacacagataagctgtctgaactgtgtgtgacccagccgcctgagggacccatataccttttctccagcaaaagataggagatgctgtttgtgttcatactggggcagggagagggcaacatttgcttacttatttatttagaataaatgttctttatttatttttacatttgtaagattttaaattgacaagttaacagttgtccatatttatggaggaacacattttagagataagggctggctgagtgtggtggctcacacctgtaatcccagtactttgggaggccaaggtgagtggatcacttgaggtcaggagttcaagaccagcctggccaacatggtaaaacctggtctctgctaaaaatacagaaattagctgggcgtggtggtgagcgcctgtaatcccagctacttgggaggctaaggcaggagaatcgcttgaacctgggaggcccaggttgcagtgagccaagatcatgccattgcactccagcctgggcaacaaagtgagactctgtctcaaaaataaaataaaaataaagataagggctgctgcacatctagagcctgtgattcccactctgcgttagggcaaatgggtggtgaacaaaaatctaaaaagaaggtgtgggtttggattcagctggcaacccctgaacatggtgccgtgcacctgcctgagttgctgtgatcagtgtcagtctctgcactgtttggcacaagcgtgcgcgctgtgcgcattccctgaaccccctgcactgtttggctcgagcgcgcacgcgctgcttgcggtccccaagccccctgcactgtttggcacgagcacgcgtgcgctgcgtgcggtcctcgagccccctgcactgtttggcacgagagtgcacgtgctgtgtgtggtctccaagtcccctgcactgttcgtttggcacacgcgcatgtgctgtgtgcagtcccgagccccctgcactgtttggcacaagcgcacgtgcgctgtgtgcggtcctcaagccccctgcactgtttggcacgagcgtgtgccctgtgtgcggtccccaagccccctgcactgtttggcacgagagtgagcgctgtgtgcagtccctgaccccccgcctcccctgcgttcttttctaggaggagcgagctgggctggaggcctcactcctggcatgccaccaagttctctgacagccaccccgagctagcggcctccccattcacctccaccagcggctgtccttcctggtccggccgacaccacgcgaggtaggcacccattcccgtccaggatgccaggtttgttcagccttctgcagggagcgcactcctgactgcagaatgattttgatgtttctgatgagactgggccaccgacacataatcacagttggagggctctgaatttttgactgaaccggcaagcgtgtgacacaaaatgaaatggcaagacaaggcatgagcaagaaggggagcataggacttgggtttcagccaagcttctttgggattggccaggtgggatgccaggcagtagggttctgagccggtggggtggcatccacggcacccctctcctttccagggttttacacatggactggaaggcaggagatatatatggggtggcaggtatatcttgtaaaagctcccaagaggttctttaagctttggtagcctctcctcaaccctcttggagttagtggcagtatcctcactagtctcctgttaagaggatggcggtaacagcagatagtctgcttttggtgtgcgtgtgtggatgtctccctgcttgcgtgagtgtgtgtgtgtatctgtgtatgtttacgggtgtgagtgtgtgggggggtgtgagtgtgcatgtgtatttctacacgtttgtgtgtgtgtgtctttgtatgtgtatgagtgttcatgtgtctgttcgtgtgtgcctgtatgtgtgcctgtgcatctctttgcttgtatgtgcatgtgtgtgcacatgtatatgtgtatgtgagtgtgtgagtatcagtgagcatgtttggtgtgtgtgtgtgtgtgtgtgtgtgcgcgtgcgtgcacacgcaggtatgtgtctgtgtttggagctaatgtaaccactcagtttttggctgttaataaatgctggtcttggctgggcgcaatggttcatgtctgtaatcccaacactttgggaagctaaggtgggaagattgtttgagttcaagaccacccgggacaacacagcaagaccccatctctattaaaaataaaagaaaattagctgggcattgtgtgcacacctgtagtcccagctactcaggagactgaggcagtaggatcactgaagcccaggagttcgaggctgcagtgagctatgattgcagcaccgcactccagtctgggcaacagagcaagacctcgtctcttaaaaaaaaaaaaaaaagaaaagaaaaaaaaatactggtctgtaaaattgcaaggtaaagatttatatgacacgaaggaaagacaactgaaatataacattacccctaaagtgacaaaagatgatggtatttagagcccagtgtattttttggggaaaaaaaaaacacaaaaaaacaaaaagccacagattctcaactgagtagtaacacttaagtgaacagtgggccttttattttattcctgaagtgacttaaggtgatgagatctccattaagcccatttggcagtctcttgatgaaagaaacatgcacactgcccacatctgtgtggaaacagtgctcagagttctctagatctgcttggacttgggatctcacagaaaagtcccttccagaatactggtgggtagtcaggagcatgccccgggtttgaggatacgtggtctgttcttacagaagatgggtgggaaacccaaacagtcctctccctcccatagatgacagccagttgttctccagtgttctgtcctggtcacacggttctctcatcctcactctcccccaacctagtggagccacagcttcttcctgttgaagggtgaacatctcagctttgttgagctttaaagaaagcacttaacatcctggataaatagtttcaccattgagagctctcagtcacacacagttattaccttacagaggaatcaatgtgtcaactcaccgtcaatttcatcctcttagacaccatcctgtttaggagcctgtgttttttggtgtgagtgtcaataactctgtagggtataaccagttagctgaaagctgaacacagcagtgtgtgatattattattattattattatctttgaaacagggttttactccattgcccaggctggagtgcagtggcgcagtcacagctcactgcagcctcaacctcccaggctcaagccatcttcccacctcagcctcccaagtagctgggactacaggcatgcaccaccacatccagctaattttttaaaaagtttttatagagatgggggtctcactatattgctaagtaaggctggtctcaaactcctggcctcaagtgatcctccagcctcaagtgatcctcctgccttagcgtctcaaagcactgggatttcaggtgtgagccaccaaacctggtctgtaacaggctagctagtaaatgcttttggctttgcaggccgcacatctctgttgcagttactcagctctttcattatagcccaagagcagccacagacactacgcagacacatgggcacagttgggttccagtaaagcttcatgtatgaactgaaatttgaatttcatatcattttcacaggtgaaataggagaaatagtatgcctcttctcccaccataaaacatataaaaaccatttgggctgggtgcggtggctcatatctgtaatcccagcactttgggaggccgaggcaggcagatcacttgaggtcaggaattcgagaccagcctggccaacatggtgaaaccccgtctctactaaaaatacaacaaaattagccgggcacagtggcaggcacctataatcccagctactcgggaggctgaggcaggagaatcgcttgaacccaggaggcgaaggttgcagtgagctgagatcacgcgtctgcactccagcctaggcgacagagtgagactgtctcaaaaaaaaaaaaaaaaccaaaatcaacaacaacaacaacctgagttgtggtgtggccacccctgcgcttaactgttgattgaccatagacgtgtaaatgcagacgttgcctgccaacgatccgggcatcaggctgagaatgtgcgctagggttgcaaggcatctgtttggtaaaagccatgtaacagggaggacacagtcttttcagcctgtgcccagtttctccgtgtctctactaaaatccagatgtgctgagctgcaacctcagcctcagcaacatcaccgtgggaaattactgtttggcattttggtatttccacagagggtcagctgcgtccaccgccttgccctttgccattgctgttgctaaagcacaccatgccttgtccttcttctcattcttgcagttcttcctcccacgacctgtccagttcctgggagcagacgaacctacagcgcaccttagatcacttcagctccttggggagcgttgacagcctggaccacccctccagtcgcctctcggtggccaagtccaacagcagcatcgaccacctgggcagccacagcaagcgcgactcggcctacggctccttctccaccagctctagcactcctgaccacaccttgtccaaagccgacacgtcctccgcagagaacatcctctacactgtgggcctctgggaggctcccaggcagggtggccggcaggcccaggccgcaggcgaccctcagggctcggaggagaagctcagttgtttcccgcccagggtccccggtgacagcggcaaaggccccaggccagagtacaatgccgagcccaagctggctgcccctgggaggtccaattttgggccagtctggtatgttcccgataagaagaaagcaccatcatccccacctcctccccctccccctctccgcagtgacagctttgctgccaccaagagccacgagaaggcccagggccctgtgttctcagaggcggctgcggcacagcactttacggccctggcccaggctcagcctcgtggtgaccggagaccagagctcaccgatcggccttggaggtcagcacacccggggagcctcgggaagggatcgggaggcccgggctgcccacaggaggcccacgcagacggcagctggccgccctccaaggatggagcttccagtaggctgcaggcctctctgtccagctcagatgtgcgcttccctcagtctcctcatagcggccgacaccctcccctatacagcgaccacagccccctctgtgctgacagccttgggcaggagccaggggctgccagcttccagaacgacagccctcctcaggtgagggggctcagcagctgtgaccagaagctggggagcggctggcagggtccccggccctgtgtgcagggagacctgcaagcagcacagctctgggcgggatgctggccttctgacacagcccttggagccctcgagagtcttcccccacccacggtgggccagagcccacgccatcacctacctcagcctgagggtcctccggatgcccgcgagacaggacggtgttacccgctggacaaaggggccgagggctgctccgcgggagcccaggagcctcccagggccagccgtgcagaaaaagccagccagaggctggcagccagcatcacgtgggcagatggggagagcagcaggatctgcccgcaggagacgcccctgttgcactccctgacccaggaggggaagcgccggcctgagagcagtccagaggacagcgccaccagaccgccaccgttcgacgcccacgtgggcaagcccacccgaagaagcgaccgctttgccaccaccctgcggaatgagatccagatgcatagagccaagctgcagaagagccggagcacagtggctctgactgcagcaggggaggcggaggatggcaccggccgctggagggccgggttgggaggtggcacccaggaaggacccctcgctggcacctataaagaccacctgaaagaggcccaagcccgggtcctgagggccacgtccttcaagcgccgcgacttggaccccaacccaggagacctatacccggagtcactggaacaccggatgggggatccagacactgtcccccacttctgggaggcaggcctggcccagccaccctcatctacaagtggcgggccccacccgccccgcatcggaggccggagacggttcacagctgagcagaaattgaagtcctactcggaacctgagaagatgaacgaggtgggcctcacgaggggctacagtcctcaccagcaccccaggacatctgaggatactgtgggcacgtttgctgacaggtggaagttttttgaggaaacgagcaaacctgttccccagaggcctgcccagaagcaagctcttcacggaatcccgagagacaagccagagaggccgcggacagcgggccgcacatgtgagggcacggagccctggtcgcgcaccacctcccttggggacagcctcaacgctcacagcgcagcggagaaggcagggacttcagacctgccgcggaggctcggcacctttgcagagtatcaggcctcttggaaggaacagaggaaacctctggaggccaggagctctgggcgctgccactcagcggatgacatcctggatgtgagcctggacccacaggagaggccgcagcacgttcatgggaggtcccggtcttcaccgtccacagaccactacaagcaggtaagcatggagccacagcccccttgaccatcatcttaacccaaggacaggacacacccagaatgcagtggctgacgccagggctactcagctccagctgtgcgagcatttaccttttccagatctcctagtgtcctctgttagaggtatttggggacaaagttgacaccttcaaggcaatttaaactgccatattcccgaaaacccacatttttcattctcgttctcgttgccataatctctggctttaactgagtttccccttaagtagcttgctcctaccttcatactcagcaaagaacttggagggagaaactatggaaaatgataactaacgcctctgacatggaaatgtgtggtttatgtaaaagcttaaaatgacatacagtagccacttttcaaacactgatggatgacctttaatatttatagtatttgggtttttttagtattctgttttttatttgcaagtattttcaaggattgctctgggacaaaatgtatttaaaacacattaagtgattgcactttattaaggtgagagttttgatggtgagagttaatgtccagctttctagaaaactgcatatttcttagccctgcttcaaagtgaacagtctctttctctcttgcacctaccccctttgaaagctttttctccctattacatctgcacttgcacatctcaaagaaaaaaatgttccacaatgatagatgcagtttctttttaaaagaatccagggtgggtgcggtggtgcatttgcagttctagtactttggaagaccgaggaaggatgatcacttgaggccaggagttccagaccagtctgggcaacaaagcaagaccttatctctacaaaaaaaaaaaaaagaaaaaaaaaacttaagacaggtgtggcggtgcccaaggaggttcaggttgtggcgaactgtgttctcaccactatactccagcctgggcaaaagagcaagaccctgtctcaaaaaaaaaaaaaaaaaaaagaaccactagtaatttaatacaagatacctaataagtgcatggaaagaaggctgctggtttgctctgtggcgtcccagccctgaaaatccacacagatgctgtgagtgtttatttccactgttggataccctggcttgtggctattcagcatgacctctgagaattccatgcttgctctgtcaggagcaaagaatcccaggctctgacgagtactagagcttgaggcttcaccgctgtaatttgtgaccagctgtattttattttatttcttttggccaattgtgccacacggttttacaggcttcacgtaggagttgtttcctgcccagaacagaagtggacgtggggtcttatttcagtcatctcaatgaaatgctttgtagaactgccctggcaaggcaaacccacaaatgagggctttcataatcacagatgtcctgaggaaggcagcttgaggacttggtgtctcattatgttgccctttgcaggaagcttctgtcgaactgcgaaggcaggcaggggaccccggcgagcccagagaagagcttccctccgcagtccgggccgaggagggacagtccacgccgaggtgggtgaaatttggattcagagttactgaagaggcgtctgagggtgggcttctgtacgatgggtgggtgcttggttaacatggctagatgtctggcttttgccaaacccaaagcggctgaaatccggcgtgatttctagcatccctgacgtactggaggtctgggcagagcctgtgcaccctgcagccctgcctggagacacatcccagggcggggaggccttcttacacggcggtgacattttttggttcttaaaatggctactgtgttttccgcacggtgagactgcttatggagacataatgagaagtccagttgaacatactggagctgcacgctttgcacagagcgccttatggaagggcagctttagctatctagcacacagctgtgtgcctagccgcggcctggaaatcagagttgcctctaaggattgttagtaagaaaggaacagggcaggccttcctaaattggacctagttaatgagttaattttgagctttaaaatagaaatcgagttagtcacctcccaaagagaggcttcaagcatctgcaggaactgtggcagcagcaggagattagagcgttttgtgccataattccagaatgtgcgccgtagccgcttagttgagacaaggacagggttagattaaatacatagtataatctgtgctgggtgtggtggttcacacctgtattcccagcactttgggaggctgaggcaggtgaatcgcttgagcccaggagttcaagaccagcctgggcaacatggtgagatcccatctctactaaaaatagaaaaaaaaaaattagccaggtgtggtggcagatgcctgtagtcccagctaccctggaggctgagctactcgttcaagcacgagaatcgcttgaacctgggaagtggatgttgcagtgaatggggattgcgccactgcactccagcctgggcaacagagcgagaccctgtctcaaaaaaaaaaaaatagtataatcttccccttcatcacacgaggagggcaggcagagagtgtgcgtctctacagaagatgtggtgcaatcttgtttcaaaaaggcggatggagggatgggagtaaatgcacgacagggtccccgggtgtggatttttctgtcgccttgagaatgttgtgtgattgccatgacattcacattaaacactgacctcaaaactcaaggttctgttgcagaaattaccaatttaaaagtttgctttcaagagcctcatgtaatggggttttatttcatttggccttaaacagagctgttatccttctacaaggggatcaaatatttatgtgactctgcaacgacaggattgatattgtgtgtgtgcttgtgtaggaagtctctgcagttacttaacagactctgaggctgaaaccaagaatgcgtgggtcagaaaggccgacgaataatccacctacagaatttagctgtgtctgagaagcacaattagagctttatgactgtggattccaagtaggtcacgtgccgagcaccagctgcagtctgttttccaagccagctcccaggccgttgaggctggccgtgcagtgcatcgtgggcagtgctcgatgggctctgcacatgcgggccttgctttgcccgatgccaccagtgtatcatctgtgcagagggcacccgtgctggtgagagtgtatagctctgctgtgcatggagggggtcgccctgaacagctgtcacgtgcaggctgtgtgtgagtgagtgaatggcactgtcgatactgaaagggtcgagaggaagcggggccccctgcttcattcatcaaggccatgtctcccagcagactgcataaccactccaaagaaattagttccagaaactctctgcttttgagctaccaacccagcaattttcagaattgttgggtgcggttttttttttgagtggtgaggcgcgatgaaattcgagaatatgtaggttgaaaagttgttttcaacttttttcagagactctttaatttctgaaggaccagcaagaaagaatacacttgaaaaatttcaatggagaataatagaagtcaaagttcaggcaagggattgttctttgcccaccaaaaagaaaatctagaatacaaaggtttgaagatacccagtgttttgcataagtttcaaataacgtaaacatgtctgtgtaaatcatatgaagtgctgctctgataatcgatgcgtagcaaaaagtatgtattgtattctgtttggataacaaaagaatgttgagatcggaattgttttttgttgttgttgctcatgtgaaccaaatagagataacattttttgtgaagttcaagatcctgttaatataaagacaagtagggcagattgaagtgatgatactttttttttaagttacatgatgtttcagaagctcagaggagatagagcaaagtgacttctggctgggttatgggagaaacaggtggcgtttgagctaaaatagaactgaacctgagggagcagacccagcacgtttgcttccctccagctcttctgtcctgaacagcccaccgcaccccagcccccacccccactgccatcagaggcttcacctcagacccacaagctcaggcatcatagccagctggagcctgctttggggaaatgctctctcctgctgacttggggccccttgaatgctgggtctgtttcctagtgtggccataacaaactccccaagactgggggactcaaacaacagaagtggattctcccacagtcctagaggctggaagttccagagcaaggtgtgagcagggctggttcctcctggggcctctctcctaggcttgtagatgccgtcttctccctgtgtcctcacaaggtcgtccctctgcgcatttttgtatcatttcttcttataaggaccccagtcctattggatcagagccctccccaatggccctaattacctaattttaccttaattacttcttctaaggccctgtcttccaatacagtcacattctgagatactaagagttatggcttcagcacattgattttgtggggcacagttcagtccctaacactgggagaaatgtccctgcttctccattctacctttatagtaaccacttctacctgctgtcagctctctcaggaagtgtcatcctacccttgagctgatcaggctttacgttcatgacagatgtgaaagcctttaagatgaagggaagagggagctgtcaccctgtgggtggcacagaagaggggcatttggcaaaacctgactggagggctttttgagaaacctgtctggagggttccttggcaccatgcaactgaaggctgacagctctgcacaccttctggttcagtcaatccatctttaagagtttaccttgaaagtggacatccactgccccatgaatgtgctaacctcttcaaactgggatggtttggcagggggacagtgactcttaaactcacatcacggatgtatttgtacaccttcactattccttgctgtctgctgggctggaccgttggctcctggaagatgggattttactttttcatttctcagtaccccgtacctgacataattcctgcacagattacatgctcaataaatggttggatggatggagggactggtggatggacagatgggtggttgagtagacagatggatggaccagtcctcaggtagatagttggagggtggggagggtgggtggatgaatagttggatggatggaagggtaagtggatagatggatggatggatgcatggatggatacatggatgagatgtagggatgcatggatggatagatggatgaatggaagagtaagtggatggatggatagatgggtgtgtggatggatgcagaggtgtatggatggatggatgggagggtaagtggttggatggacgaatggaaaagtaagtgggtgggtgggaggatggatggataagtagatggatggatgaaagggagggtgagtgggtggatagatggatggatagaggggagggcaagtggatggatggatacatgggtgcatggatggatggaggcatgggaaggtggatggatgagtgaatgggaagatagaaggatgggtaggtggatgtataaacagatggattggtggctgaatggataaataccaggctgaccttccttgagttagtctttcttgattgtggtgaataatctttccatattggtacattgtgtgtcctaaaattttatttagaattttagtttacacactagtaagtgaaatggcctttatttatccttctgcactagcatggcatttggaatcaagaagacataaacatctcaaaataaatttggtagcacagatttgttttgggtatgagattttagaccttgtaggaaagtttagaggtaccacatttgttcgttgctcctcaatttcgagaggccttgggtgaggactgtgttctgggtggctccagagactggcactgaaatgagatctgggggcggccccctggagctgtgggtgctggcagtgtcttccttctgtgccttcttgcagccacttccgcccccgcctgcaggagccactgccaagcactgatgagctggcactgacctcaggcttgtattttgttgggacagatgggaggggaggcaaagaaagagagtatatcctaaatcccaataccagctgcaaaattgaatgcatacgaaatagagctctttagggaaaaatttgctttcatataatatgtataaacaagctaaatgaacctgagggtcatcttcctggatgttttccctgagaggtgacttggtgtacagagattcatgtgaagaccaatttttcatttacaaaacaagctccttcatgtagatttcagaataagtaacagagatttatcatccaagctctccccctcatttgtcactttagggcagatgtttgctttccctggccttcaattagctcagggcaattgaagctttccattctgagctgctgtgctaggtaattatgaatagactgtgctggatcgggtcaggataaaaaggtgaaacttgatcttggaattttgtcagggcagagcccagcattctgcatagctttgtacagtgtagtactgcatgctgagcagaaaggttcttgtgcagggagtacttgcggatgtaacaccctcaccccagaagggataaacggtagctgtaggagagagcctgcggcatgggtctagcggacttccctttatgtctttttttgatgttgttttttgagacagggtctcgccctgtcacccaggctggagtgcagtagtgcgacctctgctcactgcagcctccacctcctgggctcacgtgatcctcccacctcagcctctggagtagctgggactataggtgcacaccaccatgccagctaatgtttgtattttttttgtaaagatgaggtctcaccgtgttgcccaagctggtcttgaactcctgggctcaagcgatccacccatctcagcctcccaaagtgctgagattacaggtgtgagccaccacacctggccttgtttttatgccttactttgcaactacaatttccccttacatttatacccatggggactttaagaaacccaggaccgagacaggcggccacccgtttgtttactttttggtttggtcgcgtgattctagattatttagaaggaatagctttcaggtgatagtttatggttacaggatttcggctaaggaggagaagcgggagcagggaggcagatccacaaagccctcgtgtggagggagaagtgtgcaaaaggagggtgaaagtgaccaatgccccaagatgccagagctgagggaagccagagggaaatgcagaggaaaatttaactcaggcatctcagttctagatggggcaggtaagcagtcttctacaaacagaatttgtgtcattgagcagggcacagtggcacgtgtctctaatcccagcactttgggagtctgaggcaggaggatcacttgagtccaggagttcgagaccagctggggcaacctagcaatactctatctctacaaaaaatacaacagttgctgccccatggttgggtgccaacatacgtagctgtactcgcacaggatccttgatccctcatgtgactcctaggctgtggcctgagacttgcctttccagaagaatccagccctgtggaaagctgcccctttgtttcccagcagccccatccctggagcccccagcggcctctcttgggggagagactcccgtagcacgtgctgacgtggcagccccgctctgctctgcctctcctctggcctcctttcttgtcagctggctgcgttcttcaaagctctcagcctctgggccgaccttggctgcgttcgcatgttacgggatcctttggggctttcacctttctccagagagctacctggaaacatagatgtccattctcccctttagcttcttccagcctccattcctcttggctgtgtcctagtccagtcctccacccagattgggctgaggtgacacagacatccacccagaaggctgtacagattgataaccgattgattcattcaaagggtcttgctctgtcacccaggctggagtgcagtggcacaatcatggctcactgcagcctcaacctccaagctcaagtgatcctcccgagtagctgggatcacaggcatgcgccagcacacctagctaattaaaaaaacaaaaaaagtttttgtagagaaggccttgccatgttgctcagggtggcctcaaactcctggcctcaagtgatcctcttgcctcagcctctcagagtgctgggattacaagggtgagccaccacaccacacccagccaatgtgttcatttttaaagtttgacttaagagtcccatagattcagtgtcttatgtggcagttaggtccttgcagttagtctcagaaatcgatttagctcatctgttttctgaaggcccacacatttgaaataaaaaaggaaatagttctgagtcacctccttctcaatataaatagaaaatgcattcaaatattcccacaagttttgtgtcttttaaatctgcacaaacccaaagaattcctagaggaggccgccagagctagcagcacgtgtcaggtctgcatcccaccgggccagctgagcaacccgcttcaggcccctgcataccacacagctcaccaccgcctccaacgccaggagagtccagaaggccggagggcgagggaggactgacgcgtgggcggtgacggcgcgggagccagtgatgtatttctgctttgggctttctcgcacgtggcacttggagcacatccttgggaacatgtctgtcctctttgccagtttaaatttttgtgtgttcgtttccatactagctcttagaatctaaatcaagtgttgtggatggtgtgcaagaccatggctgtgtatgtgtgtgtgggagtctcattgaccacagtgctgacacagtttcccttggtggaagtaaagagtaagttcaggactcccctgtaaatgatgtgctccccatggatgagggacaggaagaacatcagggtaccgtgccagcagagctctgtgccctgttagtcgaaacaaaagtgatggctgagatgagtccttctgtggcacccaggaaactttgatagctgggccaagaagcagcggcactgcagtgccctgggccgcgagcatcatggtttatgctcagcaaagccacatcacctgtcatatagacctgacatcagctttacagttttgcttgcatataacttgcaaattttgttttgtgttttatagcctaagaaccattaaaataaggaaacagattttatatagagacatttagcagtctaataaaaaaaaataaaaatcacatattgtatgatgccatttatataaaatgtccagaataggcacatccgtagatagaaagtagattagtggctgccaggggttaagaggggagaagtgagggagagactgttcatgggcgtggggtttctttctggagtaatgaaaatcctctagaatctgatagtggtgatggtgactgctgtgatatactaaaaactactgaactgcgctgtttcaaagggcacattttatgatatattttatctcagtctttaaaaaaaaatctcaacactgggaatccataagaaaactttttttaatttaaaatgggtctgtcaggcagggcgtggtggctcacgcctgtaatcccagcactctgggaagccaaggcgggtggatcacctgaggtcaggagtttgagaccagcctggccaacatggtgaaaccccgtctctactaaaatattagccaggtgtggtggcagtcacctgtaatcccagctactcaggaggctgaggcaggagaatcgcttgaacctgggaggcggaggttgcagtgagccgagatcgtgccattgcactccagcctgggcaacaagagtgaaactgtctcaaaaaaaattaaaataaataaataaataaaatgggtctgtgcattaagcagctgtagttcagagattgacaaagtttgcggaagatgagatgataaatatgtttggctcagaggaacatagtgtccctgctgcgaccactcagctctgccgtgatagcgcaaaagcagccacacggtgaccaggttgccctccctgcaggcctgctaagaggactctggctagattccagcccttgctggtccccctggcgttggggcaggggggaggcgggcagcatccctactgtcccaccggacccagcagccacaggggcctttcgcttctccacattccttcctgccctgccctaaagcaggaagcaagacaaggaaacctctgagtcaggtatgtggatgtcctctgcagaactcgcctggtcccttccttcaagtcatttgtttctttctgtgagtcagccctgcctcctgtttaccaggcacaggtagttttacctgtggctccctgagcagaactggagccggtgtaacacaggctgtgtctctgaatagaaagtctccacactgccgtgccgctctccactctgtgtttgcccactgtatgcaccagagcaccctcccggctccccttctcctaagcaaatcccacacacctgcatcccatccttcctcagatcacttccggaatcatctgcagagtttgggtttcatggtttgtgcgacactctcaagcagctcacccaaatcgggtggtgtcagatggtaaagggttgaggggtctaggtcagggtcacttggaaacaagttcctgggggagcagagcaactttcttctctacttggaagaatatgataaagcacccctagactcactggtttcgagttctagggaagcagatattgatgactcaacagaggaaaggattgtgtaatcattgctttagtcaggggttagcaaactatggtccacaggccaactctggccccctgtctgtttttttaaataaagttttattggcatgcagccacatccgtttgctcacaggcggcctgtggctgctccctctctataatggcagagagttgagtcattgcaacagatcggatggctcctagggctgaaaatatctgccatctggtcctttacacaaaggtttgcttgccgaccatgttgggcttagtggaggggtgtaagggatggtcttacatgagtgtgcttccagcacagggagcatggaacccagtggcagtctgtctggatgttttcaaagaggcttctttgtaatagttcgcgattatcttgcaacatgatatccatctccccatccctagtgtggttaacttggggaagtttgctttgtccaagtagagggggctgtagcttgttcacagcccaagaatgcaggagcacgcaggatgctggagcaccagcttttctgacttgttagtgatagcctgggttagggaaggttgtccttggaccacatgggctgggcatgcccctcaattcatggaaagtgactcagaaaagttcaaggtttcaccaagactaagaggtgaggaggaagttctttcagaacataagggtactagggtggtgatttcattctgttctttttttatgtgtggactttttcaagggcacaaatgttttgtgtcaattaaaagcagatttgtatgcattttgttacaatgattatgattttaaagtcttaatagtattatactatacaatctacaaaaagatttgagcatcttataagccctgataattatgcctcgctctaagaaacatgggtatctggaaagccacattataaactttaatattataaatgtgctttctgtttagaaggaattcttggagggtctcctttaagagtggattcctaggccaggcacaggggctcatgcctataatcccagcactttgggaggctgagaggattgcttgagcccaggagttcaataccagcctgggcaacatagtgagaccccatctctacaaaaaaaatttagctgggcatggtggtgcacctgtagtcccagttatttgggaggctggattgggaggatcgcttgagcctgggaggtcaaggctgcagtgagctatgatggtgccactgcacttcagcctgggtgacagtgagaccctctctcaaaaataaataaataaataaataaataaataaaaacaaaaataaaaaaacaggattcctagagcacagccagcatgcagaacttgttttctaaggcttttctccaataaaaggaaccagggctcctcagaggaatgactgagtctagggttggggcagggactgtacaagatgagcctggagtatcttatagtgccagaaaataagcgctcaaatacacccatatgtaaacccagcggtgacaacagtgtgggtatgtcatagggacacaggaaccaacaatgaccaaaggcagaacaagttaagcagcaaaattaagtagtagtggattataatccaatatataaaatgaatccacagcccagactgatacgcaggatggttgaataaattaacaaatgaagaatagagaaatctgctgtgcagaaaattgcaaatactttatgtagctactgtgcccttaaggaggtggagcatagctcccccgctccccgctcagtgtgggctgccaacagtaagctccctccaaagagtacagtgtggcaaaggggaccgaggagaggaacatcacagtggagaaactggtgtataccaacttcaccaggcgatcagggccaacgttgacaggtaagtcacattgacagcatgccccttgatatcataggataacagtggcacttcacttccatggtctctctcccagaagtcccaggctaatcataaaaacacatcagacagttcccaattgagagacatgctgcaaaatgccggaacagacctcttcaaaactattaaggtcatcaaaaacaaggaaagcctgagaaactatcatagcctattcaggctgctataataaaacacctaagattatatgatttataaacagcagaaatgtatttgtcacagttctggaggctgggaagtctaagatcgaggcactggcagattcggtgtctggtgaaggtgctttctggctcacaaatggctgtctctctgctgcgtcctcacatgatggaaggggagagggagctctcaggggtcccttttatgagggcactaatcccattcgcaagagctccatccttatgacctcatcacctcccagaggccccacctcctaacaccatcacctgggggttaggtttcaacataggaatttgggggtggggggcacaagtgttcagtctaaagctatagcaccctcacagcaagaggagtctgaagaagcaggcctgagtatgatgcagtacctggatgaggttcaaagacagaaggagaacattgattaaacagaaaatttgaataaagtgtgacctttagttaatattaatgtaccaatattgattcattaactatgacaaacacaccccatagtaagtcagatattaataatagggggaagtgggtagagggcatatgggagctctcgcctggctgttgcaattttttagtaaatctaaacccattctaaaatgagatgctggccaggcgcaatgggtcatgcttgtaatccaagcactttgggaggttgaggcaggaggattgcttgaagccaggagtttgagaccagcctgggcaacatagcaagaccctggccaggtgcagtggctcacgcctgtaatcccagcactttgggaggctgaggcgggcgtatcacttgaggtcaggagttcgagaccagcctgaccaacatggtgaaaccccgtctctaataaaaatacaaaaattagctgggcatggtggcgtgcacctgtaatctcagctactcgggaggctgaggcaggtgaattgcttgaacccaggaggcggaggttgcagtgagctgagatggtgccactgcgcttttgcctgggtgacagagtgagactccatctcaaaaaaaaaaaagtataatgaaatatttattttttacaaatttttatgtagagaccaggtcttgccatgttgcccaggctggtctccaactcctgggctcaagcagtcctcccgcctcggcctcccaaaagtgctggggttataggcgtgaaccaccacacccagccctataataaaatatttaatcagccatcagctgattgctgttccgtgtgtggcctggcagtatgtgttgagcatttgagaaaaggtgatggcccggggtgaatggcaccctctcttagagacagtaacatgtacttggtaaagtaatacgtgaagatgaaaagtactggaaagaacacgggcttcggagttgaagacacaggctggaatcctcattctgcctctcagtgtaagtgtgtcaggtcccccaagcttgctgacctcacggccctggatcatggggatatgcagagcaaccttgctcgcagacttatttacatgcttaagggatataacattaatgaatcagcacagtgcctaaggttaagtgtcgatatgggggaaaaaaatctaaaatagcagtgatacagtataggctgcaaagcagcatatgttatttggagaaatgagcaagagttggaagtaattgctatgaatgtagaagagggtgacaggaacaggttggaaagagaaactccgtcctggtggctaagcccaggatgtgggagggtgggatagggctgtgaggcgcagtggctggcgacgctgcttcctggaggggctgtggtgctgaggtctggggctgcgttaggagggaggtggggctcagggactttaaatagagatcattgtgaaatggttaattgggaaagtcaggtccagcctgcctttgtcttccctgagtgccttgcacacactcaaagttccggaaacgcttgttagttgcttgatgggttacattcctaatgagtgtgtaatcaacccaagaatatatggacatagaataggctgttgaatgttttctttttcctccttatggttgtggagttgaactgtgtgtcacatatgttataggattatctagcatcacttaatagagaaagctgtaacatcagtgcagtgggctttctatatttccccgttaaaatataagaagtgctgggcacagtggctcacacctataatcccagcactttgggaggctgaggcaggaagatcacttgagcccaggagttggaggctacagtgagccatgatcataccactgcactccagcctgggagacagagcaagatcctttctccaaacacacacacacacacacacacacacacacacacacacacacacataaaggaagactgccccccaagccttttggggttttaaattacaagacacacacacacacacacacacacacacacacacacacacacacacacacacataaaggaagactgccccccaagccttttggggttttaaattacaagacttttggggtttaagcactgaagtgttgggaatgttccccactgaggcaaggagttgctgatgaagtgatgggaaatgcaagcggagccttgagccgtggaggtgaaggttgacggagcctgcgtgagcttgcccatcaacaagacagcaggcacagacaggccagctgttgtgagcttggctttaggactccattcagtaggcaggaggagagctgcagcagaggcgggctgtgggtccctgaagcacatcgctgccttcacagctgggcgaactcccatccagcacggtaagcagagccgggtaagggacctctgcgtttgctctcggggcacttcatcccagatgggaccggtttcaggacgcctgcgccgtttgttaggggtttgtagttcccagtggctcttttgttctgctatcttgaagggcaggttgcttgtcagctcacaatgctgtgggtaaggtctggtgaggtcggcgaatgtgttctcattgtttattcttctgcctgaagatgagaaataatgcaaatcagggtgcagattccggctcgagctccacaggcgtgcacgtatgtgtaagggcatgctcgccggtgctgcatgtcctcgtggatgcatgcaatttttacagctttgggattcacggttagctgaaagcacattggaactggaaggcggtgctcttaacaccgtgttctaggctggaagccgtagagccatcatctgctctgatgggactgcagcccttggtatgtgggacccttgctccatgtgagttctgcagatgggttccccgagggagctggctggaggacgccagcatcgcatgaagacctgcctgcctcgtttgccttttgtttttcagtagcagtaagaaacaggcattctcactacacaggcattgaatgcggacattgagaaaaaatggtgagtcagctacatcctcaagaaaaaaaagcggcgaaatcaggtgtgcatgtttagtcatgagaaatgttccctgagtgcgtttgcacatagcctgctgattgcagtgagataatttaaatagagaaaatggaatcaccatggttcttagcattttccagttcttttattttgctctttggtgtgattgtgacagtttaagggttttactatacatgtgctttttcccccattttatgttgtgataaaagaaagagatgattagttttggctatatttctaaatggttggaatgcctttgctttactaaaggaggcttttgtgtgtgcagagggtcgatggcattttcacagggaaattgatgcataaatatgtttgcacacacaggctgtctctttggtctgcatttactgactcacaagagtaggtgtcattttgaaatgcatgtttttagcggttgtgctagttgaaaggtaaaaaggcaaaggagtttgaagaaaggtttttggaaatctacctggtagcacttacgagtaaacagcctactgcctcgtagatggtcttaagatttataagatgaatggaaaataatattttaatgtatcatataaaaaaactgaagatttggtaccaagttgatgaatggttggcatatttcttttcattacggaatagaacctttgaggtcatactctacaagtatttcttattattttattgcggaaaagcattgcatgggtggtagaggcacatttctttcttttgtcacacatagtggcaaaaacattttatactttgtccctttctgtttctccgcctccacctgcgcccacccccctgcccccccgcccctcccgccccgatcaccaccaacccaaaccaacaccatacctcttaaggaaaaaaattgcaggggaattctcatctacagaggcatgaacaacacacacagagttttttacagagtgctaggaataaccatacacgttggtgtcaagcatataggctgcggaaggctctattgcccagccagagggacaaatgaccctggtgaatgcacgctgactgctgcttgttttgcatgggctggctgctcttccagagtccgcctttggattttggaggttgaggaaggaagggaatattttatgtggcctttggaatacatttactttacactacctttaattttttacctctcatatgcattaaatttttaagaagaccagggtaggggagcagtgggaagaagctgatgtcttgtatccacccatctttcccctgtcctcgggcactgatttccagctggcttttcctagagcaagtaagacagtcgggtcatttctggaaggcttgtagacatccttggatgtctgaagaggtcctagagttatttacttatttacctttaaaacatatttgccgacaccttatttaaaattcctgaaagttcacagtgcctcttcatatgtataccttgggtcctactatgcggttaccatcttgattttataataaagcaaactgggggcggggtgactagattctcacaaccagttagtgaagagccctcgtggggcagcatggctgattttcagtctggtgggctcctgcggactaatgggtcgaggtcctccaggtaaggctgaatgtagaactggcccaagaattcctagttattctcttagtaactttcacatcccttatccagtttgctgccagtgcagtgagaaggaatttcagtttggacttctgggagtgaagtacagaaacccgttaatcaggcagagacagcatgtgtgctcctcagcctgcgttggtgtggcttgcgaagccacctaagcattctgaccctccatttcttcatccataaaacaaggaacacagattaaattatttcttatttaaaaattatttattttttatgtttaccattaccttgatcttgaagtttaaattatttcccaggtcccttccagctgtagtcatttttggttcttagggagagaagccagggactcaaatttcccttcagtcatatttccagctctgtggggtgatttgtggctgcactgttttgctcatttgccgtcattatttccaggaacaaaagcatatgaatatatatgagacacacgcacaggggtaatagcttcgatatccatttacaaataaaatcagctctgtcagcaaactcaattttctgtcaacagggctttgttgatgggaatgcccttgacagctaagcctacttcggtcttcttgtggtaatgcctcataaagccactcactgccaaggtgctcttgggtataacttgcatgaaatttgttataaaattattccgttaaaaaaatctagctggcggacccttaaatgtacttggaggccattaagggtggaaaagctagaaattctaggaaaattttcaacatttatacacgtgtgtgtgtatacacatatacatgcccatacacatatgtgtactacacacattttctatagtaattatgcatataaagttaatgtcatgtacaacaaatatctgaagtctattggataaacaatccatttccgattctggttcagctgagttagaagataggcaggcaatgatctgagatggaaggtttccacagtttggggtcacgtgcaattgtgatagaaggaagattgagattttctcttaatttatgaagctgatatgctattctaactagtttttaatatatcttaccacagggccacccaaaattcaaaattactcctgattttgtaagcttcacatatgtttttgagaatgaggttttatactaatctgggattacagctttctaggctgtgatatacagtttttattaacatttcctattttaaaaatcaattttgctaattaaaacctttttattaagaatatatagaagttctgggaagcagagtgaggatattaacaaatcaccctcaatcctatcacccagagtctccgctgtggaacatggaagtatatctgctttgaagtccttgcaaatatgtttttacacatgcaattatattacacatactgtatgtaagctgcctttttctgtaacttgtatgtgtatggtgcatgacattctaaaatctaacaaccctgtagccatactgtggacatttagggctgctgttggtgtttgacgttgtaaataatactgcagcagatatctgtagtgaaatacttgtgctcttccatgttgatttccttcggataaaattctgggcatggagttgctaggcaggcgctagaaaatatcaccacgttgccctccaaaaagtgtatgcttactatttacactctaggggcaccgatcgcccaggacagtcctacttctcccaaaactttgtcaatattagacatttttaaaattctgtggtttgataggcaaaaaagttatttcatttttaacttgcatttcttcagggactagcaaagtcagacttttttggtgcactgactagccatttgtgttttttcttttgtacattactcttcagcgcgtgttcattttcctactgaagatgagccctttcttgattattgtcatttaggttgcagataacatccctaccgtgtgctgtgtgccttccagatgttagtgggtggttacagttcaacttttttgacatacaagtgtgttgaattttagcgttgtcgcccttgcacctggagcctctgtgtggccagttctgccttttggtggctactggcttctgttagttgtacattgccattactggtctcttgttaccatgtgtgccgcagaaggtgtagccaccaggagctctgtcagcatgaattccctaggaggtgtagacatccatctcggaaggctggtagaaaaattgtctctgtggaaaaattaagaagtgcccagctttccgacaaccctaactcatcgtagttcccatcttttgctctggttgacaggaaactcgtggtcctattggaagcacaaccataggacctctgtacattctcgtgtccggtctgctctttgcataagggtgcttgcccctgcttgtgcccttctgctttttgtttacatttgctctcactgtgatgtttttatgttcattttgatactcaagttgtgtgtttgttctcctgcgtgagacacttctaaacatttcatcatttagggtatacatagatcaaagtaagtggggaccacataaacatatgtagaaacacgttctgaacaccaaagagcttctcggtcaccagttaatattgtggttctttgttgttgttgttgttgttgttgttgttgttttttgagatggagtctcgctctgtcacccaggctggagtgcagtgccgcaatctcagctcactgcaacctctgcctcctgggttcagccagttctcctgccttagcctcccaagtagctgggattacaagcatgcgccaccacgcccagctaatttttttttgtatttttagtagagacagggtgtcaccatattggccaggctggtctcgaactcctgaccttgtgatccacctgccttggcctcccaaagtgctgggattacaggcgtgagccaccacacctggccaatattgttattacagtcactgttttatggaaaaacttagtgacctcatatcgttcttactgggcaagtgagcctaacacaatctgtttctatagtaattgtggaaatgtgacgttacagtggaagaggagagttgggacatggctgtggagtggagctggggctgtccacctctcacttagtatggaatcctctcctaggcccttcagctccagcacactggaagtctaaggggttttgtttgtctgtttgcccctatgttttaatcaccgctaggatcagaagaactgcagtctctgtgaacaggtcttcaggtgacatcagtgtgttacctccctggttagcaattagcattcccgaggtcgggtgctgtgctgcatgcaaagttgaatcaggcacagacagaaccttccttgaaggagtttgtcctctcttaatagtgaagataatatagaaattgtcctagccagtttacactcctaaaacaaattaccatagactaggaggcttaaacaacagacttttattgctcacagttcttctggaggctggtagtccaacgtcaaggtgctggcctgtggattcctggttcacagatggcactttctacctgtgtcctcacatgagggagagcagagagaggaagcaagctccctcgcatatcttttctttttttgagacagggtctggttctgtcactccaggctagagtgcagtggtgcaatcacagctcactgcagcctcaaactcccaaactcctaggctcaagcaatcttcccacctcagcctcctgagtaactgggactttaggcatgtaccaccatgcctggctaattttgtttgtttttgtagagatggagtctcattatgttggccaggagggtctcaaactccgggcctcaagcagtcctcccaccttggcctcccaaagtgctgggattacacgcttcagccacaatgctatccttgagtgcttcttatgagggtactcatccattcctgagggcttcaccctcctgactgcatcaccttccaaaggctccacctcttcatcctatcccattggggttaggatttcaacttatggatttgggaggcagggcacaggcatttagactgcaacataaatgtgaatggctgaggagcatgggattcagaaggcccgagcacatcaggctgcctgctttgctttctgctcctttcttctctcttccctcctcccttcctttgtttctttgttccttctttcctgttgactcagtgagcttttgctgcaatctgctttgtgccaggcattgtgttggacctggaatacagaggtagatgaggcaggggtgagcacagtcgtttcagctaggaggagagatactaaatgaaaataccacagaatggtgaagtgcagtctaggaatcaacaggtagagattcagtactgtgcaagttcagagaagaaaggcatatctgtgtcaatgggtccaggaaatgtttcatggaggaggttgcttttttttttttttttttttttttttgagatgaagtcttgctctgttgccagtctggagtgcagtggcatgatatcagctcactgcaacctctgcctcctgggttcaagtgattctcctgccttagcctcctgagtagctgggactacaggcgcccaccaccatgcccagctaatttttctatttttagtagagacagggtttcaccatgttgggcaggatggtcttgatctcctgacctcgtgatctgcccccctcagcctcccaaactgctgggattacaggcgtgaaccaccgcacccggccccgcatttcactggatcttcagaacaggaatggcttccttggggagggtcccaaaaagtgcgaatcaaaacagagatttgggaaccaccaggcatgcataggtagggcagggcatctcaactcactgcaacccatcagagagtacatctcaacccactacagctcatcagacagtacatcttaactcactacaactcatcagactgacatctcaaatcactacagctcatcacagagtacaactcaactcagtacaactcatcagacagacatctcaaatcactacagctcatcagacagacaaatcactacagctcatcagacagacatctcaactcactataactcagacatctcaaatcactacaactcatcagacatctcaactcactataactcagacagacatctcaactcactacaactcatcagacatctcaacttcactacggttcatcagacagacatctcaaatcactacaactcatcagacatctcaactcgctacaactcatcagacagacatctcaaatcactacagctcctcagacagtatatctcaactcaccacaactcatcagacagacatctcagctcactacaactcatcagacagtacctctcaagtcactgagttttatggtctgtgactgataccccgatagagttgtggaggtgaaaagaatacaggtgaaagtgtttggtaatatgaacacctcctagatccatcctagatgtctagaaattcacatacacatttgtggctcagaagagcatgtaggtgtagggaacaaggtgtaaggtaaactcaaattcatacattgcttgttacctctgcccagaccttagtagctttaagcttttgtcaataatagatcatacctaataaatattacacaacccagatgcttctaaaactattattgaggtaaatgaaaatgtctgccacagtaagatagtatttatcacagagattcagatatgattttttttctcttttaacctaaagaaatatagtaataacaaaaaagtcagctaatatgctataagcaattgttgggaatcttggcatgaaatccagttagggtactgattgtgcccatatcagatttttagaagcagataacctgatgtgtttatgagttttatttctggtctgctttctcctcaaaatttcctgtgtatacattgaaaacaaaaagccagccacagatcacttgatcattatagcataaagagtagaataattgtgttagttaccttgctgcataacaaatcgtccaccaatttggtggcttgaacaccactaaacatttattatctcatacactttctgagggttagggaggagattagctgggttattgtggctcagcatctcctgagattgcagtcaacacgtgggccaggacagccgtcttccaaaggcttgcttggagctagaggatccgcttccaagagggcacccatatgtctgttggcaggaggcctcagttcctccccacatggatctccgtatagggctgcttgagtgtcctcacaacatggttgttggcttccccgctgtgagttatcctcgggagagaggaaggaggaagttgcaatgcctgtgtgatctggtctcagaagtcacacatcggcacttctgccatacatttttaaaccaatttattgaggtataattgacatataaaaggctgtacatatttaatgtatacaacttgatgaatttggagataagtatctataagcctgtgaaatcatcaccacaatcagtgccttaaacggatccatcacctccaaaagttttctcccaccctgtcaaccctctttttttttgttgtcattgataagatctacccccttagcaaatttgtaaatgtacaatacagaattattaactacagacgctgcgctgtgcagtaggtctctgggtaattcatcttgcgtaattgaaactttgtgccctctcaccaatacctccctgtttccccttcccccatcccctaacaaccaccattcattctatttgaaagtttaaaattcttcacgtaagtgggaccatgtagcacttgtctttctgtgcctggcttgtctcacttagcataatgtcctgtaggctcatccatgttgtcacaaatggcaagatttccctcctttttaagtcttttctattcctctatatgcacgcatcacattttctttattcactcatctgtcaatgtctgcttaggtggcttccatgccttggcattcacaatataaatagttcacacaagtgaactattcacaatagttcatgtcgtagtaaacatgtgagttctgccatattttgcttgttcaaaaggagtcagagtccggcctacttctaacaagctccacttgtttgaaggaaggagtttcaaaggaattgttggaacttctttgtttgtttgttttttagaaatgagttctctgtctgttgcccaggctggcatgcagtgacatagtcatggctcagtgcatcgttgaattcctggattcaagtgatcctcctgcctcagctttccaagtagctgggactacaggtgcatgccaccatacttggataatttttttaaaaacttttctttcggtaccagatcttgctatgttgcccaggctggtctcaaactcctggcctcaagtgaccctcctgcctaggcaacccaagttgctgggactccaggcatgagccactgtgcctggctgattttgataactttatacacctcgtaatcaaaacagtaagttccagaaagctcctttgtactctttccaatgaaaccctgccccacaaccatccctccctgatgtgtgaccctagtgagtgttgcctcttcttgagcttcatgtaaactggaccctacttgtgcgttctttggcggttgacccttcattcagggtcgtgcccctgggacccattctcactgctgtgtctcggtagtttttctaaattactggctagtgttcccttctgtgaatacagcaccactggttgatccactcaccagtaggtgggcagtgtttggccaacatgaatgagggcttgtgttgtttctcttgggtgagagagttgtttctctgggagcggtggactggctgggtcgcagggcaggtgtgtgagagtctccttcctcacacagtttcactaggactcagaagccatggtcttttctctcctgtgaagggcttgagactttctggaattgagttcatgtagctgtcctcagcttttgatgagggacgtgtgtgtgttccaataacacttcgtttacaaaaccaggaggcagtggagagttggcccttggtttctagtttgcaaactcctggtctagaaggtaagacaaatattaatttttaaaacccgcgtgtctgtaattgctcattttgaaagcactgtgaagggaacactaagggagaggggatgggaagactttttacatgtgtgtggggagtctgatgaatttgtaaaacctatgattttataacttttctggcctctttttagttgctactgtgagcagtagtccatatgtgaaccagagtggacctccacaagctgccttttgaagttgttacagttagcagagacgaactggcccagggttcaagaagcctttctggctggaggaatgtggatcagtccctccaggcctggaagagggcagtggggggcggggggtgcactcaatcttaccattttcacagatgagagtaatttcatttcagaggggtatgccaaggcagcgatgaaaacttcaggaatagctttgaatatctaaaggaagtgggtaagaaagtgggaggttgggagttccggagggagagttcctgtaaagcagagattcccagggctggctcaacatccacattgcctggagggctttccctgaaacacaggcttgcaggcatgccagcccttgctatttcccacctctgcccaggcctggccctcatcaaggcgggagagcccagctcccagggctcacgctctggaaccaagaatgtggctctccaggcacagagacaatagaggcctggaacagatcctcaaaatgtgtgtgctgaagacatactcagggtccgatacttgagggccatctcacattatcatctccaaatctaggcaggttctgttattgggcattaacccctcgagaaatcagtgcctgtaactatgatttggatcatctgtgctttggatttctcttttaatcttctctgtctcctcccattcttaaccacaagtgatttatcagcctctctaattcaacttcattactctttgccatccaagtccctgcaagcacaaataaaacccaaaggaagcagcagacctttttatccatctgtgaagacactcaagaaacactaaattcatctgactttctagagtaattgctttccccacatggcactagaatcctggcatacagggagcagcttcagcagagacacggcagtagagaaatgactgactgaaggatggttcagggctgttgtcctccctgaaggtggttccaacaggacacaaaagttgcagcagagcctgtgagaacagctgtgtcctttgtcgtcactagctggtctgtctgttcattgggcaatttcagtttttatgactgaaagctgggcatgcaaaggacaaccaaacagcctctagcctgctgatgctcacagtctggaaagtcctatggtaaatcaatatttcttttttgcttttcagagacagtctcactctgttacccaggcaagagtgcagtggcatgatcatcgctcactgcagcctccaactcctgggctcaagcaatcctcccgcttcagcctcctgagtagctgggactaaaggtgcccaccaccatgcctggctggtttttcaattttttgtagagacagggtcttgctatgttgcccaggctggtctctaactccttgcctcgggcagtcctcctgccttggcctccctaagtgttgggattgcaggcacggggcaccacatccaggcttttttcatttgtttttagagacagggtctccctctgtcacccaggctggagtgcagtggtgtgatcatggctcactgcaaccttgaactcccagggtcaagcaattctctcacctcagcctcctgagtagttgggactgcaggcatgcatcaccatacctggctaatttttaattttttttttatttttattttttgtagagactgggtcttgctatgttgttcagagtggtcttgaattcctcccacctcggcctcccacagcactgggattataggtgtgagccactgtgctcagcctggtaaattggtatgtctaaggagagtgtttggtgccattgttcccaggtgttcacactgtttaaaatgtttctaatacatctcagcattgataggttggttgcttggttggtttcttgcctcttttgggctccatcgccttccccactgtctcctttttccacctcatctggcctttgtggagtgctgtgttggcaaaagagctttccacctgtgcctccccaagggtgtgtgtctgtaagagctgcccagggcctgggaaggacagtggagacaccaggtactcgttcgggagacttgtgctcaaaatgacatgggtgtgccggctcttagctgcctgacccgcattctgaggcctggtggcgccgtgcttcttcagcgtgtgaacacctgcctggcagcgtctgatacacctcaccaggctgaagggcagaccagctacctgtgattcctgataaaaattctgtgctttacagaatcccttctatttatgcccacaaccaatggaggagtgctttctagatgataacctcaaactgtcagtgttgagcttgagttgatgtttgagttactgagcgttccacgttccatgctcatggaaacctggctctgtttggaagcagcaatgctgggccctaccccagttgtcccatgagataattgtgctctgtgcacacagttccggtcccagaccctggctttgtagcatacattttcaaggaggactcttgggccaccacagatactgccctatccattgctatttttgatggtatgcttgtgtataatacgtttgtatatggcataagttagcagaatatgtaaatgaaaggaggaaacacctcaatgtcattatccacgggaagtgtgttcactctgtctcttcattgtaaaaatgaggcagtgccgttgcccagagctctcttggcaccttttatacccctcaccggctggcttggtcggctgcaggggtgcccttcccatctcattggctgggtgtgttgcatggtgttatgctttgggaagaaggttgtatggtgctggtgtcacagaggcctgtgtccaggtctgccccatcacagactgaccctttggtcttaggtgctcagcaggtgcctggctcataggaagcccacgcaactccatctcccacaccagggcctttatctgctgctagctcaccgccatcctatgcgatgtggcctgtgatcagcttgtacaggagaggcagctttctggggtgtagttgcctgcctgacgtcacatagctggcacgtgatggatcccgattggatgtgtctgcccggggaaacctcaagtcacaggcagctagcacagctcaagcgtccctaatcagaaggtctgaaatcttaaatgcttcaaagttcaaaactttttgagcaccaacatgatgccataaaggaaaaattccacagctgatctcgtgggatgtgtcgcagtgagaatgcaggtagagactgggcaagctgctgctgtttgctgttgctggcgcctcacagctgaggcgggtgttctggtgccattgccgtgctgcttacttaccctggacacattcctctctcactgtattgatggtatatcgtgcttttcactgttgagtgcttatatatcagtataggaaaattattgcttgttggcagcatataaattcagagtccggaatgacggagatgccagacaactacagattgtgcacatgggtggcagagagactgacacttttgctttatgatggttcggtggatacaaactttgtttcgtgcacaaaattattaagcatattgtataaaattaccttcaggctatctatataaagtgtatatgaagcaaaatgagtgtcaggtttagacttgagtcccacccccgagatgtctcattatgtatgtgtaaatattccaaaatccaaaaacgtctgaaatccaaaacacttctggtcccaagcatttcggaagagagatgtttaacccgtactttagaaagcactcaggcgctggagttcatcgcgggcagcatttcagcagcacctgtgttgtgtgtctgcaaatcagaatgcatccctatcccatcattgacaccaaaagtagttatgatgcctgtggcagtggctcatgcctgtactcccagcactttgggaggccaaggcaaaaggatcacttgagcccaggagtttgaggccagcatgggcaacatggtgaaccccatctctacaaaataatttaaaaactagccaggccatagtggcatacacctgtggtcccagctagtcaggagactaaggcaggagggtcacttgagcctgggaggtcgagactacagtgacccgtgatcacgctgctgcactccagcctgggcaaaacagcaagaccctatctctgtctccaaaaaaaaaaaaaaaaaaaaaaaaaaaaaaaaagtaggtgaggaggaccctgtggtgtgtgttccttaagtcatctgcaagattcagaaattttcccatcctccttgctaaagataattgttaaccctattcagaaaacagtggtggattattgattacagagcagttcaaaactgtttagttgtgttgggaacattcacacacaaggtcctttcacggagaacttaaccatggtgtcttgaaaaaatgcagcttctcaccttttaaaattccgcacaaaaaaagtgaaagtgattgaaagcaacaggtgcatttacattgtgttcaagtgagggcataacatgatgcatgtaataaatatttgcttgcaaggccctgaaggaaatagcccagatccctgccctctgtagaggtgctttcagcccagggaggagcgtggaggcaggtgagcaatgggatgatttgagagagtccccttgctggggcgtgacctggaggtggggtgatgtcagggcaggactgggggagctgagggctgtgtggaggcaggggcagtgcaaggagaccttgcattcagacatggggctggctgtctcgtcgtggaagcaaaaatagagtaatgccagcaggatctctagagtgtttgtttttttcctaacagtggtttcggtcctgtcatagcatgctgggtgactgagtacactaatggtggcccttcctgcaggtttgtccccttcatataagttctgtttggctttgaggtgctgttttagagcttcatgctctgtctccttcagtggcggccagcccagggagaatggcagggccgtgggctccatgtagcagatctctgaagccactgctgcttggagcctgccggccctctcccctctgggaactgtgcaagcagctgtctccttgggaacgtggcattagcatgttttgcatgagaatgaacaccaaccaaggctgaatatcaattggatcctagagtgcagctgcctttgaaatgttcctttgtgtggccgaacttcctgctgcagttgattcctggagcttgtgcgaagacacaaagtcttaagtcatcttagtgccttgcttactctatctctggatcttgctgtcaccatttattttatccttagaagtatggcaaagagaaatgcatacatatatgcagagacacatgtctacacacaggcacaacagagacacacgtacctacacatgcacacaacatatacaacccgggcacacactcacaacatgcatctccacacagacacaacacaggcacacatacccacacacgcatacaacgcacaacacaggcacacacatacaacacacatggacacagagacatgcatctacacacatacacaacccaggcgtacacatacaacatacatctacacacagacacatgtgtacattcagacacaacccagactcctacatctacacatgcaaacaaccagacatacacatacaacgtacatctatgcagagatatacatctacacacatacacagcgcaggcacacacacagtgtacatatagacagacagacatttatacacatacaacatgcatctacacacacaaaacatagacacagacaacatctacacatagatctgtacacatacacaccagatgcatacaacatatagacatgcacgtaacacatagacatgcatctgtgcgcaagcacaacatggaccactcacacacacaacctgcagagctgcctcttggaaccagttagaaacaaaagttggaatatgaccccagcaagtccccaatccccatttttggtccttttcttcgtttgtgttgttgaccctgatggcccagattcttatcaactgcgacaataaaaaccaattagtgattttatagtttgactttgcaaggtgggggtggggggcaaacttggtccagacattgctgtgctgctgcaggtctgaatgaagtgcagtgttgggctggagcgcgccccgtgctgcacttctggcgtgggaagtgacgatgcagcacacaccactcccctgagaacagagcacccagctcctgtagtttggccctctaggaagatgggaaggagcctgtgggcaccttctgattaggagagaagccaggagccagcctgccgtccactttctcagtgggtctcttgctccatgtcattgttcacttctcacagggcctttgctccctgcaggtgagttctctttcgtttatgggtggatctcggagcacttctgcagaaggcactttgcaaatagagttcctttttaatcagtgggtgaccaaaggcacttggattttagcaataaattataggtcatttaattatctgtttctgtgatgtggtgatgtgatatggtttggctgtgtccccacccaaatctcaacttgaattgtatttctgagaattcccacgtgttgtgggagggacccagggggaagtaattgaatcatggggcctggtctttcccctgctattcttgtgatagcaaataagtctcacaagacctgatgggtttatcaggggtttccgcttttgcttcctccgttttctcttgccactgccatgtaagaagtgcctttcacctcccgccatgattctgaggcctccccagccatgtggaactctaagtccaattaaacgtcactttgttcccagtttcaggtatgtctttatcagcagcgtgaaaacgaactaatacctggcgcttttaaataacaggtaccaggtgctttcaagtgggtctatgggtgatagatttcaggagttttcaaagggaaaaaaagtgcaagtgtacctcaactctttggcatgaaatgaattattgaacgctgaaatattgaggctgggcgcagtgactcacacctgtaatcccagcacttgggaggccaaggcaggtggatcccttgagtccaggagtttgagaccagcctgggcaacatggtgaaaccctatctctacaaaaatacaaaaattagctgggtgtggtggtgcacacctgtggtcccagctgctagggaggttgaggtgggaggatcatctgccaaggaagtggaggctgcagtgagcccagattgtgcactccagcctggacaacagagtaagaccctgtctcaaaaaaaaaaaaagaaaagaaagaaagaaagaaagaaagaaatatggaaatgaaatggaatattgaattctgaaccattgaatattgaaatgcaatgtgggggagacatctgacctgtgagagcgcttctcagaatgcaaatcagtttggcagtattttaatgtcattctgtgttttataaccagacaaatgtattgttctctaacccatgcatagctgtgttcaagttttgttttgttttgttttgtttttttgagacggagtcttgctttgtcacccaggctggagtgcagtggtatgatctcagctcactgcaacctccacctcccaggttcaagcaattctcgtgcctcagccttccgagtagctgggattacaggtacacgccaccatgcccggctaatttttgcatttttagtagagatggggcttcaccatgttggccaggctggtctcgaactcctgacctcaagtgatccacccgcctcggcctcccaaagtgctgggattacagatgtgagccactgtgcccagccattcaagttattttgataacacttcaagctaggagtttctgttagtgtctgtctgatgcacatgagaaatctgacttctttgagtggggttgctgttgtctgaagctgaggttgagctatttggttacagcttgttttctaagcctgtgctgtgtcttcagcctcctctaagctgagagcagaggaggctgccctcccaacactttgggaccagacctcccaacactttgggaggccgaggcaggtggatcgcttgaggacaggagttcaagaccagcctgaccaacatggtgaaaccccatctctactaaaaatacgaaaattagccgggcgtggtggcgcatgcctgtagatctagctactccgcaggcaggcaagaggatcacttgaacccaggagtttgagaccagcctgggcagcacagtgagaccccatctctactaaaattttaaaagttagccaggcatggtggtgggcacctatagtctcagctacttgggaagctgaggtggtaggattgcttgagtccaggagttcgaggctgcagcatgctatgatcacactgtactccagcctgggtgacaaagcgagaccccaactctttaaaagagcctttgttggtcttaattttcataatacaatactgattttcaaggttttattaaagaattgatttgcagctcatcttagaaaggtttacccctttgtatatggcaatttcccataagccacataaaaatactgtgacttgaagtaaatatttctgaatctagctgtatgtgagcatttccacaaacattaatgttgtttctaaagtttttgttcatttattcctgcaaaaacaaatgcaatttgtgtgtgtatgtgtgtctgtgtgtgatgtgtgcgcctgtgtcttgaatgcttcatgttcccttgtgggacatgccagtcgacagcctcatgttgtctgaggtgcgtcacgactccccaccttgcatgaggagttgcggtggcgacaggtgtgggaaagtgcatatggatttaactcctgaaagtggcttaaggggattgtgaagatccaggtccagtcccttgtggtgggaaggtattattggaatcgttgattaatttgtacttgttcttcctctagacaagcagatgcccagtgtcgggaaggcagcccaggatcacagcagcacccaccgagtcagaaggcaccgaacccacccacattctctgaactatctcactgccggggagccccagagctgccccgggagggccggggccgagcgggaaccctacctcgagattatagatactcggaggagagcaccccagcagacttgggaccccgagcccagagccctggctcacccctgcatgctcgaggacaagactcgtggccagtgagctcagccctgctctccaagaggccagccccacagaggccaccgccacccaagcgcgagcccaggagatacagggccacagacggcgcacctgctgacgcccccgtgggcgtcctcggcaggcccttcccaacgccatcccctgcgtccctggatgtgtatgtggcccgcctgtccctctcccacagcccctctgtgttcagcagtgcccagccccaggacaccccgaaggccactgtctgtgagcgtggaagccagcatgtgagcggggacgcatcacgtcctctgccagaagcactgctccctcccaagcagcagcacctgcgcctgcagacggccaccatggagacctcgcgctccccctcgccccagttcgccccccagaaactgacggacaaacctcccctgctcatccaggatgaggattcaaccaggtactgtcctgcgacggtgttccctccccatgaggctcctaatgtgggacgcgggttctcagtgggtctttctggggagtcacctgggcaccttgctttagctcaaggcgttggacttaaagtcagtactggggaataactgtgtggacagaaagtgaagcttcagtggtggttggatttttatctcactggggggctgctgtttcctgcagggaacaggggtagatgtgaataggtgatacatcttccccttcctccaagccagatgcatttatatctgcattacccacaggcatctgcagggtagaggtctgtttttttttgtcgttgttgttgttttaatgcagtcaatatttgtgattggaatcgagtttaacctaagcatgcgacctttaggtgaaattggtatttttcatggtgtccagtattttcttactcctttttttccagatttttttttaatgttagaaagctaagctggtatataccttttgttaaagcagaagaatactcattcacatttcatggtgctatcatcaggatttcaggcatggaattattgcgtccattgagatgctgatgaatgttaggcaggaacttgacctttcaagagcactaggcccagcatggtggctcacgcctgtaatcccagcacgtcgagagttcaaggcaggtggatcgcttgagctgaaggagttcgaggctagcccaggcaacatggcaaaaccttgtctctactaaaactacaaaaaattagccaggtgtggtggtgcatgcctatagtcccagcttcccagggaggaggctgaagtgggaggatcacctgagcctggaggtcgaggctgcagtaagccaggatggcaccactgcactccagcctgggtgacagagtgagaccctgtgcaaaaaagagcaccggctgtttagctttcttcacacacaaataccacctccttgagtgccttgaaggactgagaaatggaagaaggggagaatttctgtctcattctctggagcagtggctctcaacctaggaggtggagtgtgattttggcccccaggggacattaggcaatgtctggagacagtttttgttgtcctaagtgcgatgggagtggggggtgctctctgcatctagtggtggagcccagggaggccactcagggtctgcagtgtgtgggcggcccccacagagcattgtccgaccgcagatgccagctgctcttaggctgggaaccctgctgtagagccgcacgcccagcacaggacccaccatcacctgtgctgtgtaaatgtggggcaaagaaaaccaagtcgatgaatgcaggtcctcagtcacaccaggtgtggcgggtggctgccgtcctggacaggacagataacaggtattcccatcgccgcagaaaattctgtgggacctcactgctctagagtctcaagtaattttttttcttagcttctaaataactcagcagagaaagaacatgactgatactgatcctgtatctccagccgaggcattgtaaccacagttttctctgtgggccaaaactgggctttgcatcatttaaaatgtatctaaagatcattcagatatcccttgaattggtaacattgtaaggttctgaaaggaaagtgtcttactcctttcaggctgctataataagatctcatagactgcacggctcattaacaggagaaatgtgtgagttgatgagggctggtcgctggaaggtccgacccactgtgttctgtccttattttgaagtcaaggctcgtgaaactgttctcatgtggaagtcaagactgtttttaagaagagagaccatttctgttaaaaaatgatcaggaatagatgctttgttggaaagtgtatgtgaacccgtgggagataggagatttgttttttttccttcccggtactgtattttatattattatcattattattccctgtcgcccaggctggagtgcagtggtgcgatcttgacttttgggttcaagtgattctgctgcctcagcctcccgagtagctgggattacaggcacctgccaccacaccaggctgatttttgtatttttagtagagacggggtttcaccatgttggccaggctggtctcaaactcctgacctcaggtgatctgtctgcttcagcctcccaaagagctgggattacaggggcaagccactgggcccagcctctttcccaatattttaaaacctgtgaagggagatttgtttatgttgtttaatttgtttctattgtgcacatcaaatttctgcacaaaagggggaggataccaatacaggctgatgtgaaagtcagtaataggcaagcagagcttctcccgggagccgggggggcgggggtgaagggagtgcagagggttctgcgtttgctggtgcttggataaggtggccaggttttcctccttcttttattattattattattattattatttattattattatgtttttaacagagaggtggggaggtctcactgtgttacctaggctggtctcaaactcctgggcgcaagcagtcctcccaccttagcctcccacagtgctgggattccaggtgtgagccactgtgcctagccagggttttccttcataagtctgacctatctaaatggtattttccacagttagactttgtaaattgtcttcatgaggaagcagttgtgaggtgtctgtgagtccctagataaaacacatcagatgttgctgaaccctactggagagagggaggaaaatacgcagttagttcatctcagcctgagcaccactgccttgatagggaaagagccctcctgcattcccagtcaccagtgaaagagggaaaaacagcattaaatttagagcatcgtggctgccctcctgctgtggaaaattggatacatttgtgtaacatcgtaggggcagttttgggttgacttcattagaaacacatcctaatttggggttgtggagtttggcctgtttctttttgcttccctcctgaccaccagcatatggggctgcttctccagtgctctgaaaagctcttggctgagatggccctggtcagcatggtctagcacggtgccgctgagagcagcaggtgcagggctgccccagacaagggactgtggcattgctgggcctgttcctcctgttctctctcccccagtctcccagggatgctttaggtacctctctagtccctttcatccagaaacttttcttttttttttgagatggagtcttgctctgttgcccaggctagagtgcagtggtgtgatctcaggtcactgatctcagctcactgcaacttctgcttcccaggttcaagcgattctcatgcttcagcttcccgagtaggtgggattacaggtgcgcaccaccacacccggctaatttttgtatttttagtagagacagggtttctccatgttagccaggtgggtctcgaactcctgaccacaagtgatccacccgcctcggccttccaaagtgctgggattacaggcatgacccaccacatctggctgacacttttttaaaaaaaaagcaaaactgtgccctttggaagtaatacagaaccgatgactcgctgcttactgcgagatcgtatctcactggtgtgcaaatctgtgcaacgctagcttgaagcacagcgggcggggggtacaaggacagtgttgggtgggctgtcctgcatatggcacaggaggttctcccaagtggggtggtggggggctttggcctgactccaagcacggccactccggagaggagccctccccaggccctgagaactacgcaggaacccgcgggcctgcaccaacctaaggacggatgggaatcctggaaaatgcccatccactgcaggcttcccctacaaaagaacatttaacccaacagggcttgttgaagtttgcattatcatctgcggaatgacaaatggtattaaatagtcctcacagccctccacgaacccctggaggacaccttgggatgcctcaggggtggcattggcggtttgagcatagaaaggatgctgtggttggaaggcggaggtaggagtcagagggagcttcttgaggcctctgcctcatccaggatgtgggatcatggaggctccttcgagttgggtggctggctagtgcctttgagtcaggttcccatccagaggggagggcaggggacacgtcaatcagggtctgtggctggagcatgctttgcgatttcagcagactgttcatcttccagaattgagcgggtgatggacaacaacaccacggtgaagatggtgcccatcaagatcgtgcactcggagagccagccagagaaggagagccgccagagcctggcatgccccgccgagccacctgccctgccccacgggctggagaaagaccagatcaagacgctgagcacatctgagcagttctactcgcgcttctgtctgtacacgcggcagggtgctgagcccgaggccccacatagggcccagccggctgagccccagcccctgggcacccaggtgccccccgagaaagaccgctgcacctcccctccagggctcagctacatgaaggccaaagagaagactgtggaagacctgaagtcggaggagctggccagggagatcgtggggaaggataagtccctggccgacatcctggatcccagtgtgaagatcaaaaccactatggacttgatggaaggcatcttccccaaagacgagcacctcctggaagaagcccagcaacggaggaagctgctccccaaaatcccctctcctagaagcacagaggagaggtgagtaggcgtggcctcccagcttgggcgtgactctgcctggcatctcttaggcttgtaaagggaagggggtctgcctctctgttttcatgcgtgcttttggggaagacgggttttcataagggctcctcgatgcttagcactttttggcttttttgtgagcctccggaaagagaaatggagggttaacggctttgggcctgacatgaaaatacacactgcagaccaccaagctgccttggcctgaggccagcaggatttctgatgatgcccacaggtctcctttctcgtaagacagctgttctcagtgggggccgctgtctaccctgggggacagttggcaatgtcactgtggggaggggtgttccaagcatctggtgggtggagcccaggaacactgctcaacatctacagtgcacaggagggccccccccacagagagtcatccagcccccacgtgtccctagtgccaacatgagaatgaaggcttagattgaatatatatgtgtttctttatgaaatgtttttttaaaactttatttgaaatttttttacatctgcatttaaaaaatttattataatttggccaggcacagtggtgcacacctgtaatcccagcactttggctgaccgaggtaggcagatcatttaagcccatgaattcaataccagcctggacaacatggcaaaacccagtctctacaaaaagtacaaaaaattagccaggcgtggtggtagacacctgtagtcccagctactcgagaggctgaggtgggaggatcacttgagcccaggagttggaggctgcagtgagctatgatggtgccactgcactccagtgtgggtgacagagtaagaccccatctcttgaaatagaaatgaaaaaaaattacgacaatttacacctgcctgaacaaatgtattttaattggttttgtaagtagcactttcagcgtatctccttcagccacttgaccacaaaggcatgcgtggtggcatcttccctgctgctgacatatgttctgccagcacagcgtcattcatgggtaggaaggtggagtgggtatgacacacagccaaggaggagcagctggaccaagtggacccaggcaggagggcgccgacagggctgctgggaggaagggagaagggttggtgtttgtagatagcgtcacacatgtccttgtcctcatcaacccaggctcctggtagagatcatctgtgctctcacctctgtagcagagattcttagatattcctgcttatttgagtttttgccttttttaaaaactatgtttcatacacttacgagtatccatttgacagggttgatggtttttagttttaaccttgttacctacttacttttccccctttggctgtctcatctccctggctggtgtcctttcgtgagcaccagtgttgatttgtcacaacccagggggtggggcagaggggctgtttgcgtgcacagtcccagctcattgaagttcccacacctttacccaggaaagaggagcccagcgtgcctgcggccgtgtccctggccaccaattctacctactacagcacgtcggcccccaaggcggagctgctgatcaagatgaaggacctgcaggagcagcaggagcacgaagaggattcgggaagcgacttggaccacgacctgtcggtgaagaaggtaggagagtccattccaaatgacagcgtgtgcgtgtccaggcaggggcaggcatccggatcacaccatcctgccccagcgcagaccctgcaccacgtgtcccagggcgtttgtgttcagctttcactcaggacagtggaatttgaggtgatattagtgaagccctctgttgttagttctatgtcctaatcttgagccattccacaaacgtctctttgctgtttcaataggatccaatgtcaaattagtttagtcaccattctctttcattttatcttatttatttatttttgagacagggtcttgctctgtcgtgcaggcttgagtgcaatggtgcaatcatggcccaccgcagccttgacctcctggcctcaagcgatccccctgcctcagataaaggaaaattattttcaaattagaaagtggtaacttttttttgagatagagtctccctctgtcacccaggctggagtgcagtggcacactctcagctcactgcaacctctgcctcccgggttcaagcaattctcctacctcagcccctcgagtagctgggattacaggcacctgccaccaagccttgctaatttttgtatttttagtagagatggggtttcaccatgttggccaggccggtctcgaacctcaagtgatccacccaccgcagcctcccaaagtgctgggattacaggcgtgagccactgcttccgggctggaagatggtaactttttggttcaaggtattaaaaagggaaatgaaaattaagggtttaggtcttggggcttttacgggccctccatctggcacacggtaccattcgcttcattctggttgcacattcctcttttaaaaaataataaagaatccaaaacatgttcggtttttccacacagaaccaggaaaatcataccatctggaccatttgaatttgggtcacaccctaggtttagagaactgcattctttgctcgcatgcctttgtttttcatgatataatgaatttcagaagcggcatgccttgattctgccgccctcatctgtggggcactctgtccacctgctttgggaggctggagatgctgggaagccgcctcaccagaagtgtggctccggaactgagtgagtcactgtgggctggaagttggcctcactttagttcagcaagtgtgagttgggcacctgcaccagaagcacatgctgtacatcccagctctctatggtgctgatgactcagcggtcctgttttcctgcttgattggacaaagcggccactgctgcattacattttctccctgctttcccgcagccacacgcttatgatgtcgcacattcctgcaacgcgtgcacaggcggaggcgtgttcagggaggaagcgagcatagcgcagatggggacttagcaggccacctgctctgtagctgcttcaggggaacatatgagaccctaattccgtaggcttccaacattcccagggcgaccacagttgtctcagtcacagcattgctaggtggtcatagagctgagagccaaatcagggaaccctctgttttaggagaagactaaggacagagttgagagagtggaagccccaggcagggaggcagcagggggctctggtggctggtagagaagcatcacgcagagatgacaagatatggttttatacttggggcagctcagaaggactctgcccagaaaagagggcaccatgttgagttgaaccagatagctgattggtttaagtttagaatctttgagaattatggcttttccctggaaccaggaggtgagtgcagggcccagacagaatagaccttgtttcccctatagaagggaacaaaaggtggaggaagggaatgaatggcccagggctcattcttagtggagggatgagagtggctgtgtgcctggtctctactgttgcaggctcttacctgagcctcctggaaagccacgcactgcaagaaatagcagatgggcctgccagacagtatggaccacagtggtgagcccttcagcaccctgggtggtgtggacagccactgatctgttcactgtcccaggccaggtcttgtctcagaaatctttgaaagccaacggctgttctttatacaatggccctttaacaaaggggaaatggtttcaataaaaatttgcatatgacatgtaaaagaaccaataaagaaatctggactcctttcagagagcccagtttcaaattagctcagctgaggtaggttttgagggcacatgttcatgcaccagtataaaatctacatttccgtaattgctgaagaataatggcactgaaaatttcctgagcggccgggcgcggtggctcacgcttgtaatcccagcactttcggaggccgaggtgggcggatcacgaggtcagcagatcgaggccatcctggctaacatggtgaaaccccgtctctactaaaaatacaaaaaattagccaggcgtggtggcgggcgcctgtagtcccagctactcgggaggctgaggcaggagaatggcgtgaacctgggaggcggagcttgcagtgagctgagatagcgccactgcactccagcctgggtggcagagcagagactccgtctcaaaaaaaaaaaaaaaaaaaaaaaaattcctgagcagccctggcgggcgtccttccttatccacagttccctgcattgcttgcagtcttccttcaggctagcattggtatcaggaatttgggaagttcttcatgcctgtttcctgttttgtgcttttccctcaagtgatgactatctaaaatttggccacattctcagctgtgagattctcaacttaaacagtctctccagataggtagtgagtaggaaaaggcacaaaccacttttcctctgctctcacgccacagcaaccaacacagaagacttcggtgaccacatgtgtgaggggggtttcccacacacccagcgagcagtcacttctgcagcagacaccagctgggtggcctctgattcagttcagatgtgacactgtcaaattggaggtagcgtctcatcccacgggttgagggctcagtccccaagactgcaccccccacacacaccagtcgcaagtctgagtctcagggacttctgaccaaccaccttcaagttggggttcccatgaccccctctttagtttccattactttgctagagtggctcacagaactcagggaaacatttacatctatgataaagaatgttacaaaggatacacatgaagagatgtgtagggcgaggcatggggaaaggggtgcggaagagcttccatgccctccctgggtgctccaccctccaggaaccttcttgtcttcacctgtcaggaagtctccagccccgtcttcttgggccttttatggagccttcattggataggcctgatagaaatctgtgtagaaatgtgattggacaaaaagactacaatccagtcctaacagaccgaggagaaagccacaaggtctgcctgttgagattcttgttggcctctctgtgtagcgttccttccccctaggtgtgccgcaggacccttcaggaatatggggatcttaagacctgcattcattcaaggcggtggaggatttctttatggaaaggttggggaagattagatcttgctttgggcaggtaaaagtttaagaccagcctgggcaacatggagagaccccgtctctacaaaaataaaaaaattatctgggtgtggtggtgcatgcctatggtcctagctgcttaggaggctgaggtgggaggattggttgagcccaggaggtcactgctgcagtgagtggtgatcatgccactgcactccagcctgggcaacagagtgagaccctgtctcaaaaaataaaataaaataaaataaaataaatgcatccatgtgagggaaagacctcacgcaatcaggaaataggctgcctcgtatctggcacatgtttctcctgctgtggggttgacttttcctgcctaatgctcatccggctggtcattttacccatagattatggaatcagggcacgaccacttgaagccaggagtttgaggctgtagtgcactatgatcatgtctgtgagtagccactgcactgcaacttgggcaacatagcaagaccgcttctctaaacaagtagaaaaaaggtcatcatttagaaggctggtgggaaagggcatagagtgttagtgtctaatagttacgcagtttcagttggggaagatgacagagttctagagacggatggtggtgacaggtgcatcgcagcatgaatgtaccacacaccacagaactatgctctgaaaagtggtcaagatggcaagctttatgttacatatattttactacaattttgaaaacagtcatctgtttgcattttggtcaagttgaaatcagtaggttatagtaaaagactgttaagttcattcgtatccctttattggtcttaatttttatatgctagtattagcaattaaaattttttttctttttttttctctttagcaattaaaattttaattgctaggccaggcccggtggctcacacctgtaatcccagcactttgggaggccaaggcgggtggatcacctgaggtcaggagttcaagaccagcttggccaacatggtgaaaccccatctctactaaaaatacaaaaattagccaagtgtggtggtgcacgcctgtaatcccagctactcaggaggctgaggcacgagaattgcttgaacccgggaggccattgcactccagcctgggcaacagagcaagaccctgtctcaaaaataaaaattaaataaataaaaataattgctagtgacaataattatatgtacaggacacataactaatcacggaatttggtgctggacataagactcactactttctctctatgtgaatctttaaattagaaaattccaaaggacagaatacataggtctgtgactccttccaaagatatgggttgaaactgcatctaccatgacgagcatcggggccacaactccgacgttctctaatagggcatgaacagaacgagaacaggtttattttatttttaaatgccaatagtgccattaggagtcattcttctttcccttagtcgtataaatcccctattatttggtgatgcaaaagtgagctttcacgcaggtcagctgcacctttcacgtaggtgcgccaaggtggcagtgagcagtgtggccggggtgggggccggcctaaccagtgtctccgtgttcccttgccatcccgtgcccaacagcaggagctcatcgagagcatcagccgcaagctgcaggtgctccgggaggcccgcgagagcctgctggaggacgtgcaggccaacaccgtgctgggggccgaggtggaggccatcgtgaaaggcgtctgcaagcccagcgagtttgacaagttccggatgttcattggagacctggacaaagtggtgaacctcctgctgtcgctgtcaggccgcctggcccgggtggagaatgccctcaataatttggacgacggcgcttctcccggtgatcgggtaaatgcagatacgtctgacttggaaatggggggtggtctcgtgggaaggctgtttttcaagtgtcgtgaaagtcagctccttggagcctagcatagcttccacatggcctgtccacctcctcctgcagaccttgtcgagacagtgcacgctctataccctctccttccttttatatttctttagttgtttgtttgtttgtttgtttgtttgagacagggtctcattctgttgcccaggctggagtgcagtggtgcgatctcggctcactgcagcctctgcctcccgaggttcaagagattctcccacctcagcttcccgggtagctgagctcccaggtgcatgccaccatgcctggctaatttttgtatttttttggtagagatgggatttcactatgttggccaggctggtctggaactcctgagctcaagtgatccgcctacctcagcctcccaaagtgctgggattacaggtgtgagcaactgtgcctggcctccttccttttaattgaggggaaaaggtgcttatcagatgcagggagttgaaccgtcattggactgcagggttgcgggatcttctcaaagaactgttacctctttttaacatctttttagatattcctattgactcttactgataattgtctcttcttagaaaaatcatgttgttgttgtttttacttttcttttaccatgtataagtccgtaacagacatgcctgcctgctgacgatcgtaagtactcaatgatagctattttcttgtggtggttgtagctgtgatttaacaagagggcatgtatcagtctagaaggaagcagacagtgcatctaacttcaaggcgtttctcagtgggtctgtcttttcgtcctttcacatatgaaccaagagaaataatagctgcctcgttggcttttacctcataggccaaatatcagtaaaacagctagttttgtttgcacagaacaggccttcagaatgttcatctgtatcatgaataaaacatcttaacctctctcagaaggggagcagaagaagcacccttcccctttctccaggtgagggtgatttgggccacgcagaacgctgtcctggcgctgggcttggagacggtgcccttctgcactcagccgagtgcttagtaactgtgtcgtggaactagctaggtcagggtggcaccgtgcccgagggggctgctggccgacacccgtgcacagcactgcgtcttctccaccctcaggcttccttgtgtgcagatatgctctgcaggctcgggggcttctcctcctcctgccaggagcatttagtaagcctaccctgaattcctctcgagtccacccatgtggccagctgtcccacggtgttcccatggagcggaccttgacgccaagagggccccgcagtcctttgccctttgcagcatctcagaattctgtcgttgtgagtcccttggtgactcttctgctcaccattcgaggcaggtgggagagagtcaggctcagacagcaagaggaaacccagagaggcctgtgggcggcttctgggggcctcaggctggcccgctgcaaccatgagacacatgcccccaggccctgggccctgggtttgtctgtgtggaccccatcggatctctggtggcatcagggtttccatcgataagttgtgggaccagcccacaagttgccagtgtcttcaagggttggccagtgccccagctttcatcctggtcctcaacaggcttgtttgtctgtcaacagcaatcactgcttgagaagcagagagtcctgatccagcagcacgaggacgccaaggagctcaaggagaacctggaccgccgcgagcgcatcgtctttgacattttggccaactatctgagcgaggagagcctcgcggactatgagcacttcgtgaagatgaagtcggccctcatcatcgagcagcgggagctggaagataaaatccaccttggtgaagagcagctgaagtgcttattggacagccttcagcccgaaaggggcaaataagagaccagtccccggtggaggaggggcacggggcctccgagctccagctccgttcccaaggatactcgtgaagaccccatctgtgttcatggcctggaaagagacttctcccatagcaaagaggctgttataaaagcaataacttttgtgtttgtgtgggatgatttatttaattttttagtttcccctttgattgctgagagccattttcctttacacataactacacctgacaccaggctctgctggatgtgagtttccactgcatgggctgtgggctgggcctgtggtgcctgccgagtggtcactgtcagtgggaaacccgttgttcctcccgtcttcagatgctgagccaactgcttggacagcagccagcgcgtcatgacgtgcatgagagggggaccctggtgctcatcttctcttgtcattcatccaggcatgggctgccaggttttgtccctgctcgttcaacagtgtgagcatttgtctctgttatctaatgatgttctctgacccagcagaaatcatcatcatgatgatgataatttattaactttttggaagggtgaatagtttcctaatggttaaaaaccaactgtgaaaggaaccacctgtgtggttgggttcactcattctcagattaaattgccacttaaagaaataacgtgcatgctttaaaaaacacagtcacgcaccaagcaggcaaatagctttagtccttctcacctcacatcacagttgttctgcaaagtaaaattttttggttaagagcgtgtccagtagtaatgtgcttgttagctgtttctcaagaccaacagaagattttttcagttactttccccccatgtattttgtatgcatatgattgtccgtgataattggctacttttccattgtttcctccttaaatcgtttagcatggcatgagggccacattccatggacgggaagaccccttcctcttcagaggtcccgtggactacacagctcctgagcttgatctttttctgccatgaagtttaaagattctatgcccatttccttgattgaaatggcaggattctaaagagagcctggtttgttaaaagaaaacactgtcatgctgtcagttcccaattgacaagtcacagactgggagaaaatatttgcaaatcgtgtatctgacaaaaggtttgtgtccaggatgtacaaagaactctcaaaccggatagtaagaaaacaaacagcccaagtgaaaagcaggcaaaagacttgaatagacacttcaccaaagagcatacacgcgtggcaaacaagcacacgaaaagacgttcagccgccgatggcttggttataatttataacttacttatttttatctaataattgtagattcagtgtatttcttcaaaaaatgtttaattaaatgcatgttaatggtgagtgaatcccttgggtgacttcgtgtttaggtcgtattagggcatttgttggatcaacggatcattttaaccctgacttccccttattcccataaaagaagttttccagtggaatggagatttcattttgtcagcagcagtgaccacagccttaccaaagcagacgcgtgcgcgtgcacagatgcacacacacagatgtcttaaaagactagaatccacacttcctgagccagaggggccgtgttgacggtaatgcattctctatagagccaagtccaaactggcaagctcaatgatgcaggcaataaaccgcctttttggcagcctaccaatgccaaaaggataaatgtctttccaaaagtgtgtattcctgttaaattaagctcttgctaacttgaaaaatccctgttctgccagcgaagcttcctcctcctctccagctggtagtcacttgcgtgaatgctggtcagtctgaaaaggtgaagctggctgtgcacttacccccatctttctccctcggggagacgacccaaggaatttcagagtattttgtttggcagagcttttacctgttattctttgccctcaaatacagtattgtggtcattttgatgatatgtgtgtaaaatgtgaataatccaattggtgtctgtactcagccttttgatgtctttttaggactttctcttctacacagcaatacgtcgtgctcgagtatccttgtagcaaagcacatagagccagctgtcctgtcagttcccctgtttgcctctgaaacgtctggttagtggggacccaaagattctagtgagtcaacatccataactctgtatctagttgtattattcatagaaaatcaatctggtgctaatggttggccctggtgttgttgggtggcagctgctccttcgccctcttgtagtgtggctgtggagggctctgcctatggggggtggcctgtggcttgtatccttcagtccaccacagcaaatgtgtgtagatttcatgctcgacacttaccactcacctatcaacagatcatcctgcttgactgtaacaaaataaatagtgtctcttcaagtgaa

SEQ ID NO: 2961 - DNA, 162987 bp, human; identical to SEQ ID NO: 2960

SEQ ID NO: 2962 - DNA, 162987 bp, human; identical to SEQ ID NO: 2960

SEQ ID NO: 2963 - DNA, 162987 bp, human; identical to SEQ ID NO: 2960

SEQ ID NO: 2964 - DNA, 39001 bp, human
aggcagcttgaggacttggtgtctcattatgttgccctttgcaggaagcttctgtcgaactgcgaaggcaggcaggggaccccggcgagcccagagaagagcttccctccgcagtccgggccgaggagggacagtccacgccgaggtgggtgaaatttggattcagagttactgaagaggcgtctgagggtgggcttctgtacgatgggtgggtgcttggttaacatggctagatgtctggcttttgccaaacccaaagcggctgaaatccggcgtgatttctagcatccctgacgtactggaggtctgggcagagcctgtgcaccctgcagccctgcctggagacacatcccagggcggggaggccttcttacacggcggtgacattttttggttcttaaaatggctactgtgttttccgcacggtgagactgcttatggagacataatgagaagtccagttgaacatactggagctgcacgctttgcacagagcgccttatggaagggcagctttagctatctagcacacagctgtgtgcctagccgcggcctggaaatcagagttgcctctaaggattgttagtaagaaaggaacagggcaggccttcctaaattggacctagttaatgagttaattttgagctttaaaatagaaatcgagttagtcacctcccaaagagaggcttcaagcatctgcaggaactgtggcagcagcaggagattagagcgttttgtgccataattccagaatgtgcgccgtagccgcttagttgagacaaggacagggttagattaaatacatagtataatctgtgctgggtgtggtggttcacacctgtattcccagcactttgggaggctgaggcaggtgaatcgcttgagcccaggagttcaagaccagcctgggcaacatggtgagatcccatctctactaaaaatagaaaaaaaaaaattagccaggtgtggtggcagatgcctgtagtcccagctaccctggaggctgagctactcgttcaagcacgagaatcgcttgaacctgggaagtggatgttgcagtgaatggggattgcgccactgcactccagcctgggcaacagagcgagaccctgtctcaaaaaaaaaaaaatagtataatcttccccttcatcacacgaggagggcaggcagagagtgtgcgtctctacagaagatgtggtgcaatcttgtttcaaaaaggcggatggagggatgggagtaaatgcacgacagggtccccgggtgtggatttttctgtcgccttgagaatgttgtgtgattgccatgacattcacattaaacactgacctcaaaactcaaggttctgttgcagaaattaccaatttaaaagtttgctttcaagagcctcatgtaatggggttttatttcatttggccttaaacagagctgttatccttctacaaggggatcaaatatttatgtgactctgcaacgacaggattgatattgtgtgtgtgcttgtgtaggaagtctctgcagttacttaacagactctgaggctgaaaccaagaatgcgtgggtcagaaaggccgacgaataatccacctacagaatttagctgtgtctgagaagcacaattagagctttatgactgtggattccaagtaggtcacgtgccgagcaccagctgcagtctgttttccaagccagctcccaggccgttgaggctggccgtgcagtgcatcgtgggcagtgctcgatgggctctgcacatgcgggccttgctttgcccgatgccaccagtgtatcatctgtgcagagggcacccgtgctggtgagagtgtatagctctgctgtgcatggagggggtcgccctgaacagctgtcacgtgcaggctgtgtgtgagtgagtgaatggcactgtcgatactgaaagggtcgagaggaagcggggccccctgcttcattcatcaaggccatgtctcccagcagactgcataaccactccaaagaaattagttccagaaactctctgcttttgagctaccaacccagcaattttcagaattgttgggtgcggttttttttttgagtggtgaggcgcgatgaaattcgagaatatgtaggttgaaaagttgttttcaacttttttcagagactctttaatttctgaaggaccagcaagaaagaatacacttgaaaaatttcaatggagaataatagaagtcaaagttcaggcaagggattgttctttgcccaccaaaaagaaaatctagaatacaaaggtttgaagatacccagtgttttgcataagtttcaaataacgtaaacatgtctgtgtaaatcatatgaagtgctgctctgataatcgatgcgtagcaaaaagtatgtattgtattctgtttggataacaaaagaatgttgagatcggaattgttttttgttgttgttgctcatgtgaaccaaatagagataacattttttgtgaagttcaagatcctgttaatataaagacaagtagggcagattgaagtgatgatactttttttttaagttacatgatgtttcagaagctcagaggagatagagcaaagtgacttctggctgggttatgggagaaacaggtggcgtttgagctaaaatagaactgaacctgagggagcagacccagcacgtttgcttccctccagctcttctgtcctgaacagcccaccgcaccccagcccccacccccactgccatcagaggcttcacctcagacccacaagctcaggcatcatagccagctggagcctgctttggggaaatgctctctcctgctgacttggggccccttgaatgctgggtctgtttcctagtgtggccataacaaactccccaagactgggggactcaaacaacagaagtggattctcccacagtcctagaggctggaagttccagagcaaggtgtgagcagggctggttcctcctggggcctctctcctaggcttgtagatgccgtcttctccctgtgtcctcacaaggtcgtccctctgcgcatttttgtatcatttcttcttataaggaccccagtcctattggatcagagccctccccaatggccctaattacctaattttaccttaattacttcttctaaggccctgtcttccaatacagtcacattctgagatactaagagttatggcttcagcacattgattttgtggggcacagttcagtccctaacactgggagaaatgtccctgcttctccattctacctttatagtaaccacttctacctgctgtcagctctctcaggaagtgtcatcctacccttgagctgatcaggctttacgttcatgacagatgtgaaagcctttaagatgaagggaagagggagctgtcaccctgtgggtggcacagaagaggggcatttggcaaaacctgactggagggctttttgagaaacctgtctggagggttccttggcaccatgcaactgaaggctgacagctctgcacaccttctggttcagtcaatccatctttaagagtttaccttgaaagtggacatccactgccccatgaatgtgctaacctcttcaaactgggatggtttggcagggggacagtgactcttaaactcacatcacggatgtatttgtacaccttcactattccttgctgtctgctgggctggaccgttggctcctggaagatgggattttactttttcatttctcagtaccccgtacctgacataattcctgcacagattacatgctcaataaatggttggatggatggagggactggtggatggacagatgggtggttgagtagacagatggatggaccagtcctcaggtagatagttggagggtggggagggtgggtggatgaatagttggatggatggaagggtaagtggatagatggatggatggatgcatggatggatacatggatgagatgtagggatgcatggatggatagatggatgaatggaagagtaagtggatggatggatagatgggtgtgtggatggatgcagaggtgtatggatggatggatgggagggtaagtggttggatggacgaatggaaaagtaagtgggtgggtgggaggatggatggataagtagatggatggatgaaagggagggtgagtgggtggatagatggatggatagaggggagggcaagtggatggatggatacatgggtgcatggatggatggaggcatgggaaggtggatggatgagtgaatgggaagatagaaggatgggtaggtggatgtataaacagatggattggtggctgaatggataaataccaggctgaccttccttgagttagtctttcttgattgtggtgaataatctttccatattggtacattgtgtgtcctaaaattttatttagaattttagtttacacactagtaagtgaaatggcctttatttatccttctgcactagcatggcatttggaatcaagaagacataaacatctcaaaataaatttggtagcacagatttgttttgggtatgagattttagaccttgtaggaaagtttagaggtaccacatttgttcgttgctcctcaatttcgagaggccttgggtgaggactgtgttctgggtggctccagagactggcactgaaatgagatctgggggcggccccctggagctgtgggtgctggcagtgtcttccttctgtgccttcttgcagccacttccgcccccgcctgcaggagccactgccaagcactgatgagctggcactgacctcaggcttgtattttgttgggacagatgggaggggaggcaaagaaagagagtatatcctaaatcccaataccagctgcaaaattgaatgcatacgaaatagagctctttagggaaaaatttgctttcatataatatgtataaacaagctaaatgaacctgagggtcatcttcctggatgttttccctgagaggtgacttggtgtacagagattcatgtgaagaccaatttttcatttacaaaacaagctccttcatgtagatttcagaataagtaacagagatttatcatccaagctctccccctcatttgtcactttagggcagatgtttgctttccctggccttcaattagctcagggcaattgaagctttccattctgagctgctgtgctaggtaattatgaatagactgtgctggatcgggtcaggataaaaaggtgaaacttgatcttggaattttgtcagggcagagcccagcattctgcatagctttgtacagtgtagtactgcatgctgagcagaaaggttcttgtgcagggagtacttgcggatgtaacaccctcaccccagaagggataaacggtagctgtaggagagagcctgcggcatgggtctagcggacttccctttatgtctttttttgatgttgttttttgagacagggtctcgccctgtcacccaggctggagtgcagtagtgcgacctctgctcactgcagcctccacctcctgggctcacgtgatcctcccacctcagcctctggagtagctgggactataggtgcacaccaccatgccagctaatgtttgtattttttttgtaaagatgaggtctcaccgtgttgcccaagctggtcttgaactcctgggctcaagcgatccacccatctcagcctcccaaagtgctgagattacaggtgtgagccaccacacctggccttgtttttatgccttactttgcaactacaatttccccttacatttatacccatggggactttaagaaacccaggaccgagacaggcggccacccgtttgtttactttttggtttggtcgcgtgattctagattatttagaaggaatagctttcaggtgatagtttatggttacaggatttcggctaaggaggagaagcgggagcagggaggcagatccacaaagccctcgtgtggagggagaagtgtgcaaaaggagggtgaaagtgaccaatgccccaagatgccagagctgagggaagccagagggaaatgcagaggaaaatttaactcaggcatctcagttctagatggggcaggtaagcagtcttctacaaacagaatttgtgtcattgagcagggcacagtggcacgtgtctctaatcccagcactttgggagtctgaggcaggaggatcacttgagtccaggagttcgagaccagctggggcaacctagcaatactctatctctacaaaaaatacaacagttgctgccccatggttgggtgccaacatacgtagctgtactcgcacaggatccttgatccctcatgtgactcctaggctgtggcctgagacttgcctttccagaagaatccagccctgtggaaagctgcccctttgtttcccagcagccccatccctggagcccccagcggcctctcttgggggagagactcccgtagcacgtgctgacgtggcagccccgctctgctctgcctctcctctggcctcctttcttgtcagctggctgcgttcttcaaagctctcagcctctgggccgaccttggctgcgttcgcatgttacgggatcctttggggctttcacctttctccagagagctacctggaaacatagatgtccattctcccctttagcttcttccagcctccattcctcttggctgtgtcctagtccagtcctccacccagattgggctgaggtgacacagacatccacccagaaggctgtacagattgataaccgattgattcattcaaagggtcttgctctgtcacccaggctggagtgcagtggcacaatcatggctcactgcagcctcaacctccaagctcaagtgatcctcccgagtagctgggatcacaggcatgcgccagcacacctagctaattaaaaaaacaaaaaaagtttttgtagagaaggccttgccatgttgctcagggtggcctcaaactcctggcctcaagtgatcctcttgcctcagcctctcagagtgctgggattacaagggtgagccaccacaccacacccagccaatgtgttcatttttaaagtttgacttaagagtcccatagattcagtgtcttatgtggcagttaggtccttgcagttagtctcagaaatcgatttagctcatctgttttctgaaggcccacacatttgaaataaaaaaggaaatagttctgagtcacctccttctcaatataaatagaaaatgcattcaaatattcccacaagttttgtgtcttttaaatctgcacaaacccaaagaattcctagaggaggccgccagagctagcagcacgtgtcaggtctgcatcccaccgggccagctgagcaacccgcttcaggcccctgcataccacacagctcaccaccgcctccaacgccaggagagtccagaaggccggagggcgagggaggactgacgcgtgggcggtgacggcgcgggagccagtgatgtatttctgctttgggctttctcgcacgtggcacttggagcacatccttgggaacatgtctgtcctctttgccagtttaaatttttgtgtgttcgtttccatactagctcttagaatctaaatcaagtgttgtggatggtgtgcaagaccatggctgtgtatgtgtgtgtgggagtctcattgaccacagtgctgacacagtttcccttggtggaagtaaagagtaagttcaggactcccctgtaaatgatgtgctccccatggatgagggacaggaagaacatcagggtaccgtgccagcagagctctgtgccctgttagtcgaaacaaaagtgatggctgagatgagtccttctgtggcacccaggaaactttgatagctgggccaagaagcagcggcactgcagtgccctgggccgcgagcatcatggtttatgctcagcaaagccacatcacctgtcatatagacctgacatcagctttacagttttgcttgcatataacttgcaaattttgttttgtgttttatagcctaagaaccattaaaataaggaaacagattttatatagagacatttagcagtctaataaaaaaaaataaaaatcacatattgtatgatgccatttatataaaatgtccagaataggcacatccgtagatagaaagtagattagtggctgccaggggttaagaggggagaagtgagggagagactgttcatgggcgtggggtttctttctggagtaatgaaaatcctctagaatctgatagtggtgatggtgactgctgtgatatactaaaaactactgaactgcgctgtttcaaagggcacattttatgatatattttatctcagtctttaaaaaaaaatctcaacactgggaatccataagaaaactttttttaatttaaaatgggtctgtcaggcagggcgtggtggctcacgcctgtaatcccagcactctgggaagccaaggcgggtggatcacctgaggtcaggagtttgagaccagcctggccaacatggtgaaaccccgtctctactaaaatattagccaggtgtggtggcagtcacctgtaatcccagctactcaggaggctgaggcaggagaatcgcttgaacctgggaggcggaggttgcagtgagccgagatcgtgccattgcactccagcctgggcaacaagagtgaaactgtctcaaaaaaaattaaaataaataaataaataaaatgggtctgtgcattaagcagctgtagttcagagattgacaaagtttgcggaagatgagatgataaatatgtttggctcagaggaacatagtgtccctgctgcgaccactcagctctgccgtgatagcgcaaaagcagccacacggtgaccaggttgccctccctgcaggcctgctaagaggactctggctagattccagcccttgctggtccccctggcgttggggcaggggggaggcgggcagcatccctactgtcccaccggacccagcagccacaggggcctttcgcttctccacattccttcctgccctgccctaaagcaggaagcaagacaaggaaacctctgagtcaggtatgtggatgtcctctgcagaactcgcctggtcccttccttcaagtcatttgtttctttctgtgagtcagccctgcctcctgtttaccaggcacaggtagttttacctgtggctccctgagcagaactggagccggtgtaacacaggctgtgtctctgaatagaaagtctccacactgccgtgccgctctccactctgtgtttgcccactgtatgcaccagagcaccctcccggctccccttctcctaagcaaatcccacacacctgcatcccatccttcctcagatcacttccggaatcatctgcagagtttgggtttcatggtttgtgcgacactctcaagcagctcacccaaatcgggtggtgtcagatggtaaagggttgaggggtctaggtcagggtcacttggaaacaagttcctgggggagcagagcaactttcttctctacttggaagaatatgataaagcacccctagactcactggtttcgagttctagggaagcagatattgatgactcaacagaggaaaggattgtgtaatcattgctttagtcaggggttagcaaactatggtccacaggccaactctggccccctgtctgtttttttaaataaagttttattggcatgcagccacatccgtttgctcacaggcggcctgtggctgctccctctctataatggcagagagttgagtcattgcaacagatcggatggctcctagggctgaaaatatctgccatctggtcctttacacaaaggtttgcttgccgaccatgttgggcttagtggaggggtgtaagggatggtcttacatgagtgtgcttccagcacagggagcatggaacccagtggcagtctgtctggatgttttcaaagaggcttctttgtaatagttcgcgattatcttgcaacatgatatccatctccccatccctagtgtggttaacttggggaagtttgctttgtccaagtagagggggctgtagcttgttcacagcccaagaatgcaggagcacgcaggatgctggagcaccagcttttctgacttgttagtgatagcctgggttagggaaggttgtccttggaccacatgggctgggcatgcccctcaattcatggaaagtgactcagaaaagttcaaggtttcaccaagactaagaggtgaggaggaagttctttcagaacataagggtactagggtggtgatttcattctgttctttttttatgtgtggactttttcaagggcacaaatgttttgtgtcaattaaaagcagatttgtatgcattttgttacaatgattatgattttaaagtcttaatagtattatactatacaatctacaaaaagatttgagcatcttataagccctgataattatgcctcgctctaagaaacatgggtatctggaaagccacattataaactttaatattataaatgtgctttctgtttagaaggaattcttggagggtctcctttaagagtggattcctaggccaggcacaggggctcatgcctataatcccagcactttgggaggctgagaggattgcttgagcccaggagttcaataccagcctgggcaacatagtgagaccccatctctacaaaaaaaatttagctgggcatggtggtgcacctgtagtcccagttatttgggaggctggattgggaggatcgcttgagcctgggaggtcaaggctgcagtgagctatgatggtgccactgcacttcagcctgggtgacagtgagaccctctctcaaaaataaataaataaataaataaataaataaaaacaaaaataaaaaaacaggattcctagagcacagccagcatgcagaacttgttttctaaggcttttctccaataaaaggaaccagggctcctcagaggaatgactgagtctagggttggggcagggactgtacaagatgagcctggagtatcttatagtgccagaaaataagcgctcaaatacacccatatgtaaacccagcggtgacaacagtgtgggtatgtcatagggacacaggaaccaacaatgaccaaaggcagaacaagttaagcagcaaaattaagtagtagtggattataatccaatatataaaatgaatccacagcccagactgatacgcaggatggttgaataaattaacaaatgaagaatagagaaatctgctgtgcagaaaattgcaaatactttatgtagctactgtgcccttaaggaggtggagcatagctcccccgctccccgctcagtgtgggctgccaacagtaagctccctccaaagagtacagtgtggcaaaggggaccgaggagaggaacatcacagtggagaaactggtgtataccaacttcaccaggcgatcagggccaacgttgacaggtaagtcacattgacagcatgccccttgatatcataggataacagtggcacttcacttccatggtctctctcccagaagtcccaggctaatcataaaaacacatcagacagttcccaattgagagacatgctgcaaaatgccggaacagacctcttcaaaactattaaggtcatcaaaaacaaggaaagcctgagaaactatcatagcctattcaggctgctataataaaacacctaagattatatgatttataaacagcagaaatgtatttgtcacagttctggaggctgggaagtctaagatcgaggcactggcagattcggtgtctggtgaaggtgctttctggctcacaaatggctgtctctctgctgcgtcctcacatgatggaaggggagagggagctctcaggggtcccttttatgagggcactaatcccattcgcaagagctccatccttatgacctcatcacctcccagaggccccacctcctaacaccatcacctgggggttaggtttcaacataggaatttgggggtggggggcacaagtgttcagtctaaagctatagcaccctcacagcaagaggagtctgaagaagcaggcctgagtatgatgcagtacctggatgaggttcaaagacagaaggagaacattgattaaacagaaaatttgaataaagtgtgacctttagttaatattaatgtaccaatattgattcattaactatgacaaacacaccccatagtaagtcagatattaataatagggggaagtgggtagagggcatatgggagctctcgcctggctgttgcaattttttagtaaatctaaacccattctaaaatgagatgctggccaggcgcaatgggtcatgcttgtaatccaagcactttgggaggttgaggcaggaggattgcttgaagccaggagtttgagaccagcctgggcaacatagcaagaccctggccaggtgcagtggctcacgcctgtaatcccagcactttgggaggctgaggcgggcgtatcacttgaggtcaggagttcgagaccagcctgaccaacatggtgaaaccccgtctctaataaaaatacaaaaattagctgggcatggtggcgtgcacctgtaatctcagctactcgggaggctgaggcaggtgaattgcttgaacccaggaggcggaggttgcagtgagctgagatggtgccactgcgcttttgcctgggtgacagagtgagactccatctcaaaaaaaaaaaagtataatgaaatatttattttttacaaatttttatgtagagaccaggtcttgccatgttgcccaggctggtctccaactcctgggctcaagcagtcctcccgcctcggcctcccaaaagtgctggggttataggcgtgaaccaccacacccagccctataataaaatatttaatcagccatcagctgattgctgttccgtgtgtggcctggcagtatgtgttgagcatttgagaaaaggtgatggcccggggtgaatggcaccctctcttagagacagtaacatgtacttggtaaagtaatacgtgaagatgaaaagtactggaaagaacacgggcttcggagttgaagacacaggctggaatcctcattctgcctctcagtgtaagtgtgtcaggtcccccaagcttgctgacctcacggccctggatcatggggatatgcagagcaaccttgctcgcagacttatttacatgcttaagggatataacattaatgaatcagcacagtgcctaaggttaagtgtcgatatgggggaaaaaaatctaaaatagcagtgatacagtataggctgcaaagcagcatatgttatttggagaaatgagcaagagttggaagtaattgctatgaatgtagaagagggtgacaggaacaggttggaaagagaaactccgtcctggtggctaagcccaggatgtgggagggtgggatagggctgtgaggcgcagtggctggcgacgctgcttcctggaggggctgtggtgctgaggtctggggctgcgttaggagggaggtggggctcagggactttaaatagagatcattgtgaaatggttaattgggaaagtcaggtccagcctgcctttgtcttccctgagtgccttgcacacactcaaagttccggaaacgcttgttagttgcttgatgggttacattcctaatgagtgtgtaatcaacccaagaatatatggacatagaataggctgttgaatgttttctttttcctccttatggttgtggagttgaactgtgtgtcacatatgttataggattatctagcatcacttaatagagaaagctgtaacatcagtgcagtgggctttctatatttccccgttaaaatataagaagtgctgggcacagtggctcacacctataatcccagcactttgggaggctgaggcaggaagatcacttgagcccaggagttggaggctacagtgagccatgatcataccactgcactccagcctgggagacagagcaagatcctttctccaaacacacacacacacacacacacacacacacacacacacacacacataaaggaagactgccccccaagccttttggggttttaaattacaagacacacacacacacacacacacacacacacacacacacacacacacacacacataaaggaagactgccccccaagccttttggggttttaaattacaagacttttggggtttaagcactgaagtgttgggaatgttccccactgaggcaaggagttgctgatgaagtgatgggaaatgcaagcggagccttgagccgtggaggtgaaggttgacggagcctgcgtgagcttgcccatcaacaagacagcaggcacagacaggccagctgttgtgagcttggctttaggactccattcagtaggcaggaggagagctgcagcagaggcgggctgtgggtccctgaagcacatcgctgccttcacagctgggcgaactcccatccagcacggtaagcagagccgggtaagggacctctgcgtttgctctcggggcacttcatcccagatgggaccggtttcaggacgcctgcgccgtttgttaggggtttgtagttcccagtggctcttttgttctgctatcttgaagggcaggttgcttgtcagctcacaatgctgtgggtaaggtctggtgaggtcggcgaatgtgttctcattgtttattcttctgcctgaagatgagaaataatgcaaatcagggtgcagattccggctcgagctccacaggcgtgcacgtatgtgtaagggcatgctcgccggtgctgcatgtcctcgtggatgcatgcaatttttacagctttgggattcacggttagctgaaagcacattggaactggaaggcggtgctcttaacaccgtgttctaggctggaagccgtagagccatcatctgctctgatgggactgcagcccttggtatgtgggacccttgctccatgtgagttctgcagatgggttccccgagggagctggctggaggacgccagcatcgcatgaagacctgcctgcctcgtttgccttttgtttttcagtagcagtaagaaacaggcattctcactacacaggcattgaatgcggacattgagaaaaaatggtgagtcagctacatcctcaagaaaaaaaagcggcgaaatcaggtgtgcatgtttagtcatgagaaatgttccctgagtgcgtttgcacatagcctgctgattgcagtgagataatttaaatagagaaaatggaatcaccatggttcttagcattttccagttcttttattttgctctttggtgtgattgtgacagtttaagggttttactatacatgtgctttttcccccattttatgttgtgataaaagaaagagatgattagttttggctatatttctaaatggttggaatgcctttgctttactaaaggaggcttttgtgtgtgcagagggtcgatggcattttcacagggaaattgatgcataaatatgtttgcacacacaggctgtctctttggtctgcatttactgactcacaagagtaggtgtcattttgaaatgcatgtttttagcggttgtgctagttgaaaggtaaaaaggcaaaggagtttgaagaaaggtttttggaaatctacctggtagcacttacgagtaaacagcctactgcctcgtagatggtcttaagatttataagatgaatggaaaataatattttaatgtatcatataaaaaaactgaagatttggtaccaagttgatgaatggttggcatatttcttttcattacggaatagaacctttgaggtcatactctacaagtatttcttattattttattgcggaaaagcattgcatgggtggtagaggcacatttctttcttttgtcacacatagtggcaaaaacattttatactttgtccctttctgtttctccgcctccacctgcgcccacccccctgcccccccgcccctcccgccccgatcaccaccaacccaaaccaacaccatacctcttaaggaaaaaaattgcaggggaattctcatctacagaggcatgaacaacacacacagagttttttacagagtgctaggaataaccatacacgttggtgtcaagcatataggctgcggaaggctctattgcccagccagagggacaaatgaccctggtgaatgcacgctgactgctgcttgttttgcatgggctggctgctcttccagagtccgcctttggattttggaggttgaggaaggaagggaatattttatgtggcctttggaatacatttactttacactacctttaattttttacctctcatatgcattaaatttttaagaagaccagggtaggggagcagtgggaagaagctgatgtcttgtatccacccatctttcccctgtcctcgggcactgatttccagctggcttttcctagagcaagtaagacagtcgggtcatttctggaaggcttgtagacatccttggatgtctgaagaggtcctagagttatttacttatttacctttaaaacatatttgccgacaccttatttaaaattcctgaaagttcacagtgcctcttcatatgtataccttgggtcctactatgcggttaccatcttgattttataataaagcaaactgggggcggggtgactagattctcacaaccagttagtgaagagccctcgtggggcagcatggctgattttcagtctggtgggctcctgcggactaatgggtcgaggtcctccaggtaaggctgaatgtagaactggcccaagaattcctagttattctcttagtaactttcacatcccttatccagtttgctgccagtgcagtgagaaggaatttcagtttggacttctgggagtgaagtacagaaacccgttaatcaggcagagacagcatgtgtgctcctcagcctgcgttggtgtggcttgcgaagccacctaagcattctgaccctccatttcttcatccataaaacaaggaacacagattaaattatttcttatttaaaaattatttattttttatgtttaccattaccttgatcttgaagtttaaattatttcccaggtcccttccagctgtagtcatttttggttcttagggagagaagccagggactcaaatttcccttcagtcatatttccagctctgtggggtgatttgtggctgcactgttttgctcatttgccgtcattatttccaggaacaaaagcatatgaatatatatgagacacacgcacaggggtaatagcttcgatatccatttacaaataaaatcagctctgtcagcaaactcaattttctgtcaacagggctttgttgatgggaatgcccttgacagctaagcctacttcggtcttcttgtggtaatgcctcataaagccactcactgccaaggtgctcttgggtataacttgcatgaaatttgttataaaattattccgttaaaaaaatctagctggcggacccttaaatgtacttggaggccattaagggtggaaaagctagaaattctaggaaaattttcaacatttatacacgtgtgtgtgtatacacatatacatgcccatacacatatgtgtactacacacattttctatagtaattatgcatataaagttaatgtcatgtacaacaaatatctgaagtctattggataaacaatccatttccgattctggttcagctgagttagaagataggcaggcaatgatctgagatggaaggtttccacagtttggggtcacgtgcaattgtgatagaaggaagattgagattttctcttaatttatgaagctgatatgctattctaactagtttttaatatatcttaccacagggccacccaaaattcaaaattactcctgattttgtaagcttcacatatgtttttgagaatgaggttttatactaatctgggattacagctttctaggctgtgatatacagtttttattaacatttcctattttaaaaatcaattttgctaattaaaacctttttattaagaatatatagaagttctgggaagcagagtgaggatattaacaaatcaccctcaatcctatcacccagagtctccgctgtggaacatggaagtatatctgctttgaagtccttgcaaatatgtttttacacatgcaattatattacacatactgtatgtaagctgcctttttctgtaacttgtatgtgtatggtgcatgacattctaaaatctaacaaccctgtagccatactgtggacatttagggctgctgttggtgtttgacgttgtaaataatactgcagcagatatctgtagtgaaatacttgtgctcttccatgttgatttccttcggataaaattctgggcatggagttgctaggcaggcgctagaaaatatcaccacgttgccctccaaaaagtgtatgcttactatttacactctaggggcaccgatcgcccaggacagtcctacttctcccaaaactttgtcaatattagacatttttaaaattctgtggtttgataggcaaaaaagttatttcatttttaacttgcatttcttcagggactagcaaagtcagacttttttggtgcactgactagccatttgtgttttttcttttgtacattactcttcagcgcgtgttcattttcctactgaagatgagccctttcttgattattgtcatttaggttgcagataacatccctaccgtgtgctgtgtgccttccagatgttagtgggtggttacagttcaacttttttgacatacaagtgtgttgaattttagcgttgtcgcccttgcacctggagcctctgtgtggccagttctgccttttggtggctactggcttctgttagttgtacattgccattactggtctcttgttaccatgtgtgccgcagaaggtgtagccaccaggagctctgtcagcatgaattccctaggaggtgtagacatccatctcggaaggctggtagaaaaattgtctctgtggaaaaattaagaagtgcccagctttccgacaaccctaactcatcgtagttcccatcttttgctctggttgacaggaaactcgtggtcctattggaagcacaaccataggacctctgtacattctcgtgtccggtctgctctttgcataagggtgcttgcccctgcttgtgcccttctgctttttgtttacatttgctctcactgtgatgtttttatgttcattttgatactcaagttgtgtgtttgttctcctgcgtgagacacttctaaacatttcatcatttagggtatacatagatcaaagtaagtggggaccacataaacatatgtagaaacacgttctgaacaccaaagagcttctcggtcaccagttaatattgtggttctttgttgttgttgttgttgttgttgttgttgttttttgagatggagtctcgctctgtcacccaggctggagtgcagtgccgcaatctcagctcactgcaacctctgcctcctgggttcagccagttctcctgccttagcctcccaagtagctgggattacaagcatgcgccaccacgcccagctaatttttttttgtatttttagtagagacagggtgtcaccatattggccaggctggtctcgaactcctgaccttgtgatccacctgccttggcctcccaaagtgctgggattacaggcgtgagccaccacacctggccaatattgttattacagtcactgttttatggaaaaacttagtgacctcatatcgttcttactgggcaagtgagcctaacacaatctgtttctatagtaattgtggaaatgtgacgttacagtggaagaggagagttgggacatggctgtggagtggagctggggctgtccacctctcacttagtatggaatcctctcctaggcccttcagctccagcacactggaagtctaaggggttttgtttgtctgtttgcccctatgttttaatcaccgctaggatcagaagaactgcagtctctgtgaacaggtcttcaggtgacatcagtgtgttacctccctggttagcaattagcattcccgaggtcgggtgctgtgctgcatgcaaagttgaatcaggcacagacagaaccttccttgaaggagtttgtcctctcttaatagtgaagataatatagaaattgtcctagccagtttacactcctaaaacaaattaccatagactaggaggcttaaacaacagacttttattgctcacagttcttctggaggctggtagtccaacgtcaaggtgctggcctgtggattcctggttcacagatggcactttctacctgtgtcctcacatgagggagagcagagagaggaagcaagctccctcgcatatcttttctttttttgagacagggtctggttctgtcactccaggctagagtgcagtggtgcaatcacagctcactgcagcctcaaactcccaaactcctaggctcaagcaatcttcccacctcagcctcctgagtaactgggactttaggcatgtaccaccatgcctggctaattttgtttgtttttgtagagatggagtctcattatgttggccaggagggtctcaaactccgggcctcaagcagtcctcccaccttggcctcccaaagtgctgggattacacgcttcagccacaatgctatccttgagtgcttcttatgagggtactcatccattcctgagggcttcaccctcctgactgcatcaccttccaaaggctccacctcttcatcctatcccattggggttaggatttcaacttatggatttgggaggcagggcacaggcatttagactgcaacataaatgtgaatggctgaggagcatgggattcagaaggcccgagcacatcaggctgcctgctttgctttctgctcctttcttctctcttccctcctcccttcctttgtttctttgttccttctttcctgttgactcagtgagcttttgctgcaatctgctttgtgccaggcattgtgttggacctggaatacagaggtagatgaggcaggggtgagcacagtcgtttcagctaggaggagagatactaaatgaaaataccacagaatggtgaagtgcagtctaggaatcaacaggtagagattcagtactgtgcaagttcagagaagaaaggcatatctgtgtcaatgggtccaggaaatgtttcatggaggaggttgcttttttttttttttttttttttttttgagatgaagtcttgctctgttgccagtctggagtgcagtggcatgatatcagctcactgcaacctctgcctcctgggttcaagtgattctcctgccttagcctcctgagtagctgggactacaggcgcccaccaccatgcccagctaatttttctatttttagtagagacagggtttcaccatgttgggcaggatggtcttgatctcctgacctcgtgatctgcccccctcagcctcccaaactgctgggattacaggcgtgaaccaccgcacccggccccgcatttcactggatcttcagaacaggaatggcttccttggggagggtcccaaaaagtgcgaatcaaaacagagatttgggaaccaccaggcatgcataggtagggcagggcatctcaactcactgcaacccatcagagagtacatctcaacccactacagctcatcagacagtacatcttaactcactacaactcatcagactgacatctcaaatcactacagctcatcacagagtacaactcaactcagtacaactcatcagacagacatctcaaatcactacagctcatcagacagacaaatcactacagctcatcagacagacatctcaactcactataactcagacatctcaaatcactacaactcatcagacatctcaactcactataactcagacagacatctcaactcactacaactcatcagacatctcaacttcactacggttcatcagacagacatctcaaatcactacaactcatcagacatctcaactcgctacaactcatcagacagacatctcaaatcactacagctcctcagacagtatatctcaactcaccacaactcatcagacagacatctcagctcactacaactcatcagacagtacctctcaagtcactgagttttatggtctgtgactgataccccgatagagttgtggaggtgaaaagaatacaggtgaaagtgtttggtaatatgaacacctcctagatccatcctagatgtctagaaattcacatacacatttgtggctcagaagagcatgtaggtgtagggaacaaggtgtaaggtaaactcaaattcatacattgcttgttacctctgcccagaccttagtagctttaagcttttgtcaataatagatcatacctaataaatattacacaacccagatgcttctaaaactattattgaggtaaatgaaaatgtctgccacagtaagatagtatttatcacagagattcagatatgattttttttctcttttaacctaaagaaatatagtaataacaaaaaagtcagctaatatgctataagcaattgttgggaatcttggcatgaaatccagttagggtactgattgtgcccatatcagatttttagaagcagataacctgatgtgtttatgagttttatttctggtctgctttctcctcaaaatttcctgtgtatacattgaaaacaaaaagccagccacagatcacttgatcattatagcataaagagtagaataattgtgttagttaccttgctgcataacaaatcgtccaccaatttggtggcttgaacaccactaaacatttattatctcatacactttctgagggttagggaggagattagctgggttattgtggctcagcatctcctgagattgcagtcaacacgtgggccaggacagccgtcttccaaaggcttgcttggagctagaggatccgcttccaagagggcacccatatgtctgttggcaggaggcctcagttcctccccacatggatctccgtatagggctgcttgagtgtcctcacaacatggttgttggcttccccgctgtgagttatcctcgggagagaggaaggaggaagttgcaatgcctgtgtgatctggtctcagaagtcacacatcggcacttctgccatacatttttaaaccaatttattgaggtataattgacatataaaaggctgtacatatttaatgtatacaacttgatgaatttggagataagtatctataagcctgtgaaatcatcaccacaatcagtgccttaaacggatccatcacctccaaaagttttctcccaccctgtcaaccctctttttttttgttgtcattgataagatctacccccttagcaaatttgtaaatgtacaatacagaattattaactacagacgctgcgctgtgcagtaggtctctgggtaattcatcttgcgtaattgaaactttgtgccctctcaccaatacctccctgtttccccttcccccatcccctaacaaccaccattcattctatttgaaagtttaaaattcttcacgtaagtgggaccatgtagcacttgtctttctgtgcctggcttgtctcacttagcataatgtcctgtaggctcatccatgttgtcacaaatggcaagatttccctcctttttaagtcttttctattcctctatatgcacgcatcacattttctttattcactcatctgtcaatgtctgcttaggtggcttccatgccttggcattcacaatataaatagttcacacaagtgaactattcacaatagttcatgtcgtagtaaacatgtgagttctgccatattttgcttgttcaaaaggagtcagagtccggcctacttctaacaagctccacttgtttgaaggaaggagtttcaaaggaattgttggaacttctttgtttgtttgttttttagaaatgagttctctgtctgttgcccaggctggcatgcagtgacatagtcatggctcagtgcatcgttgaattcctggattcaagtgatcctcctgcctcagctttccaagtagctgggactacaggtgcatgccaccatacttggataatttttttaaaaacttttctttcggtaccagatcttgctatgttgcccaggctggtctcaaactcctggcctcaagtgaccctcctgcctaggcaacccaagttgctgggactccaggcatgagccactgtgcctggctgattttgataactttatacacctcgtaatcaaaacagtaagttccagaaagctcctttgtactctttccaatgaaaccctgccccacaaccatccctccctgatgtgtgaccctagtgagtgttgcctcttcttgagcttcatgtaaactggaccctacttgtgcgttctttggcggttgacccttcattcagggtcgtgcccctgggacccattctcactgctgtgtctcggtagtttttctaaattactggctagtgttcccttctgtgaatacagcaccactggttgatccactcaccagtaggtgggcagtgtttggccaacatgaatgagggcttgtgttgtttctcttgggtgagagagttgtttctctgggagcggtggactggctgggtcgcagggcaggtgtgtgagagtctccttcctcacacagtttcactaggactcagaagccatggtcttttctctcctgtgaagggcttgagactttctggaattgagttcatgtagctgtcctcagcttttgatgagggacgtgtgtgtgttccaataacacttcgtttacaaaaccaggaggcagtggagagttggcccttggtttctagtttgcaaactcctggtctagaaggtaagacaaatattaatttttaaaacccgcgtgtctgtaattgctcattttgaaagcactgtgaagggaacactaagggagaggggatgggaagactttttacatgtgtgtggggagtctgatgaatttgtaaaacctatgattttataacttttctggcctctttttagttgctactgtgagcagtagtccatatgtgaaccagagtggacctccacaagctgccttttgaagttgttacagttagcagagacgaactggcccagggttcaagaagcctttctggctggaggaatgtggatcagtccctccaggcctggaagagggcagtggggggcggggggtgcactcaatcttaccattttcacagatgagagtaatttcatttcagaggggtatgccaaggcagcgatgaaaacttcaggaatagctttgaatatctaaaggaagtgggtaagaaagtgggaggttgggagttccggagggagagttcctgtaaagcagagattcccagggctggctcaacatccacattgcctggagggctttccctgaaacacaggcttgcaggcatgccagcccttgctatttcccacctctgcccaggcctggccctcatcaaggcgggagagcccagctcccagggctcacgctctggaaccaagaatgtggctctccaggcacagagacaatagaggcctggaacagatcctcaaaatgtgtgtgctgaagacatactcagggtccgatacttgagggccatctcacattatcatctccaaatctaggcaggttctgttattgggcattaacccctcgagaaatcagtgcctgtaactatgatttggatcatctgtgctttggatttctcttttaatcttctctgtctcctcccattcttaaccacaagtgatttatcagcctctctaattcaacttcattactctttgccatccaagtccctgcaagcacaaataaaacccaaaggaagcagcagacctttttatccatctgtgaagacactcaagaaacactaaattcatctgactttctagagtaattgctttccccacatggcactagaatcctggcatacagggagcagcttcagcagagacacggcagtagagaaatgactgactgaaggatggttcagggctgttgtcctccctgaaggtggttccaacaggacacaaaagttgcagcagagcctgtgagaacagctgtgtcctttgtcgtcactagctggtctgtctgttcattgggcaatttcagtttttatgactgaaagctgggcatgcaaaggacaaccaaacagcctctagcctgctgatgctcacagtctggaaagtcctatggtaaatcaatatttcttttttgcttttcagagacagtctcactctgttacccaggcaagagtgcagtggcatgatcatcgctcactgcagcctccaactcctgggctcaagcaatcctcccgcttcagcctcctgagtagctgggactaaaggtgcccaccaccatgcctggctggtttttcaattttttgtagagacagggtcttgctatgttgcccaggctggtctctaactccttgcctcgggcagtcctcctgccttggcctccctaagtgttgggattgcaggcacggggcaccacatccaggcttttttcatttgtttttagagacagggtctccctctgtcacccaggctggagtgcagtggtgtgatcatggctcactgcaaccttgaactcccagggtcaagcaattctctcacctcagcctcctgagtagttgggactgcaggcatgcatcaccatacctggctaatttttaattttttttttatttttattttttgtagagactgggtcttgctatgttgttcagagtggtcttgaattcctcccacctcggcctcccacagcactgggattataggtgtgagccactgtgctcagcctggtaaattggtatgtctaaggagagtgtttggtgccattgttcccaggtgttcacactgtttaaaatgtttctaatacatctcagcattgataggttggttgcttggttggtttcttgcctcttttgggctccatcgccttccccactgtctcctttttccacctcatctggcctttgtggagtgctgtgttggcaaaagagctttccacctgtgcctccccaagggtgtgtgtctgtaagagctgcccagggcctgggaaggacagtggagacaccaggtactcgttcgggagacttgtgctcaaaatgacatgggtgtgccggctcttagctgcctgacccgcattctgaggcctggtggcgccgtgcttcttcagcgtgtgaacacctgcctggcagcgtctgatacacctcaccaggctgaagggcagaccagctacctgtgattcctgataaaaattctgtgctttacagaatcccttctatttatgcccacaaccaatggaggagtgctttctagatgataacctcaaactgtcagtgttgagcttgagttgatgtttgagttactgagcgttccacgttccatgctcatggaaacctggctctgtttggaagcagcaatgctgggccctaccccagttgtcccatgagataattgtgctctgtgcacacagttccggtcccagaccctggctttgtagcatacattttcaaggaggactcttgggccaccacagatactgccctatccattgctatttttgatggtatgcttgtgtataatacgtttgtatatggcataagttagcagaatatgtaaatgaaaggaggaaacacctcaatgtcattatccacgggaagtgtgttcactctgtctcttcattgtaaaaatgaggcagtgccgttgcccagagctctcttggcaccttttatacccctcaccggctggcttggtcggctgcaggggtgcccttcccatctcattggctgggtgtgttgcatggtgttatgctttgggaagaaggttgtatggtgctggtgtcacagaggcctgtgtccaggtctgccccatcacagactgaccctttggtcttaggtgctcagcaggtgcctggctcataggaagcccacgcaactccatctcccacaccagggcctttatctgctgctagctcaccgccatcctatgcgatgtggcctgtgatcagcttgtacaggagaggcagctttctggggtgtagttgcctgcctgacgtcacatagctggcacgtgatggatcccgattggatgtgtctgcccggggaaacctcaagtcacaggcagctagcacagctcaagcgtccctaatcagaaggtctgaaatcttaaatgcttcaaagttcaaaactttttgagcaccaacatgatgccataaaggaaaaattccacagctgatctcgtgggatgtgtcgcagtgagaatgcaggtagagactgggcaagctgctgctgtttgctgttgctggcgcctcacagctgaggcgggtgttctggtgccattgccgtgctgcttacttaccctggacacattcctctctcactgtattgatggtatatcgtgcttttcactgttgagtgcttatatatcagtataggaaaattattgcttgttggcagcatataaattcagagtccggaatgacggagatgccagacaactacagattgtgcacatgggtggcagagagactgacacttttgctttatgatggttcggtggatacaaactttgtttcgtgcacaaaattattaagcatattgtataaaattaccttcaggctatctatataaagtgtatatgaagcaaaatgagtgtcaggtttagacttgagtcccacccccgagatgtctcattatgtatgtgtaaatattccaaaatccaaaaacgtctgaaatccaaaacacttctggtcccaagcatttcggaagagagatgtttaacccgtactttagaaagcactcaggcgctggagttcatcgcgggcagcatttcagcagcacctgtgttgtgtgtctgcaaatcagaatgcatccctatcccatcattgacaccaaaagtagttatgatgcctgtggcagtggctcatgcctgtactcccagcactttgggaggccaaggcaaaaggatcacttgagcccaggagtttgaggccagcatgggcaacatggtgaaccccatctctacaaaataatttaaaaactagccaggccatagtggcatacacctgtggtcccagctagtcaggagactaaggcaggagggtcacttgagcctgggaggtcgagactacagtgacccgtgatcacgctgctgcactccagcctgggcaaaacagcaagaccctatctctgtctccaaaaaaaaaaaaaaaaaaaaaaaaaaaaaaaaagtaggtgaggaggaccctgtggtgtgtgttccttaagtcatctgcaagattcagaaattttcccatcctccttgctaaagataattgttaaccctattcagaaaacagtggtggattattgattacagagcagttcaaaactgtttagttgtgttgggaacattcacacacaaggtcctttcacggagaacttaaccatggtgtcttgaaaaaatgcagcttctcaccttttaaaattccgcacaaaaaaagtgaaagtgattgaaagcaacaggtgcatttacattgtgttcaagtgagggcataacatgatgcatgtaataaatatttgcttgcaaggccctgaaggaaatagcccagatccctgccctctgtagaggtgctttcagcccagggaggagcgtggaggcaggtgagcaatgggatgatttgagagagtccccttgctggggcgtgacctggaggtggggtgatgtcagggcaggactgggggagctgagggctgtgtggaggcaggggcagtgcaaggagaccttgcattcagacatggggctggctgtctcgtcgtggaagcaaaaatagagtaatgccagcaggatctctagagtgtttgtttttttcctaacagtggtttcggtcctgtcatagcatgctgggtgactgagtacactaatggtggcccttcctgcaggtttgtccccttcatataagttctgtttggctttgaggtgctgttttagagcttcatgctctgtctccttcagtggcggccagcccagggagaatggcagggccgtgggctccatgtagcagatctctgaagccactgctgcttggagcctgccggccctctcccctctgggaactgtgcaagcagctgtctccttgggaacgtggcattagcatgttttgcatgagaatgaacaccaaccaaggctgaatatcaattggatcctagagtgcagctgcctttgaaatgttcctttgtgtggccgaacttcctgctgcagttgattcctggagcttgtgcgaagacacaaagtcttaagtcatcttagtgccttgcttactctatctctggatcttgctgtcaccatttattttatccttagaagtatggcaaagagaaatgcatacatatatgcagagacacatgtctacacacaggcacaacagagacacacgtacctacacatgcacacaacatatacaacccgggcacacactcacaacatgcatctccacacagacacaacacaggcacacatacccacacacgcatacaacgcacaacacaggcacacacatacaacacacatggacacagagacatgcatctacacacatacacaacccaggcgtacacatacaacatacatctacacacagacacatgtgtacattcagacacaacccagactcctacatctacacatgcaaacaaccagacatacacatacaacgtacatctatgcagagatatacatctacacacatacacagcgcaggcacacacacagtgtacatatagacagacagacatttatacacatacaacatgcatctacacacacaaaacatagacacagacaacatctacacatagatctgtacacatacacaccagatgcatacaacatatagacatgcacgtaacacatagacatgcatctgtgcgcaagcacaacatggaccactcacacacacaacctgcagagctgcctcttggaaccagttagaaacaaaagttggaatatgaccccagcaagtccccaatccccatttttggtccttttcttcgtttgtgttgttgaccctgatggcccagattcttatcaactgcgacaataaaaaccaattagtgattttatagtttgactttgcaaggtgggggtggggggcaaacttggtccagacattgctgtgctgctgcaggtctgaatgaagtgcagtgttgggctggagcgcgccccgtgctgcacttctggcgtgggaagtgacgatgcagcacacaccactcccctgagaacagagcacccagctcctgtagtttggccctctaggaagatgggaaggagcctgtgggcaccttctgattaggagagaagccaggagccagcctgccgtccactttctcagtgggtctcttgctccatgtcattgttcacttctcacagggcctttgctccctgcaggtgagttctctttcgtttatgggtggatctcggagcacttctgcagaaggcactttgcaaatagagttcctttttaatcagtgggtgaccaaaggcacttggattttagcaataaattataggtcatttaattatctgtttctgtgatgtggtgatgtgatatggtttggctgtgtccccacccaaatctcaacttgaattgtatttctgagaattcccacgtgttgtgggagggacccagggggaagtaattgaatcatggggcctggtctttcccctgctattcttgtgatagcaaataagtctcacaagacctgatgggtttatcaggggtttccgcttttgcttcctccgttttctcttgccactgccatgtaagaagtgcctttcacctcccgccatgattctgaggcctccccagccatgtggaactctaagtccaattaaacgtcactttgttcccagtttcaggtatgtctttatcagcagcgtgaaaacgaactaatacctggcgcttttaaataacaggtaccaggtgctttcaagtgggtctatgggtgatagatttcaggagttttcaaagggaaaaaaagtgcaagtgtacctcaactctttggcatgaaatgaattattgaacgctgaaatattgaggctgggcgcagtgactcacacctgtaatcccagcacttgggaggccaaggcaggtggatcccttgagtccaggagtttgagaccagcctgggcaacatggtgaaaccctatctctacaaaaatacaaaaattagctgggtgtggtggtgcacacctgtggtcccagctgctagggaggttgaggtgggaggatcatctgccaaggaagtggaggctgcagtgagcccagattgtgcactccagcctggacaacagagtaagaccctgtctcaaaaaaaaaaaaagaaaagaaagaaagaaagaaagaaagaaatatggaaatgaaatggaatattgaattctgaaccattgaatattgaaatgcaatgtgggggagacatctgacctgtgagagcgcttctcagaatgcaaatcagtttggcagtattttaatgtcattctgtgttttataaccagacaaatgtattgttctctaacccatgcatagctgtgttcaagttttgttttgttttgttttgtttttttgagacggagtcttgctttgtcacccaggctggagtgcagtggtatgatctcagctcactgcaacctccacctcccaggttcaagcaattctcgtgcctcagccttccgagtagctgggattacaggtacacgccaccatgcccggctaatttttgcatttttagtagagatggggcttcaccatgttggccaggctggtctcgaactcctgacctcaagtgatccacccgcctcggcctcccaaagtgctgggattacagatgtgagccactgtgcccagccattcaagttattttgataacacttcaagctaggagtttctgttagtgtctgtctgatgcacatgagaaatctgacttctttgagtggggttgctgttgtctgaagctgaggttgagctatttggttacagcttgttttctaagcctgtgctgtgtcttcagcctcctctaagctgagagcagaggaggctgccctcccaacactttgggaccagacctcccaacactttgggaggccgaggcaggtggatcgcttgaggacaggagttcaagaccagcctgaccaacatggtgaaaccccatctctactaaaaatacgaaaattagccgggcgtggtggcgcatgcctgtagatctagctactccgcaggcaggcaagaggatcacttgaacccaggagtttgagaccagcctgggcagcacagtgagaccccatctctactaaaattttaaaagttagccaggcatggtggtgggcacctatagtctcagctacttgggaagctgaggtggtaggattgcttgagtccaggagttcgaggctgcagcatgctatgatcacactgtactccagcctgggtgacaaagcgagaccccaactctttaaaagagcctttgttggtcttaattttcataatacaatactgattttcaaggttttattaaagaattgatttgcagctcatcttagaaaggtttacccctttgtatatggcaatttcccataagccacataaaaatactgtgacttgaagtaaatatttctgaatctagctgtatgtgagcatttccacaaacattaatgttgtttctaaagtttttgttcatttattcctgcaaaaacaaatgcaatttgtgtgtgtatgtgtgtctgtgtgtgatgtgtgcgcctgtgtcttgaatgcttcatgttcccttgtgggacatgccagtcgacagcctcatgttgtctgaggtgcgtcacgactccccaccttgcatgaggagttgcggtggcgacaggtgtgggaaagtgcatatggatttaactcctgaaagtggcttaaggggattgtgaagatccaggtccagtcccttgtggtgggaaggtattattggaatcgttgattaatttgtacttgttcttcctctagacaagcagatgcccagtgtcgggaaggcagcccaggatcacagcagcacccaccgagtcagaaggcaccgaacccacccacattctctgaactatctcactgccggggagccccagagctgccccgggagggccggggccgagcgggaaccctacctcgagattatagatactcggaggagagcaccccagcagacttgggaccccgagcccagagccctggctcacccctgcatgctcgaggacaagactcgtggccagtgagctcagccctgctctccaagaggccagccccacagaggccaccgccacccaagcgcgagcccaggagatacagggccacagacggcgcacctgctgacgcccccgtgggcgtcctcggcaggcccttcccaacgccatcccctgcgtccctggatgtgtatgtggcccgcctgtccctctcccacagcccctctgtgttcagcagtgcccagccccaggacaccccgaaggccactgtctgtgagcgtggaagccagcatgtgagcggggacgcatcacgtcctctgccagaagcactgctccctcccaagcagcagcacctgcgcctgcagacggccaccatggagacctcgcgctccccctcgccccagttcgccccccagaaactgacggacaaacctcccctgctcatccaggatgaggattcaaccaggtactgtcctgcgacggtgttccctccccatgaggctcctaatgtgggacgcgggttctcagtgggtctttctggggagtcacctgggcaccttgctttagctcaaggcgttggacttaaagtcagtactggggaataactgtgtggacagaaagtgaagcttcagtggtggttggatttttatctcactggggggctgctgtttcctgcagggaacaggggtagatgtgaataggtgatacatcttccccttcctccaagccagatgcatttatatctgcattacccacaggcatctgcagggtagaggtctgtttttttttgtcgttgttgttgttttaatgcagtcaatatttgtgattggaatcgagtttaacctaagcatgcgacctttaggtgaaattggtatttttcatggtgtccagtattttcttactcctttttttccagatttttttttaatgttagaaagctaagctggtatataccttttgttaaagcagaagaatactcattcacatttcatggtgctatcatcaggatttcaggcatggaattattgcgtccattgagatgctgatgaatgttaggcaggaacttgacctttcaagagcactaggcccagcatggtggctcacgcctgtaatcccagcacgtcgagagttcaaggcaggtggatcgcttgagctgaaggagttcgaggctagcccaggcaacatggcaaaaccttgtctctactaaaactacaaaaaattagccaggtgtggtggtgcatgcctatagtcccagcttcccagggaggaggctgaagtgggaggatcacctgagcctggaggtcgaggctgcagtaagccaggatggcaccactgcactccagcctgggtgacagagtgagaccctgtgcaaaaaagagcaccggctgtttagctttcttcacacacaaataccacctccttgagtgccttgaaggactgagaaatggaagaaggggagaatttctgtctcattctctggagcagtggctctcaacctaggaggtggagtgtgattttggcccccaggggacattaggcaatgtctggagacagtttttgttgtcctaagtgcgatgggagtggggggtgctctctgcatctagtggtggagcccagggaggccactcagggtctgcagtgtgtgggcggcccccacagagcattgtccgaccgcagatgccagctgctcttaggctgggaaccctgctgtagagccgcacgcccagcacaggacccaccatcacctgtgctgtgtaaatgtggggcaaagaaaaccaagtcgatgaatgcaggtcctcagtcacaccaggtgtggcgggtggctgccgtcctggacaggacagataacaggtattcccatcgccgcagaaaattctgtgggacctcactgctctagagtctcaagtaattttttttcttagcttctaaataactcagcagagaaagaacatgactgatactgatcctgtatctccagccgaggcattgtaaccacagttttctctgtgggccaaaactgggctttgcatcatttaaaatgtatctaaagatcattcagatatcccttgaattggtaacattgtaaggttctgaaaggaaagtgtcttactcctttcaggctgctataataagatctcatagactgcacggctcattaacaggagaaatgtgtgagttgatgagggctggtcgctggaaggtccgacccactgtgttctgtccttattttgaagtcaaggctcgtgaaactgttctcatgtggaagtcaagactgtttttaagaagagagaccatttctgttaaaaaatgatcaggaatagatgctttgttggaaagtgtatgtgaacccgtgggagataggagatttgttttttttccttcccggtactgtattttatattattatcattattattccctgtcgcccaggctggagtgcagtggtgcgatcttgacttttgggttcaagtgattctgctgcctcagcctcccgagtagctgggattacaggcacctgccaccacaccaggctgatttttgtatttttagtagagacggggtttcaccatgttggccaggctggtctcaaactcctgacctcaggtgatctgtctgcttcagcctcccaaagagctgggattacaggggcaagccactgggcccagcctctttcccaatattttaaaacctgtgaagggagatttgtttatgttgtttaatttgtttctattgtgcacatcaaatttctgcacaaaagggggaggataccaatacaggctgatgtgaaagtcagtaataggcaagcagagcttctcccgggagccgggggggcgggggtgaagggagtgcagagggttctgcgtttgctggtgcttggataaggtggccaggttttcctccttcttttattattattattattattattatttattattattatgtttttaacagagaggtggggaggtctcactgtgttacctaggctggtctcaaactcctgggcgcaagcagtcctcccaccttagcctcccacagtgctgggattccaggtgtgagccactgtgcctagccagggttttccttcataagtctgacctatctaaatggtattttccacagttagactttgtaaattgtcttcatgaggaagcagttgtgaggtgtctgtgagtccctagataaaacacatcagatgttgctgaaccctactggagagagggaggaaaatacgcagttagttcatctcagcctgagcaccactgccttgatagggaaagagccctcctgcattcccagtcaccagtgaaagagggaaaaacagcattaaatttagagcatcgtggctgccctcctgctgtggaaaattggatacatttgtgtaacatcgtaggggcagttttgggttgacttcattagaaacacatcctaatttggggttgtggagtttggcctgtttctttttgcttccctcctgaccaccagcatatggggctgcttctccagtgctctgaaaagctcttggctgagatggccctggtcagcatggtctagcacggtgccgctgagagcagcaggtgcagggctgccccagacaagggactgtggcattgctgggcctgttcctcctgttctctctcccccagtctcccagggatgctttaggtacctctctagtccctttcatccagaaacttttcttttttttttgagatggagtcttgctctgttgcccaggctagagtgcagtggtgtgatctcaggtcactgatctcagctcactgcaacttctgcttcccaggttcaagcgattctcatgcttcagcttcccgagtaggtgggattacaggtgcgcaccaccacacccggctaatttttgtatttttagtagagacagggtttctccatgttagccaggtgggtctcgaactcctgaccacaagtgatccacccgcctcggccttccaaagtgctgggattacaggcatgacccaccacatctggctgacacttttttaaaaaaaaagcaaaactgtgccctttggaagtaatacagaaccgatgactcgctgcttactgcgagatcgtatctcactggtgtgcaaatctgtgcaacgctagcttgaagcacagcgggcggggggtacaaggacagtgttgggtgggctgtcctgcatatggcacaggaggttctcccaagtggggtggtggggggctttggcctgactccaagcacggccactccggagaggagccctccccaggccctgagaactacgcaggaacccgcgggcctgcaccaacctaaggacggatgggaatcctggaaaatgcccatccactgcaggcttcccctacaaaagaacatttaacccaacagggcttgttgaagtttgcattatcatctgcggaatgacaaatggtattaaatagtcctcacagccctccacgaacccctggaggacaccttgggatgcctcaggggtggcattggcggtttgagcatagaaaggatgctgtggttggaaggcggaggtaggagtcagagggagcttcttgaggcctctgcctcatccaggatgtgggatcatggaggctccttcgagttgggtggctggctagtgcctttgagtcaggttcccatccagaggggagggcaggggacacgtcaatcagggtctgtggctggagcatgctttgcgatttcagcagactgttcatcttccagaattgagcgggtg

SEQ ID NO: 2965 - DNA, 162987 bp, human; identical to SEQ ID NO: 2960

SEQ ID NO: 2966 - DNA, 39001 bp, human; identical to SEQ ID NO: 2964

SEQ ID NO: 2967 - DNA, 35986 bp, human
aatgcaagcggagccttgagccgtggaggtgaaggttgacggagcctgcgtgagcttgcccatcaacaagacagcaggcacagacaggccagctgttgtgagcttggctttaggactccattcagtaggcaggaggagagctgcagcagaggcgggctgtgggtccctgaagcacatcgctgccttcacagctgggcgaactcccatccagcacggtaagcagagccgggtaagggacctctgcgtttgctctcggggcacttcatcccagatgggaccggtttcaggacgcctgcgccgtttgttaggggtttgtagttcccagtggctcttttgttctgctatcttgaagggcaggttgcttgtcagctcacaatgctgtgggtaaggtctggtgaggtcggcgaatgtgttctcattgtttattcttctgcctgaagatgagaaataatgcaaatcagggtgcagattccggctcgagctccacaggcgtgcacgtatgtgtaagggcatgctcgccggtgctgcatgtcctcgtggatgcatgcaatttttacagctttgggattcacggttagctgaaagcacattggaactggaaggcggtgctcttaacaccgtgttctaggctggaagccgtagagccatcatctgctctgatgggactgcagcccttggtatgtgggacccttgctccatgtgagttctgcagatgggttccccgagggagctggctggaggacgccagcatcgcatgaagacctgcctgcctcgtttgccttttgtttttcagtagcagtaagaaacaggcattctcactacacaggcattgaatgcggacattgagaaaaaatggtgagtcagctacatcctcaagaaaaaaaagcggcgaaatcaggtgtgcatgtttagtcatgagaaatgttccctgagtgcgtttgcacatagcctgctgattgcagtgagataatttaaatagagaaaatggaatcaccatggttcttagcattttccagttcttttattttgctctttggtgtgattgtgacagtttaagggttttactatacatgtgctttttcccccattttatgttgtgataaaagaaagagatgattagttttggctatatttctaaatggttggaatgcctttgctttactaaaggaggcttttgtgtgtgcagagggtcgatggcattttcacagggaaattgatgcataaatatgtttgcacacacaggctgtctctttggtctgcatttactgactcacaagagtaggtgtcattttgaaatgcatgtttttagcggttgtgctagttgaaaggtaaaaaggcaaaggagtttgaagaaaggtttttggaaatctacctggtagcacttacgagtaaacagcctactgcctcgtagatggtcttaagatttataagatgaatggaaaataatattttaatgtatcatataaaaaaactgaagatttggtaccaagttgatgaatggttggcatatttcttttcattacggaatagaacctttgaggtcatactctacaagtatttcttattattttattgcggaaaagcattgcatgggtggtagaggcacatttctttcttttgtcacacatagtggcaaaaacattttatactttgtccctttctgtttctccgcctccacctgcgcccacccccctgcccccccgcccctcccgccccgatcaccaccaacccaaaccaacaccatacctcttaaggaaaaaaattgcaggggaattctcatctacagaggcatgaacaacacacacagagttttttacagagtgctaggaataaccatacacgttggtgtcaagcatataggctgcggaaggctctattgcccagccagagggacaaatgaccctggtgaatgcacgctgactgctgcttgttttgcatgggctggctgctcttccagagtccgcctttggattttggaggttgaggaaggaagggaatattttatgtggcctttggaatacatttactttacactacctttaattttttacctctcatatgcattaaatttttaagaagaccagggtaggggagcagtgggaagaagctgatgtcttgtatccacccatctttcccctgtcctcgggcactgatttccagctggcttttcctagagcaagtaagacagtcgggtcatttctggaaggcttgtagacatccttggatgtctgaagaggtcctagagttatttacttatttacctttaaaacatatttgccgacaccttatttaaaattcctgaaagttcacagtgcctcttcatatgtataccttgggtcctactatgcggttaccatcttgattttataataaagcaaactgggggcggggtgactagattctcacaaccagttagtgaagagccctcgtggggcagcatggctgattttcagtctggtgggctcctgcggactaatgggtcgaggtcctccaggtaaggctgaatgtagaactggcccaagaattcctagttattctcttagtaactttcacatcccttatccagtttgctgccagtgcagtgagaaggaatttcagtttggacttctgggagtgaagtacagaaacccgttaatcaggcagagacagcatgtgtgctcctcagcctgcgttggtgtggcttgcgaagccacctaagcattctgaccctccatttcttcatccataaaacaaggaacacagattaaattatttcttatttaaaaattatttattttttatgtttaccattaccttgatcttgaagtttaaattatttcccaggtcccttccagctgtagtcatttttggttcttagggagagaagccagggactcaaatttcccttcagtcatatttccagctctgtggggtgatttgtggctgcactgttttgctcatttgccgtcattatttccaggaacaaaagcatatgaatatatatgagacacacgcacaggggtaatagcttcgatatccatttacaaataaaatcagctctgtcagcaaactcaattttctgtcaacagggctttgttgatgggaatgcccttgacagctaagcctacttcggtcttcttgtggtaatgcctcataaagccactcactgccaaggtgctcttgggtataacttgcatgaaatttgttataaaattattccgttaaaaaaatctagctggcggacccttaaatgtacttggaggccattaagggtggaaaagctagaaattctaggaaaattttcaacatttatacacgtgtgtgtgtatacacatatacatgcccatacacatatgtgtactacacacattttctatagtaattatgcatataaagttaatgtcatgtacaacaaatatctgaagtctattggataaacaatccatttccgattctggttcagctgagttagaagataggcaggcaatgatctgagatggaaggtttccacagtttggggtcacgtgcaattgtgatagaaggaagattgagattttctcttaatttatgaagctgatatgctattctaactagtttttaatatatcttaccacagggccacccaaaattcaaaattactcctgattttgtaagcttcacatatgtttttgagaatgaggttttatactaatctgggattacagctttctaggctgtgatatacagtttttattaacatttcctattttaaaaatcaattttgctaattaaaacctttttattaagaatatatagaagttctgggaagcagagtgaggatattaacaaatcaccctcaatcctatcacccagagtctccgctgtggaacatggaagtatatctgctttgaagtccttgcaaatatgtttttacacatgcaattatattacacatactgtatgtaagctgcctttttctgtaacttgtatgtgtatggtgcatgacattctaaaatctaacaaccctgtagccatactgtggacatttagggctgctgttggtgtttgacgttgtaaataatactgcagcagatatctgtagtgaaatacttgtgctcttccatgttgatttccttcggataaaattctgggcatggagttgctaggcaggcgctagaaaatatcaccacgttgccctccaaaaagtgtatgcttactatttacactctaggggcaccgatcgcccaggacagtcctacttctcccaaaactttgtcaatattagacatttttaaaattctgtggtttgataggcaaaaaagttatttcatttttaacttgcatttcttcagggactagcaaagtcagacttttttggtgcactgactagccatttgtgttttttcttttgtacattactcttcagcgcgtgttcattttcctactgaagatgagccctttcttgattattgtcatttaggttgcagataacatccctaccgtgtgctgtgtgccttccagatgttagtgggtggttacagttcaacttttttgacatacaagtgtgttgaattttagcgttgtcgcccttgcacctggagcctctgtgtggccagttctgccttttggtggctactggcttctgttagttgtacattgccattactggtctcttgttaccatgtgtgccgcagaaggtgtagccaccaggagctctgtcagcatgaattccctaggaggtgtagacatccatctcggaaggctggtagaaaaattgtctctgtggaaaaattaagaagtgcccagctttccgacaaccctaactcatcgtagttcccatcttttgctctggttgacaggaaactcgtggtcctattggaagcacaaccataggacctctgtacattctcgtgtccggtctgctctttgcataagggtgcttgcccctgcttgtgcccttctgctttttgtttacatttgctctcactgtgatgtttttatgttcattttgatactcaagttgtgtgtttgttctcctgcgtgagacacttctaaacatttcatcatttagggtatacatagatcaaagtaagtggggaccacataaacatatgtagaaacacgttctgaacaccaaagagcttctcggtcaccagttaatattgtggttctttgttgttgttgttgttgttgttgttgttgttttttgagatggagtctcgctctgtcacccaggctggagtgcagtgccgcaatctcagctcactgcaacctctgcctcctgggttcagccagttctcctgccttagcctcccaagtagctgggattacaagcatgcgccaccacgcccagctaatttttttttgtatttttagtagagacagggtgtcaccatattggccaggctggtctcgaactcctgaccttgtgatccacctgccttggcctcccaaagtgctgggattacaggcgtgagccaccacacctggccaatattgttattacagtcactgttttatggaaaaacttagtgacctcatatcgttcttactgggcaagtgagcctaacacaatctgtttctatagtaattgtggaaatgtgacgttacagtggaagaggagagttgggacatggctgtggagtggagctggggctgtccacctctcacttagtatggaatcctctcctaggcccttcagctccagcacactggaagtctaaggggttttgtttgtctgtttgcccctatgttttaatcaccgctaggatcagaagaactgcagtctctgtgaacaggtcttcaggtgacatcagtgtgttacctccctggttagcaattagcattcccgaggtcgggtgctgtgctgcatgcaaagttgaatcaggcacagacagaaccttccttgaaggagtttgtcctctcttaatagtgaagataatatagaaattgtcctagccagtttacactcctaaaacaaattaccatagactaggaggcttaaacaacagacttttattgctcacagttcttctggaggctggtagtccaacgtcaaggtgctggcctgtggattcctggttcacagatggcactttctacctgtgtcctcacatgagggagagcagagagaggaagcaagctccctcgcatatcttttctttttttgagacagggtctggttctgtcactccaggctagagtgcagtggtgcaatcacagctcactgcagcctcaaactcccaaactcctaggctcaagcaatcttcccacctcagcctcctgagtaactgggactttaggcatgtaccaccatgcctggctaattttgtttgtttttgtagagatggagtctcattatgttggccaggagggtctcaaactccgggcctcaagcagtcctcccaccttggcctcccaaagtgctgggattacacgcttcagccacaatgctatccttgagtgcttcttatgagggtactcatccattcctgagggcttcaccctcctgactgcatcaccttccaaaggctccacctcttcatcctatcccattggggttaggatttcaacttatggatttgggaggcagggcacaggcatttagactgcaacataaatgtgaatggctgaggagcatgggattcagaaggcccgagcacatcaggctgcctgctttgctttctgctcctttcttctctcttccctcctcccttcctttgtttctttgttccttctttcctgttgactcagtgagcttttgctgcaatctgctttgtgccaggcattgtgttggacctggaatacagaggtagatgaggcaggggtgagcacagtcgtttcagctaggaggagagatactaaatgaaaataccacagaatggtgaagtgcagtctaggaatcaacaggtagagattcagtactgtgcaagttcagagaagaaaggcatatctgtgtcaatgggtccaggaaatgtttcatggaggaggttgcttttttttttttttttttttttttttgagatgaagtcttgctctgttgccagtctggagtgcagtggcatgatatcagctcactgcaacctctgcctcctgggttcaagtgattctcctgccttagcctcctgagtagctgggactacaggcgcccaccaccatgcccagctaatttttctatttttagtagagacagggtttcaccatgttgggcaggatggtcttgatctcctgacctcgtgatctgcccccctcagcctcccaaactgctgggattacaggcgtgaaccaccgcacccggccccgcatttcactggatcttcagaacaggaatggcttccttggggagggtcccaaaaagtgcgaatcaaaacagagatttgggaaccaccaggcatgcataggtagggcagggcatctcaactcactgcaacccatcagagagtacatctcaacccactacagctcatcagacagtacatcttaactcactacaactcatcagactgacatctcaaatcactacagctcatcacagagtacaactcaactcagtacaactcatcagacagacatctcaaatcactacagctcatcagacagacaaatcactacagctcatcagacagacatctcaactcactataactcagacatctcaaatcactacaactcatcagacatctcaactcactataactcagacagacatctcaactcactacaactcatcagacatctcaacttcactacggttcatcagacagacatctcaaatcactacaactcatcagacatctcaactcgctacaactcatcagacagacatctcaaatcactacagctcctcagacagtatatctcaactcaccacaactcatcagacagacatctcagctcactacaactcatcagacagtacctctcaagtcactgagttttatggtctgtgactgataccccgatagagttgtggaggtgaaaagaatacaggtgaaagtgtttggtaatatgaacacctcctagatccatcctagatgtctagaaattcacatacacatttgtggctcagaagagcatgtaggtgtagggaacaaggtgtaaggtaaactcaaattcatacattgcttgttacctctgcccagaccttagtagctttaagcttttgtcaataatagatcatacctaataaatattacacaacccagatgcttctaaaactattattgaggtaaatgaaaatgtctgccacagtaagatagtatttatcacagagattcagatatgattttttttctcttttaacctaaagaaatatagtaataacaaaaaagtcagctaatatgctataagcaattgttgggaatcttggcatgaaatccagttagggtactgattgtgcccatatcagatttttagaagcagataacctgatgtgtttatgagttttatttctggtctgctttctcctcaaaatttcctgtgtatacattgaaaacaaaaagccagccacagatcacttgatcattatagcataaagagtagaataattgtgttagttaccttgctgcataacaaatcgtccaccaatttggtggcttgaacaccactaaacatttattatctcatacactttctgagggttagggaggagattagctgggttattgtggctcagcatctcctgagattgcagtcaacacgtgggccaggacagccgtcttccaaaggcttgcttggagctagaggatccgcttccaagagggcacccatatgtctgttggcaggaggcctcagttcctccccacatggatctccgtatagggctgcttgagtgtcctcacaacatggttgttggcttccccgctgtgagttatcctcgggagagaggaaggaggaagttgcaatgcctgtgtgatctggtctcagaagtcacacatcggcacttctgccatacatttttaaaccaatttattgaggtataattgacatataaaaggctgtacatatttaatgtatacaacttgatgaatttggagataagtatctataagcctgtgaaatcatcaccacaatcagtgccttaaacggatccatcacctccaaaagttttctcccaccctgtcaaccctctttttttttgttgtcattgataagatctacccccttagcaaatttgtaaatgtacaatacagaattattaactacagacgctgcgctgtgcagtaggtctctgggtaattcatcttgcgtaattgaaactttgtgccctctcaccaatacctccctgtttccccttcccccatcccctaacaaccaccattcattctatttgaaagtttaaaattcttcacgtaagtgggaccatgtagcacttgtctttctgtgcctggcttgtctcacttagcataatgtcctgtaggctcatccatgttgtcacaaatggcaagatttccctcctttttaagtcttttctattcctctatatgcacgcatcacattttctttattcactcatctgtcaatgtctgcttaggtggcttccatgccttggcattcacaatataaatagttcacacaagtgaactattcacaatagttcatgtcgtagtaaacatgtgagttctgccatattttgcttgttcaaaaggagtcagagtccggcctacttctaacaagctccacttgtttgaaggaaggagtttcaaaggaattgttggaacttctttgtttgtttgttttttagaaatgagttctctgtctgttgcccaggctggcatgcagtgacatagtcatggctcagtgcatcgttgaattcctggattcaagtgatcctcctgcctcagctttccaagtagctgggactacaggtgcatgccaccatacttggataatttttttaaaaacttttctttcggtaccagatcttgctatgttgcccaggctggtctcaaactcctggcctcaagtgaccctcctgcctaggcaacccaagttgctgggactccaggcatgagccactgtgcctggctgattttgataactttatacacctcgtaatcaaaacagtaagttccagaaagctcctttgtactctttccaatgaaaccctgccccacaaccatccctccctgatgtgtgaccctagtgagtgttgcctcttcttgagcttcatgtaaactggaccctacttgtgcgttctttggcggttgacccttcattcagggtcgtgcccctgggacccattctcactgctgtgtctcggtagtttttctaaattactggctagtgttcccttctgtgaatacagcaccactggttgatccactcaccagtaggtgggcagtgtttggccaacatgaatgagggcttgtgttgtttctcttgggtgagagagttgtttctctgggagcggtggactggctgggtcgcagggcaggtgtgtgagagtctccttcctcacacagtttcactaggactcagaagccatggtcttttctctcctgtgaagggcttgagactttctggaattgagttcatgtagctgtcctcagcttttgatgagggacgtgtgtgtgttccaataacacttcgtttacaaaaccaggaggcagtggagagttggcccttggtttctagtttgcaaactcctggtctagaaggtaagacaaatattaatttttaaaacccgcgtgtctgtaattgctcattttgaaagcactgtgaagggaacactaagggagaggggatgggaagactttttacatgtgtgtggggagtctgatgaatttgtaaaacctatgattttataacttttctggcctctttttagttgctactgtgagcagtagtccatatgtgaaccagagtggacctccacaagctgccttttgaagttgttacagttagcagagacgaactggcccagggttcaagaagcctttctggctggaggaatgtggatcagtccctccaggcctggaagagggcagtggggggcggggggtgcactcaatcttaccattttcacagatgagagtaatttcatttcagaggggtatgccaaggcagcgatgaaaacttcaggaatagctttgaatatctaaaggaagtgggtaagaaagtgggaggttgggagttccggagggagagttcctgtaaagcagagattcccagggctggctcaacatccacattgcctggagggctttccctgaaacacaggcttgcaggcatgccagcccttgctatttcccacctctgcccaggcctggccctcatcaaggcgggagagcccagctcccagggctcacgctctggaaccaagaatgtggctctccaggcacagagacaatagaggcctggaacagatcctcaaaatgtgtgtgctgaagacatactcagggtccgatacttgagggccatctcacattatcatctccaaatctaggcaggttctgttattgggcattaacccctcgagaaatcagtgcctgtaactatgatttggatcatctgtgctttggatttctcttttaatcttctctgtctcctcccattcttaaccacaagtgatttatcagcctctctaattcaacttcattactctttgccatccaagtccctgcaagcacaaataaaacccaaaggaagcagcagacctttttatccatctgtgaagacactcaagaaacactaaattcatctgactttctagagtaattgctttccccacatggcactagaatcctggcatacagggagcagcttcagcagagacacggcagtagagaaatgactgactgaaggatggttcagggctgttgtcctccctgaaggtggttccaacaggacacaaaagttgcagcagagcctgtgagaacagctgtgtcctttgtcgtcactagctggtctgtctgttcattgggcaatttcagtttttatgactgaaagctgggcatgcaaaggacaaccaaacagcctctagcctgctgatgctcacagtctggaaagtcctatggtaaatcaatatttcttttttgcttttcagagacagtctcactctgttacccaggcaagagtgcagtggcatgatcatcgctcactgcagcctccaactcctgggctcaagcaatcctcccgcttcagcctcctgagtagctgggactaaaggtgcccaccaccatgcctggctggtttttcaattttttgtagagacagggtcttgctatgttgcccaggctggtctctaactccttgcctcgggcagtcctcctgccttggcctccctaagtgttgggattgcaggcacggggcaccacatccaggcttttttcatttgtttttagagacagggtctccctctgtcacccaggctggagtgcagtggtgtgatcatggctcactgcaaccttgaactcccagggtcaagcaattctctcacctcagcctcctgagtagttgggactgcaggcatgcatcaccatacctggctaatttttaattttttttttatttttattttttgtagagactgggtcttgctatgttgttcagagtggtcttgaattcctcccacctcggcctcccacagcactgggattataggtgtgagccactgtgctcagcctggtaaattggtatgtctaaggagagtgtttggtgccattgttcccaggtgttcacactgtttaaaatgtttctaatacatctcagcattgataggttggttgcttggttggtttcttgcctcttttgggctccatcgccttccccactgtctcctttttccacctcatctggcctttgtggagtgctgtgttggcaaaagagctttccacctgtgcctccccaagggtgtgtgtctgtaagagctgcccagggcctgggaaggacagtggagacaccaggtactcgttcgggagacttgtgctcaaaatgacatgggtgtgccggctcttagctgcctgacccgcattctgaggcctggtggcgccgtgcttcttcagcgtgtgaacacctgcctggcagcgtctgatacacctcaccaggctgaagggcagaccagctacctgtgattcctgataaaaattctgtgctttacagaatcccttctatttatgcccacaaccaatggaggagtgctttctagatgataacctcaaactgtcagtgttgagcttgagttgatgtttgagttactgagcgttccacgttccatgctcatggaaacctggctctgtttggaagcagcaatgctgggccctaccccagttgtcccatgagataattgtgctctgtgcacacagttccggtcccagaccctggctttgtagcatacattttcaaggaggactcttgggccaccacagatactgccctatccattgctatttttgatggtatgcttgtgtataatacgtttgtatatggcataagttagcagaatatgtaaatgaaaggaggaaacacctcaatgtcattatccacgggaagtgtgttcactctgtctcttcattgtaaaaatgaggcagtgccgttgcccagagctctcttggcaccttttatacccctcaccggctggcttggtcggctgcaggggtgcccttcccatctcattggctgggtgtgttgcatggtgttatgctttgggaagaaggttgtatggtgctggtgtcacagaggcctgtgtccaggtctgccccatcacagactgaccctttggtcttaggtgctcagcaggtgcctggctcataggaagcccacgcaactccatctcccacaccagggcctttatctgctgctagctcaccgccatcctatgcgatgtggcctgtgatcagcttgtacaggagaggcagctttctggggtgtagttgcctgcctgacgtcacatagctggcacgtgatggatcccgattggatgtgtctgcccggggaaacctcaagtcacaggcagctagcacagctcaagcgtccctaatcagaaggtctgaaatcttaaatgcttcaaagttcaaaactttttgagcaccaacatgatgccataaaggaaaaattccacagctgatctcgtgggatgtgtcgcagtgagaatgcaggtagagactgggcaagctgctgctgtttgctgttgctggcgcctcacagctgaggcgggtgttctggtgccattgccgtgctgcttacttaccctggacacattcctctctcactgtattgatggtatatcgtgcttttcactgttgagtgcttatatatcagtataggaaaattattgcttgttggcagcatataaattcagagtccggaatgacggagatgccagacaactacagattgtgcacatgggtggcagagagactgacacttttgctttatgatggttcggtggatacaaactttgtttcgtgcacaaaattattaagcatattgtataaaattaccttcaggctatctatataaagtgtatatgaagcaaaatgagtgtcaggtttagacttgagtcccacccccgagatgtctcattatgtatgtgtaaatattccaaaatccaaaaacgtctgaaatccaaaacacttctggtcccaagcatttcggaagagagatgtttaacccgtactttagaaagcactcaggcgctggagttcatcgcgggcagcatttcagcagcacctgtgttgtgtgtctgcaaatcagaatgcatccctatcccatcattgacaccaaaagtagttatgatgcctgtggcagtggctcatgcctgtactcccagcactttgggaggccaaggcaaaaggatcacttgagcccaggagtttgaggccagcatgggcaacatggtgaaccccatctctacaaaataatttaaaaactagccaggccatagtggcatacacctgtggtcccagctagtcaggagactaaggcaggagggtcacttgagcctgggaggtcgagactacagtgacccgtgatcacgctgctgcactccagcctgggcaaaacagcaagaccctatctctgtctccaaaaaaaaaaaaaaaaaaaaaaaaaaaaaaaaagtaggtgaggaggaccctgtggtgtgtgttccttaagtcatctgcaagattcagaaattttcccatcctccttgctaaagataattgttaaccctattcagaaaacagtggtggattattgattacagagcagttcaaaactgtttagttgtgttgggaacattcacacacaaggtcctttcacggagaacttaaccatggtgtcttgaaaaaatgcagcttctcaccttttaaaattccgcacaaaaaaagtgaaagtgattgaaagcaacaggtgcatttacattgtgttcaagtgagggcataacatgatgcatgtaataaatatttgcttgcaaggccctgaaggaaatagcccagatccctgccctctgtagaggtgctttcagcccagggaggagcgtggaggcaggtgagcaatgggatgatttgagagagtccccttgctggggcgtgacctggaggtggggtgatgtcagggcaggactgggggagctgagggctgtgtggaggcaggggcagtgcaaggagaccttgcattcagacatggggctggctgtctcgtcgtggaagcaaaaatagagtaatgccagcaggatctctagagtgtttgtttttttcctaacagtggtttcggtcctgtcatagcatgctgggtgactgagtacactaatggtggcccttcctgcaggtttgtccccttcatataagttctgtttggctttgaggtgctgttttagagcttcatgctctgtctccttcagtggcggccagcccagggagaatggcagggccgtgggctccatgtagcagatctctgaagccactgctgcttggagcctgccggccctctcccctctgggaactgtgcaagcagctgtctccttgggaacgtggcattagcatgttttgcatgagaatgaacaccaaccaaggctgaatatcaattggatcctagagtgcagctgcctttgaaatgttcctttgtgtggccgaacttcctgctgcagttgattcctggagcttgtgcgaagacacaaagtcttaagtcatcttagtgccttgcttactctatctctggatcttgctgtcaccatttattttatccttagaagtatggcaaagagaaatgcatacatatatgcagagacacatgtctacacacaggcacaacagagacacacgtacctacacatgcacacaacatatacaacccgggcacacactcacaacatgcatctccacacagacacaacacaggcacacatacccacacacgcatacaacgcacaacacaggcacacacatacaacacacatggacacagagacatgcatctacacacatacacaacccaggcgtacacatacaacatacatctacacacagacacatgtgtacattcagacacaacccagactcctacatctacacatgcaaacaaccagacatacacatacaacgtacatctatgcagagatatacatctacacacatacacagcgcaggcacacacacagtgtacatatagacagacagacatttatacacatacaacatgcatctacacacacaaaacatagacacagacaacatctacacatagatctgtacacatacacaccagatgcatacaacatatagacatgcacgtaacacatagacatgcatctgtgcgcaagcacaacatggaccactcacacacacaacctgcagagctgcctcttggaaccagttagaaacaaaagttggaatatgaccccagcaagtccccaatccccatttttggtccttttcttcgtttgtgttgttgaccctgatggcccagattcttatcaactgcgacaataaaaaccaattagtgattttatagtttgactttgcaaggtgggggtggggggcaaacttggtccagacattgctgtgctgctgcaggtctgaatgaagtgcagtgttgggctggagcgcgccccgtgctgcacttctggcgtgggaagtgacgatgcagcacacaccactcccctgagaacagagcacccagctcctgtagtttggccctctaggaagatgggaaggagcctgtgggcaccttctgattaggagagaagccaggagccagcctgccgtccactttctcagtgggtctcttgctccatgtcattgttcacttctcacagggcctttgctccctgcaggtgagttctctttcgtttatgggtggatctcggagcacttctgcagaaggcactttgcaaatagagttcctttttaatcagtgggtgaccaaaggcacttggattttagcaataaattataggtcatttaattatctgtttctgtgatgtggtgatgtgatatggtttggctgtgtccccacccaaatctcaacttgaattgtatttctgagaattcccacgtgttgtgggagggacccagggggaagtaattgaatcatggggcctggtctttcccctgctattcttgtgatagcaaataagtctcacaagacctgatgggtttatcaggggtttccgcttttgcttcctccgttttctcttgccactgccatgtaagaagtgcctttcacctcccgccatgattctgaggcctccccagccatgtggaactctaagtccaattaaacgtcactttgttcccagtttcaggtatgtctttatcagcagcgtgaaaacgaactaatacctggcgcttttaaataacaggtaccaggtgctttcaagtgggtctatgggtgatagatttcaggagttttcaaagggaaaaaaagtgcaagtgtacctcaactctttggcatgaaatgaattattgaacgctgaaatattgaggctgggcgcagtgactcacacctgtaatcccagcacttgggaggccaaggcaggtggatcccttgagtccaggagtttgagaccagcctgggcaacatggtgaaaccctatctctacaaaaatacaaaaattagctgggtgtggtggtgcacacctgtggtcccagctgctagggaggttgaggtgggaggatcatctgccaaggaagtggaggctgcagtgagcccagattgtgcactccagcctggacaacagagtaagaccctgtctcaaaaaaaaaaaaagaaaagaaagaaagaaagaaagaaagaaatatggaaatgaaatggaatattgaattctgaaccattgaatattgaaatgcaatgtgggggagacatctgacctgtgagagcgcttctcagaatgcaaatcagtttggcagtattttaatgtcattctgtgttttataaccagacaaatgtattgttctctaacccatgcatagctgtgttcaagttttgttttgttttgttttgtttttttgagacggagtcttgctttgtcacccaggctggagtgcagtggtatgatctcagctcactgcaacctccacctcccaggttcaagcaattctcgtgcctcagccttccgagtagctgggattacaggtacacgccaccatgcccggctaatttttgcatttttagtagagatggggcttcaccatgttggccaggctggtctcgaactcctgacctcaagtgatccacccgcctcggcctcccaaagtgctgggattacagatgtgagccactgtgcccagccattcaagttattttgataacacttcaagctaggagtttctgttagtgtctgtctgatgcacatgagaaatctgacttctttgagtggggttgctgttgtctgaagctgaggttgagctatttggttacagcttgttttctaagcctgtgctgtgtcttcagcctcctctaagctgagagcagaggaggctgccctcccaacactttgggaccagacctcccaacactttgggaggccgaggcaggtggatcgcttgaggacaggagttcaagaccagcctgaccaacatggtgaaaccccatctctactaaaaatacgaaaattagccgggcgtggtggcgcatgcctgtagatctagctactccgcaggcaggcaagaggatcacttgaacccaggagtttgagaccagcctgggcagcacagtgagaccccatctctactaaaattttaaaagttagccaggcatggtggtgggcacctatagtctcagctacttgggaagctgaggtggtaggattgcttgagtccaggagttcgaggctgcagcatgctatgatcacactgtactccagcctgggtgacaaagcgagaccccaactctttaaaagagcctttgttggtcttaattttcataatacaatactgattttcaaggttttattaaagaattgatttgcagctcatcttagaaaggtttacccctttgtatatggcaatttcccataagccacataaaaatactgtgacttgaagtaaatatttctgaatctagctgtatgtgagcatttccacaaacattaatgttgtttctaaagtttttgttcatttattcctgcaaaaacaaatgcaatttgtgtgtgtatgtgtgtctgtgtgtgatgtgtgcgcctgtgtcttgaatgcttcatgttcccttgtgggacatgccagtcgacagcctcatgttgtctgaggtgcgtcacgactccccaccttgcatgaggagttgcggtggcgacaggtgtgggaaagtgcatatggatttaactcctgaaagtggcttaaggggattgtgaagatccaggtccagtcccttgtggtgggaaggtattattggaatcgttgattaatttgtacttgttcttcctctagacaagcagatgcccagtgtcgggaaggcagcccaggatcacagcagcacccaccgagtcagaaggcaccgaacccacccacattctctgaactatctcactgccggggagccccagagctgccccgggagggccggggccgagcgggaaccctacctcgagattatagatactcggaggagagcaccccagcagacttgggaccccgagcccagagccctggctcacccctgcatgctcgaggacaagactcgtggccagtgagctcagccctgctctccaagaggccagccccacagaggccaccgccacccaagcgcgagcccaggagatacagggccacagacggcgcacctgctgacgcccccgtgggcgtcctcggcaggcccttcccaacgccatcccctgcgtccctggatgtgtatgtggcccgcctgtccctctcccacagcccctctgtgttcagcagtgcccagccccaggacaccccgaaggccactgtctgtgagcgtggaagccagcatgtgagcggggacgcatcacgtcctctgccagaagcactgctccctcccaagcagcagcacctgcgcctgcagacggccaccatggagacctcgcgctccccctcgccccagttcgccccccagaaactgacggacaaacctcccctgctcatccaggatgaggattcaaccaggtactgtcctgcgacggtgttccctccccatgaggctcctaatgtgggacgcgggttctcagtgggtctttctggggagtcacctgggcaccttgctttagctcaaggcgttggacttaaagtcagtactggggaataactgtgtggacagaaagtgaagcttcagtggtggttggatttttatctcactggggggctgctgtttcctgcagggaacaggggtagatgtgaataggtgatacatcttccccttcctccaagccagatgcatttatatctgcattacccacaggcatctgcagggtagaggtctgtttttttttgtcgttgttgttgttttaatgcagtcaatatttgtgattggaatcgagtttaacctaagcatgcgacctttaggtgaaattggtatttttcatggtgtccagtattttcttactcctttttttccagatttttttttaatgttagaaagctaagctggtatataccttttgttaaagcagaagaatactcattcacatttcatggtgctatcatcaggatttcaggcatggaattattgcgtccattgagatgctgatgaatgttaggcaggaacttgacctttcaagagcactaggcccagcatggtggctcacgcctgtaatcccagcacgtcgagagttcaaggcaggtggatcgcttgagctgaaggagttcgaggctagcccaggcaacatggcaaaaccttgtctctactaaaactacaaaaaattagccaggtgtggtggtgcatgcctatagtcccagcttcccagggaggaggctgaagtgggaggatcacctgagcctggaggtcgaggctgcagtaagccaggatggcaccactgcactccagcctgggtgacagagtgagaccctgtgcaaaaaagagcaccggctgtttagctttcttcacacacaaataccacctccttgagtgccttgaaggactgagaaatggaagaaggggagaatttctgtctcattctctggagcagtggctctcaacctaggaggtggagtgtgattttggcccccaggggacattaggcaatgtctggagacagtttttgttgtcctaagtgcgatgggagtggggggtgctctctgcatctagtggtggagcccagggaggccactcagggtctgcagtgtgtgggcggcccccacagagcattgtccgaccgcagatgccagctgctcttaggctgggaaccctgctgtagagccgcacgcccagcacaggacccaccatcacctgtgctgtgtaaatgtggggcaaagaaaaccaagtcgatgaatgcaggtcctcagtcacaccaggtgtggcgggtggctgccgtcctggacaggacagataacaggtattcccatcgccgcagaaaattctgtgggacctcactgctctagagtctcaagtaattttttttcttagcttctaaataactcagcagagaaagaacatgactgatactgatcctgtatctccagccgaggcattgtaaccacagttttctctgtgggccaaaactgggctttgcatcatttaaaatgtatctaaagatcattcagatatcccttgaattggtaacattgtaaggttctgaaaggaaagtgtcttactcctttcaggctgctataataagatctcatagactgcacggctcattaacaggagaaatgtgtgagttgatgagggctggtcgctggaaggtccgacccactgtgttctgtccttattttgaagtcaaggctcgtgaaactgttctcatgtggaagtcaagactgtttttaagaagagagaccatttctgttaaaaaatgatcaggaatagatgctttgttggaaagtgtatgtgaacccgtgggagataggagatttgttttttttccttcccggtactgtattttatattattatcattattattccctgtcgcccaggctggagtgcagtggtgcgatcttgacttttgggttcaagtgattctgctgcctcagcctcccgagtagctgggattacaggcacctgccaccacaccaggctgatttttgtatttttagtagagacggggtttcaccatgttggccaggctggtctcaaactcctgacctcaggtgatctgtctgcttcagcctcccaaagagctgggattacaggggcaagccactgggcccagcctctttcccaatattttaaaacctgtgaagggagatttgtttatgttgtttaatttgtttctattgtgcacatcaaatttctgcacaaaagggggaggataccaatacaggctgatgtgaaagtcagtaataggcaagcagagcttctcccgggagccgggggggcgggggtgaagggagtgcagagggttctgcgtttgctggtgcttggataaggtggccaggttttcctccttcttttattattattattattattattatttattattattatgtttttaacagagaggtggggaggtctcactgtgttacctaggctggtctcaaactcctgggcgcaagcagtcctcccaccttagcctcccacagtgctgggattccaggtgtgagccactgtgcctagccagggttttccttcataagtctgacctatctaaatggtattttccacagttagactttgtaaattgtcttcatgaggaagcagttgtgaggtgtctgtgagtccctagataaaacacatcagatgttgctgaaccctactggagagagggaggaaaatacgcagttagttcatctcagcctgagcaccactgccttgatagggaaagagccctcctgcattcccagtcaccagtgaaagagggaaaaacagcattaaatttagagcatcgtggctgccctcctgctgtggaaaattggatacatttgtgtaacatcgtaggggcagttttgggttgacttcattagaaacacatcctaatttggggttgtggagtttggcctgtttctttttgcttccctcctgaccaccagcatatggggctgcttctccagtgctctgaaaagctcttggctgagatggccctggtcagcatggtctagcacggtgccgctgagagcagcaggtgcagggctgccccagacaagggactgtggcattgctgggcctgttcctcctgttctctctcccccagtctcccagggatgctttaggtacctctctagtccctttcatccagaaacttttcttttttttttgagatggagtcttgctctgttgcccaggctagagtgcagtggtgtgatctcaggtcactgatctcagctcactgcaacttctgcttcccaggttcaagcgattctcatgcttcagcttcccgagtaggtgggattacaggtgcgcaccaccacacccggctaatttttgtatttttagtagagacagggtttctccatgttagccaggtgggtctcgaactcctgaccacaagtgatccacccgcctcggccttccaaagtgctgggattacaggcatgacccaccacatctggctgacacttttttaaaaaaaaagcaaaactgtgccctttggaagtaatacagaaccgatgactcgctgcttactgcgagatcgtatctcactggtgtgcaaatctgtgcaacgctagcttgaagcacagcgggcggggggtacaaggacagtgttgggtgggctgtcctgcatatggcacaggaggttctcccaagtggggtggtggggggctttggcctgactccaagcacggccactccggagaggagccctccccaggccctgagaactacgcaggaacccgcgggcctgcaccaacctaaggacggatgggaatcctggaaaatgcccatccactgcaggcttcccctacaaaagaacatttaacccaacagggcttgttgaagtttgcattatcatctgcggaatgacaaatggtattaaatagtcctcacagccctccacgaacccctggaggacaccttgggatgcctcaggggtggcattggcggtttgagcatagaaaggatgctgtggttggaaggcggaggtaggagtcagagggagcttcttgaggcctctgcctcatccaggatgtgggatcatggaggctccttcgagttgggtggctggctagtgcctttgagtcaggttcccatccagaggggagggcaggggacacgtcaatcagggtctgtggctggagcatgctttgcgatttcagcagactgttcatcttccagaattgagcgggtgatggacaacaacaccacggtgaagatggtgcccatcaagatcgtgcactcggagagccagccagagaaggagagccgccagagcctggcatgccccgccgagccacctgccctgccccacgggctggagaaagaccagatcaagacgctgagcacatctgagcagttctactcgcgcttctgtctgtacacgcggcagggtgctgagcccgaggccccacatagggcccagccggctgagccccagcccctgggcacccaggtgccccccgagaaagaccgctgcacctcccctccagggctcagctacatgaaggccaaagagaagactgtggaagacctgaagtcggaggagctggccagggagatcgtggggaaggataagtccctggccgacatcctggatcccagtgtgaagatcaaaaccactatggacttgatggaaggcatcttccccaaagacgagcacctcctggaagaagcccagcaacggaggaagctgctccccaaaatcccctctcctagaagcacagaggagaggtgagtaggcgtggcctcccagcttgggcgtgactctgcctggcatctcttaggcttgtaaagggaagggggtctgcctctctgttttcatgcgtgcttttggggaagacgggttttcataagggctcctcgatgcttagcactttttggcttttttgtgagcctccggaaagagaaatggagggttaacggctttgggcctgacatgaaaatacacactgcagaccaccaagctgccttggcctgaggccagcaggatttctgatgatgcccacaggtctcctttctcgtaagacagctgttctcagtgggggccgctgtctaccctgggggacagttggcaatgtcactgtggggaggggtgttccaagcatctggtgggtggagcccaggaacactgctcaacatctacagtgcacaggagggccccccccacagagagtcatccagcccccacgtgtccctagtgccaacatgagaatgaaggcttagattgaatatatatgtgtttctttatgaaatgtttttttaaaactttatttgaaatttttttacatctgcatttaaaaaatttattataatttggccaggcacagtggtgcacacctgtaatcccagcactttggctgaccgaggtaggcagatcatttaagcccatgaattcaataccagcctggacaacatggcaaaacccagtctctacaaaaagtacaaaaaattagccaggcgtggtggtagacacctgtagtcccagctactcgagaggctgaggtgggaggatcacttgagcccaggagttggaggctgcagtgagctatgatggtgccactgcactccagtgtgggtgacagagtaagaccccatctcttgaaatagaaatgaaaaaaaattacgacaatttacacctgcctgaacaaatgtattttaattggttttgtaagtagcactttcagcgtatctccttcagccacttgaccacaaaggcatgcgtggtggcatcttccctgctgctgacatatgttctgccagcacagcgtcattcatgggtaggaaggtggagtgggtatgacacacagccaaggaggagcagctggaccaagtggacccaggcaggagggcgccgacagggctgctgggaggaagggagaagggttggtgtttgtagatagcgtcacacatgtccttgtcctcatcaacccaggctcctggtagagatcatctgtgctctcacctctgtagcagagattcttagatattcctgcttatttgagtttttgccttttttaaaaactatgtttcatacacttacgagtatccatttgacagggttgatggtttttagttttaaccttgttacctacttacttttccccctttggctgtctcatctccctggctggtgtcctttcgtgagcaccagtgttgatttgtcacaacccagggggtggggcagaggggctgtttgcgtgcacagtcccagctcattgaagttcccacacctttacccaggaaagaggagcccagcgtgcctgcggccgtgtccctggccaccaattctacctactacagcacgtcggcccccaaggcggagctgctgatcaagatgaaggacctgcaggagcagcaggagcacgaagaggattcgggaagcgacttggaccacgacctgtcggtgaagaaggtaggagagtccattccaaatgacagcgtgtgcgtgtccaggcaggggcaggcatccggatcacaccatcctgccccagcgcagaccctgcaccacgtgtcccagggcgtttgtgttcagctttcactcaggacagtggaatttgaggtgatattagtgaagccctctgttgttagttctatgtcctaatcttgagccattccacaaacgtctctttgctgtttcaataggatccaatgtcaaattagtttagtcaccattctctttcattttatcttatttatttatttttgagacagggtcttgctctgtcgtgcaggcttgagtgcaatggtgcaatcatggcccaccgcagccttgacctcctggcctcaagcgatccccctgcctcagataaaggaaaattattttcaaattagaaagtggtaacttttttttgagatagagtctccctctgtcacccaggctggagtgcagtggcacactctcagctcactgcaacctctgcctcccgggttcaagcaattctcctacctcagcccctcgagtagctgggattacaggcacctgccaccaagccttgctaatttttgtatttttagtagagatggggtttcaccatgttggccaggccggtctcgaacctcaagtgatccacccaccgcagcctcccaaagtgctgggattacaggcgtgagccactgcttccgggctggaagatggtaactttttggttcaaggtattaaaaagggaaatgaaaattaagggtttaggtcttggggcttttacgggccctccatctggcacacggtaccattcgcttcattctggttgcacattcctcttttaaaaaataataaagaatccaaaacatgttcggtttttccacacagaaccaggaaaatcataccatctggaccatttgaatttgggtcacaccctaggtttagagaactgcattctttgctcgcatgcctttgtttttcatgatataatgaatttcagaagcggcatgccttgattctgccgccctcatctgtggggcactctgtccacctgctttgggaggctggagatgctgggaagccgcctcaccagaagtgtggctccggaactgagtgagtcactgtgggctggaagttggcctcactttagttcagcaagtgtgagttgggcacctgcaccagaagcacatgctgtacatcccagctctctatggtgctgatgactcagcggtcctgttttcctgcttgattggacaaagcggccactgctgcattacattttctccctgctttcccgcagccacacgcttatgatgtcgcacattcctgcaacgcgtgcacaggcggaggcgtgttcagggaggaagcgagcatagcgcagatggggacttagcaggccacctgctctgtagctgcttcaggggaacatatgagaccctaattccgtaggcttccaacattcccagggcgaccacagttgtctcagtcacagcattgctaggtggtcatagagctgagagccaaatcagggaaccctctgttttaggagaagactaaggacagagttgagagagtggaagccccaggcagggaggcagcagggggctctggtggctggtagagaagcatcacgcagagatgacaagatatggttttatacttggggcagctcagaaggactctgcccagaaaagagggcaccatgttgagttgaaccagatagctgattggtttaagtttagaatctttgagaattatggcttttccctggaaccaggaggtgagtgcagggcccagacagaatagaccttgtttcccctatagaagggaacaaaaggtggaggaagggaatgaatggcccagggctcattcttagtggagggatgagagtggctgtgtgcctggtctctactgttgcaggctcttacctgagcctcctggaaagccacgcactgcaagaaatagcagatgggcctgccagacagtatggaccacagtggtgagcccttcagcaccctgggtggtgtggacagccactgatctgttcactgtcccaggccaggtcttgtctcagaaatctttgaaagccaacggctgttctttatacaatggccctttaacaaaggggaaatggtttcaataaaaatttgcatatgacatgtaaaagaaccaataaagaaatctggactcctttcagagagcccagtttcaaattagctcagctgaggtaggttttgagggcacatgttcatgcaccagtataaaatctacatttccgtaattgctgaagaataatggcactgaaaatttcctgagcggccgggcgcggtggctcacgcttgtaatcccagcactttcggaggccgaggtgggcggatcacgaggtcagcagatcgaggccatcctggctaacatggtgaaaccccgtctctactaaaaatacaaaaaattagccaggcgtggtggcgggcgcctgtagtcccagctactcgggaggctgaggcaggagaatggcgtgaacctgggaggcggagcttgcagtgagctgagatagcgccactgcactccagcctgggtggcagagcagagactccgtctcaaaaaaaaaaaaaaaaaaaaaaaaattcctgagcagccctggcgggcgtccttccttatccacagttccctgcattgcttgcagtcttccttcaggctagcattggtatcaggaatttgggaagttcttcatgcctgtttcctgttttgtgcttttccctcaagtgatgactatctaaaatttggccacattctcagctgtgagattctcaacttaaacagtctctccagataggtagtgagtaggaaaaggcacaaaccacttttcctctgctctcacgccacagcaaccaacacagaagacttcggtgaccacatgtgtgaggggggtttcccacacacccagcgagcagtcacttctgcagcagacaccagctgggtggcctctgattcagttcagatgtgacactgtcaaattggaggtagcgtctcatcccacgggttgagggctcagtccccaagactgcaccccccacacacaccagtcgcaagtctgagtctcagggacttctgaccaaccaccttcaagttggggttcccatgaccccctctttagtttccattactttgctagagtggctcacagaactcagggaaacatttacatctatgataaagaatgttacaaaggatacacatgaagagatgtgtagggcgaggcatggggaaaggggtgcggaagagcttccatgccctccctgggtgctccaccctccaggaaccttcttgtcttcacctgtcaggaagtctccagccccgtcttcttgggccttttatggagccttcattggataggcctgatagaaatctgtgtagaaatgtgattggacaaaaagactacaatccagtcctaacagaccgaggagaaagccacaaggtctgcctgttgagattcttgttggcctctctgtgtagcgttccttccccctaggtgtgccgcaggacccttcaggaatatggggatcttaagacctgcattcattcaaggcggtggaggatttctttatggaaaggttggggaagattagatcttgctttgggcaggtaaaagtttaagaccagcctgggcaacatggagagaccccgtctctacaaaaataaaaaaattatctgggtgtggtggtgcatgcctatggtcctagctgcttaggaggctgaggtgggaggattggttgagcccaggaggtcactgctgcagtgagtggtgatcatgccactgcactccagcctgggcaacagagtgagaccctgtctcaaaaaataaaataaaataaaataaaataaatgcatccatgtgagggaaagacctcacgcaatcaggaaataggctgcctcgtatctggcacatgtttctcctgctgtggggttgacttttcctgcctaatgctcatccggctggtcattttacccatagattatggaatcagggcacgaccacttgaagccaggagtttgaggctgtagtgcactatgatcatgtctgtgagtagccactgcactgcaacttgggcaacatagcaagaccgcttctctaaacaagtagaaaaaaggtcatcatttagaaggctggtgggaaagggcatagagtgttagtgtctaatagttacgcagtttcagttggggaagatgacagagttctagagacggatggtggtgacaggtgcatcgcagcatgaatgtaccacacaccacagaactatgctctgaaaagtggtcaagatggcaagctttatgttacatatattttactacaattttgaaaacagtcatctgtttgcattttggtcaagttgaaatcagtaggttatagtaaaagactgttaagttcattcgtatccctttattggtcttaatttttatatgctagtattagcaattaaaattttttttctttttttttctctttagcaattaaaattttaattgctaggccaggcccggtggctcacacctgtaatcccagcactttgggaggccaaggcgggtggatcacctgaggtcaggagttcaagaccagcttggccaacatggtgaaaccccatctctactaaaaatacaaaaattagccaagtgtggtggtgcacgcctgtaatcccagctactcaggaggctgaggcacgagaattgcttgaacccgggaggccattgcactccagcctgggcaacagagcaagaccctgtctcaaaaataaaaattaaataaataaaaataattgctagtgacaataattatatgtacaggacacataactaatcacggaatttggtgctggacataagactcactactttctctctatgtgaatctttaaattagaaaattccaaaggacagaatacataggtctgtgactccttccaaagatatgggttgaaactgcatctaccatgacgagcatcggggccacaactccgacgttctctaatagggcatgaacagaacgagaacaggtttattttatttttaaatgccaatagtgccattaggagtcattcttctttcccttagtcgtataaatcccctattatttggtgatgcaaaagtgagctttcacgcaggtcagctgcacctttcacgtaggtgcgccaaggtggcagtgagcagtgtggccggggtgggggccggcctaaccagtgtctccgtgttcccttgccatcccgtgcccaacagcaggagctcatcgagagcatcagccgcaagctgcaggtgctccgggaggcccgcgagagcctgctggaggacgtgcaggccaacaccgtgctgggggccgaggtggaggccatcgtgaaaggcgtctgcaagcccagcgagtttgacaagttccggatgttcattggagacctggacaaagtggtgaacctcctgctgtcgctgtcaggccgcctggcccgggtggagaatgccctcaataatttggacgacggcgcttctcccggtgatcgggtaaatgcagatacgtctgacttggaaatggggggtggtctcgtgggaaggctgtttttcaagtgtcgtgaaagtcagctccttggagcctagcatagcttccacatggcctgtccacctcctcctgcagaccttgtcgagacagtgcacgctctataccctctccttccttttatatttctttagttgtttgtttgtttgtttgtttgtttgagacagggtctcattctgttgcccaggctggagtgcagtggtgcgatctcggctcactgcagcctctgcctcccgaggttcaagagattctcccacctcagcttcccgggtagctgagctcccaggtgcatgccaccatgcctggctaatttttgtatttttttggtagagatgggatttcactatgttggccaggctggtctggaactcctgagctcaagtgatccgcctacctcagcctcccaaagtgctgggattacaggtgtgagcaactgtgcctggcctccttccttttaattgaggggaaaaggtgcttatcagatgcagggagttgaaccgtcattggactgcagggttgcgggatcttctcaaagaactgttacctctttttaacatctttttagatattcctattgactcttactgataattgtctcttcttagaaaaatcatgttgttgttgtttttacttttcttttaccatgtataagtccgtaacagacatgcctgcctgctgacgatcgtaagtactcaatgatagctattttcttgtggtggttgtagctgtgatttaacaagagggcatgtatcagtctagaaggaagcagacagtgcatctaacttcaaggcgtttctcagtgggtctgtcttttcgtcctttcacatatgaaccaagagaaataatagctgcctcgttggcttttacctcataggccaaatatcagtaaaacagctagttttgtttgcacagaacaggccttcagaatgttcatctgtatcatgaataaaacatcttaacctctctcagaaggggagcagaagaagcacccttcccctttctccaggtgagggtgatttgggccacgcagaacgctgtcctggcgctgggcttggagacggtgcccttctgcactcagccgagtgcttagtaactgtgtcgtggaactagctaggtcagggtggcaccgtgcccgagggggctgctggccgacacccgtgcacagcactgcgtcttctccaccctcaggcttccttgtgtgcagatatgctctgcaggctcgggggcttctcctcctcctgccaggagcatttagtaagcctaccctgaattcctctcgagtccacccatgtggccagctgtcccacggtgttcccatggagcggaccttgacgccaagagggccccgcagtcctttgccctttgcagcatctcagaattctgtcgttgtgagtcccttggtgactcttctgctcaccattcgaggcaggtgggagagagtcaggctcagacagcaagaggaaacccagagaggcctgtgggcggcttctgggggcctcaggctggcccgctgcaaccatgagacacatgcccccaggccctgggccctgggtttgtctgtgtggaccccatcggatctctggtggcatcagggtttccatcgataagttgtgggaccagcccacaagttgccagtgtcttcaagggttggccagtgccccagctttcatcctggtcctcaacaggcttgtttgtctgtcaacagcaatcactgcttgagaagcagagagtcctgatccagcagcacgaggacgccaaggagctcaaggagaacctggaccgccgcgagcgcatcgtctttgacattttggccaactatctgagcgaggagagcctcgcggactatgagcacttcgtgaagatgaagtcggccctcatcatcgagcagcgggagctggaagataaaatccaccttggtgaagagcagctgaagtgcttattggacagccttcagcccgaaaggggcaaataagagaccagtccccggtggaggaggggcacggggcctccgagctccagctccgttcccaaggatactcgtgaagaccccatctgtgttcatggcctggaaagagacttctcccatagcaaagaggctgttataaaagcaataacttttgtgtttgtgtgggatgatttatttaattttttagtttcccctttgattgctgagagccattttcctttacacataactacacctgacaccaggctctgctggatgtgagtttccactgcatgggctgtgggctgggcctgtggtgcctgccgagtggtcactgtcagtgggaaacccgttgttcctcccgtcttcagatgctgagccaactgcttggacagcagccagcgcgtcatgacgtgcatgagagggggaccctggtgctcatcttctcttgtcattcatccaggcatgggctgccaggttttgtccctgctcgttcaacagtgtgagcatttgtctctgttatctaatgatgttctctgacccagcagaaatcatcatcatgatgatgataatttattaactttttggaagggtgaatagtttcctaatggttaaaaaccaactgtgaaaggaaccacctgtgtggttgggttcactcattctcagattaaattgccacttaaagaaataacgtgcatgctttaaaaaacacagtcacgcaccaagcaggcaaatagctttagtccttctcacctcacatcacagttgttctgcaaagtaaaattttttggttaagagcgtgtccagtagtaatgtgcttgttagctgtttctcaagaccaacagaagattttttcagttactttccccccatgtattttgtatgcatatgattgtccgtgataattggctacttttccattgtttcctccttaaatcgtttagcatggcatgagggccacattccatggacgggaagaccccttcctcttcagaggtcccgtggactacacagctcctgagcttgatctttttctgccatgaagtttaaagattctatgcccatttccttgattgaaatggcaggattctaaagagagcctggtttgttaaaagaaaacactgtcatgctgtcagttcccaattgacaagtcacagactgggagaaaatatttgcaaatcgtgtatctgacaaaaggtttgtgtccaggatgtacaaagaactctcaaaccggatagtaagaaaacaaacagcccaagtgaaaagcaggcaaaagacttgaatagacacttcaccaaagagcatacacgcgtggcaaacaagcacacgaaaagacgttcagccgccgatggcttggttataatttataacttacttatttttatctaataattgtagattcagtgtatttcttcaaaaaatgtttaattaaatgcatgttaatggtg

SEQ ID NO: 2968 - DNA, 36753 bp, human
tttgtagttcccagtggctcttttgttctgctatcttgaagggcaggttgcttgtcagctcacaatgctgtgggtaaggtctggtgaggtcggcgaatgtgttctcattgtttattcttctgcctgaagatgagaaataatgcaaatcagggtgcagattccggctcgagctccacaggcgtgcacgtatgtgtaagggcatgctcgccggtgctgcatgtcctcgtggatgcatgcaatttttacagctttgggattcacggttagctgaaagcacattggaactggaaggcggtgctcttaacaccgtgttctaggctggaagccgtagagccatcatctgctctgatgggactgcagcccttggtatgtgggacccttgctccatgtgagttctgcagatgggttccccgagggagctggctggaggacgccagcatcgcatgaagacctgcctgcctcgtttgccttttgtttttcagtagcagtaagaaacaggcattctcactacacaggcattgaatgcggacattgagaaaaaatggtgagtcagctacatcctcaagaaaaaaaagcggcgaaatcaggtgtgcatgtttagtcatgagaaatgttccctgagtgcgtttgcacatagcctgctgattgcagtgagataatttaaatagagaaaatggaatcaccatggttcttagcattttccagttcttttattttgctctttggtgtgattgtgacagtttaagggttttactatacatgtgctttttcccccattttatgttgtgataaaagaaagagatgattagttttggctatatttctaaatggttggaatgcctttgctttactaaaggaggcttttgtgtgtgcagagggtcgatggcattttcacagggaaattgatgcataaatatgtttgcacacacaggctgtctctttggtctgcatttactgactcacaagagtaggtgtcattttgaaatgcatgtttttagcggttgtgctagttgaaaggtaaaaaggcaaaggagtttgaagaaaggtttttggaaatctacctggtagcacttacgagtaaacagcctactgcctcgtagatggtcttaagatttataagatgaatggaaaataatattttaatgtatcatataaaaaaactgaagatttggtaccaagttgatgaatggttggcatatttcttttcattacggaatagaacctttgaggtcatactctacaagtatttcttattattttattgcggaaaagcattgcatgggtggtagaggcacatttctttcttttgtcacacatagtggcaaaaacattttatactttgtccctttctgtttctccgcctccacctgcgcccacccccctgcccccccgcccctcccgccccgatcaccaccaacccaaaccaacaccatacctcttaaggaaaaaaattgcaggggaattctcatctacagaggcatgaacaacacacacagagttttttacagagtgctaggaataaccatacacgttggtgtcaagcatataggctgcggaaggctctattgcccagccagagggacaaatgaccctggtgaatgcacgctgactgctgcttgttttgcatgggctggctgctcttccagagtccgcctttggattttggaggttgaggaaggaagggaatattttatgtggcctttggaatacatttactttacactacctttaattttttacctctcatatgcattaaatttttaagaagaccagggtaggggagcagtgggaagaagctgatgtcttgtatccacccatctttcccctgtcctcgggcactgatttccagctggcttttcctagagcaagtaagacagtcgggtcatttctggaaggcttgtagacatccttggatgtctgaagaggtcctagagttatttacttatttacctttaaaacatatttgccgacaccttatttaaaattcctgaaagttcacagtgcctcttcatatgtataccttgggtcctactatgcggttaccatcttgattttataataaagcaaactgggggcggggtgactagattctcacaaccagttagtgaagagccctcgtggggcagcatggctgattttcagtctggtgggctcctgcggactaatgggtcgaggtcctccaggtaaggctgaatgtagaactggcccaagaattcctagttattctcttagtaactttcacatcccttatccagtttgctgccagtgcagtgagaaggaatttcagtttggacttctgggagtgaagtacagaaacccgttaatcaggcagagacagcatgtgtgctcctcagcctgcgttggtgtggcttgcgaagccacctaagcattctgaccctccatttcttcatccataaaacaaggaacacagattaaattatttcttatttaaaaattatttattttttatgtttaccattaccttgatcttgaagtttaaattatttcccaggtcccttccagctgtagtcatttttggttcttagggagagaagccagggactcaaatttcccttcagtcatatttccagctctgtggggtgatttgtggctgcactgttttgctcatttgccgtcattatttccaggaacaaaagcatatgaatatatatgagacacacgcacaggggtaatagcttcgatatccatttacaaataaaatcagctctgtcagcaaactcaattttctgtcaacagggctttgttgatgggaatgcccttgacagctaagcctacttcggtcttcttgtggtaatgcctcataaagccactcactgccaaggtgctcttgggtataacttgcatgaaatttgttataaaattattccgttaaaaaaatctagctggcggacccttaaatgtacttggaggccattaagggtggaaaagctagaaattctaggaaaattttcaacatttatacacgtgtgtgtgtatacacatatacatgcccatacacatatgtgtactacacacattttctatagtaattatgcatataaagttaatgtcatgtacaacaaatatctgaagtctattggataaacaatccatttccgattctggttcagctgagttagaagataggcaggcaatgatctgagatggaaggtttccacagtttggggtcacgtgcaattgtgatagaaggaagattgagattttctcttaatttatgaagctgatatgctattctaactagtttttaatatatcttaccacagggccacccaaaattcaaaattactcctgattttgtaagcttcacatatgtttttgagaatgaggttttatactaatctgggattacagctttctaggctgtgatatacagtttttattaacatttcctattttaaaaatcaattttgctaattaaaacctttttattaagaatatatagaagttctgggaagcagagtgaggatattaacaaatcaccctcaatcctatcacccagagtctccgctgtggaacatggaagtatatctgctttgaagtccttgcaaatatgtttttacacatgcaattatattacacatactgtatgtaagctgcctttttctgtaacttgtatgtgtatggtgcatgacattctaaaatctaacaaccctgtagccatactgtggacatttagggctgctgttggtgtttgacgttgtaaataatactgcagcagatatctgtagtgaaatacttgtgctcttccatgttgatttccttcggataaaattctgggcatggagttgctaggcaggcgctagaaaatatcaccacgttgccctccaaaaagtgtatgcttactatttacactctaggggcaccgatcgcccaggacagtcctacttctcccaaaactttgtcaatattagacatttttaaaattctgtggtttgataggcaaaaaagttatttcatttttaacttgcatttcttcagggactagcaaagtcagacttttttggtgcactgactagccatttgtgttttttcttttgtacattactcttcagcgcgtgttcattttcctactgaagatgagccctttcttgattattgtcatttaggttgcagataacatccctaccgtgtgctgtgtgccttccagatgttagtgggtggttacagttcaacttttttgacatacaagtgtgttgaattttagcgttgtcgcccttgcacctggagcctctgtgtggccagttctgccttttggtggctactggcttctgttagttgtacattgccattactggtctcttgttaccatgtgtgccgcagaaggtgtagccaccaggagctctgtcagcatgaattccctaggaggtgtagacatccatctcggaaggctggtagaaaaattgtctctgtggaaaaattaagaagtgcccagctttccgacaaccctaactcatcgtagttcccatcttttgctctggttgacaggaaactcgtggtcctattggaagcacaaccataggacctctgtacattctcgtgtccggtctgctctttgcataagggtgcttgcccctgcttgtgcccttctgctttttgtttacatttgctctcactgtgatgtttttatgttcattttgatactcaagttgtgtgtttgttctcctgcgtgagacacttctaaacatttcatcatttagggtatacatagatcaaagtaagtggggaccacataaacatatgtagaaacacgttctgaacaccaaagagcttctcggtcaccagttaatattgtggttctttgttgttgttgttgttgttgttgttgttgttttttgagatggagtctcgctctgtcacccaggctggagtgcagtgccgcaatctcagctcactgcaacctctgcctcctgggttcagccagttctcctgccttagcctcccaagtagctgggattacaagcatgcgccaccacgcccagctaatttttttttgtatttttagtagagacagggtgtcaccatattggccaggctggtctcgaactcctgaccttgtgatccacctgccttggcctcccaaagtgctgggattacaggcgtgagccaccacacctggccaatattgttattacagtcactgttttatggaaaaacttagtgacctcatatcgttcttactgggcaagtgagcctaacacaatctgtttctatagtaattgtggaaatgtgacgttacagtggaagaggagagttgggacatggctgtggagtggagctggggctgtccacctctcacttagtatggaatcctctcctaggcccttcagctccagcacactggaagtctaaggggttttgtttgtctgtttgcccctatgttttaatcaccgctaggatcagaagaactgcagtctctgtgaacaggtcttcaggtgacatcagtgtgttacctccctggttagcaattagcattcccgaggtcgggtgctgtgctgcatgcaaagttgaatcaggcacagacagaaccttccttgaaggagtttgtcctctcttaatagtgaagataatatagaaattgtcctagccagtttacactcctaaaacaaattaccatagactaggaggcttaaacaacagacttttattgctcacagttcttctggaggctggtagtccaacgtcaaggtgctggcctgtggattcctggttcacagatggcactttctacctgtgtcctcacatgagggagagcagagagaggaagcaagctccctcgcatatcttttctttttttgagacagggtctggttctgtcactccaggctagagtgcagtggtgcaatcacagctcactgcagcctcaaactcccaaactcctaggctcaagcaatcttcccacctcagcctcctgagtaactgggactttaggcatgtaccaccatgcctggctaattttgtttgtttttgtagagatggagtctcattatgttggccaggagggtctcaaactccgggcctcaagcagtcctcccaccttggcctcccaaagtgctgggattacacgcttcagccacaatgctatccttgagtgcttcttatgagggtactcatccattcctgagggcttcaccctcctgactgcatcaccttccaaaggctccacctcttcatcctatcccattggggttaggatttcaacttatggatttgggaggcagggcacaggcatttagactgcaacataaatgtgaatggctgaggagcatgggattcagaaggcccgagcacatcaggctgcctgctttgctttctgctcctttcttctctcttccctcctcccttcctttgtttctttgttccttctttcctgttgactcagtgagcttttgctgcaatctgctttgtgccaggcattgtgttggacctggaatacagaggtagatgaggcaggggtgagcacagtcgtttcagctaggaggagagatactaaatgaaaataccacagaatggtgaagtgcagtctaggaatcaacaggtagagattcagtactgtgcaagttcagagaagaaaggcatatctgtgtcaatgggtccaggaaatgtttcatggaggaggttgcttttttttttttttttttttttttttgagatgaagtcttgctctgttgccagtctggagtgcagtggcatgatatcagctcactgcaacctctgcctcctgggttcaagtgattctcctgccttagcctcctgagtagctgggactacaggcgcccaccaccatgcccagctaatttttctatttttagtagagacagggtttcaccatgttgggcaggatggtcttgatctcctgacctcgtgatctgcccccctcagcctcccaaactgctgggattacaggcgtgaaccaccgcacccggccccgcatttcactggatcttcagaacaggaatggcttccttggggagggtcccaaaaagtgcgaatcaaaacagagatttgggaaccaccaggcatgcataggtagggcagggcatctcaactcactgcaacccatcagagagtacatctcaacccactacagctcatcagacagtacatcttaactcactacaactcatcagactgacatctcaaatcactacagctcatcacagagtacaactcaactcagtacaactcatcagacagacatctcaaatcactacagctcatcagacagacaaatcactacagctcatcagacagacatctcaactcactataactcagacatctcaaatcactacaactcatcagacatctcaactcactataactcagacagacatctcaactcactacaactcatcagacatctcaacttcactacggttcatcagacagacatctcaaatcactacaactcatcagacatctcaactcgctacaactcatcagacagacatctcaaatcactacagctcctcagacagtatatctcaactcaccacaactcatcagacagacatctcagctcactacaactcatcagacagtacctctcaagtcactgagttttatggtctgtgactgataccccgatagagttgtggaggtgaaaagaatacaggtgaaagtgtttggtaatatgaacacctcctagatccatcctagatgtctagaaattcacatacacatttgtggctcagaagagcatgtaggtgtagggaacaaggtgtaaggtaaactcaaattcatacattgcttgttacctctgcccagaccttagtagctttaagcttttgtcaataatagatcatacctaataaatattacacaacccagatgcttctaaaactattattgaggtaaatgaaaatgtctgccacagtaagatagtatttatcacagagattcagatatgattttttttctcttttaacctaaagaaatatagtaataacaaaaaagtcagctaatatgctataagcaattgttgggaatcttggcatgaaatccagttagggtactgattgtgcccatatcagatttttagaagcagataacctgatgtgtttatgagttttatttctggtctgctttctcctcaaaatttcctgtgtatacattgaaaacaaaaagccagccacagatcacttgatcattatagcataaagagtagaataattgtgttagttaccttgctgcataacaaatcgtccaccaatttggtggcttgaacaccactaaacatttattatctcatacactttctgagggttagggaggagattagctgggttattgtggctcagcatctcctgagattgcagtcaacacgtgggccaggacagccgtcttccaaaggcttgcttggagctagaggatccgcttccaagagggcacccatatgtctgttggcaggaggcctcagttcctccccacatggatctccgtatagggctgcttgagtgtcctcacaacatggttgttggcttccccgctgtgagttatcctcgggagagaggaaggaggaagttgcaatgcctgtgtgatctggtctcagaagtcacacatcggcacttctgccatacatttttaaaccaatttattgaggtataattgacatataaaaggctgtacatatttaatgtatacaacttgatgaatttggagataagtatctataagcctgtgaaatcatcaccacaatcagtgccttaaacggatccatcacctccaaaagttttctcccaccctgtcaaccctctttttttttgttgtcattgataagatctacccccttagcaaatttgtaaatgtacaatacagaattattaactacagacgctgcgctgtgcagtaggtctctgggtaattcatcttgcgtaattgaaactttgtgccctctcaccaatacctccctgtttccccttcccccatcccctaacaaccaccattcattctatttgaaagtttaaaattcttcacgtaagtgggaccatgtagcacttgtctttctgtgcctggcttgtctcacttagcataatgtcctgtaggctcatccatgttgtcacaaatggcaagatttccctcctttttaagtcttttctattcctctatatgcacgcatcacattttctttattcactcatctgtcaatgtctgcttaggtggcttccatgccttggcattcacaatataaatagttcacacaagtgaactattcacaatagttcatgtcgtagtaaacatgtgagttctgccatattttgcttgttcaaaaggagtcagagtccggcctacttctaacaagctccacttgtttgaaggaaggagtttcaaaggaattgttggaacttctttgtttgtttgttttttagaaatgagttctctgtctgttgcccaggctggcatgcagtgacatagtcatggctcagtgcatcgttgaattcctggattcaagtgatcctcctgcctcagctttccaagtagctgggactacaggtgcatgccaccatacttggataatttttttaaaaacttttctttcggtaccagatcttgctatgttgcccaggctggtctcaaactcctggcctcaagtgaccctcctgcctaggcaacccaagttgctgggactccaggcatgagccactgtgcctggctgattttgataactttatacacctcgtaatcaaaacagtaagttccagaaagctcctttgtactctttccaatgaaaccctgccccacaaccatccctccctgatgtgtgaccctagtgagtgttgcctcttcttgagcttcatgtaaactggaccctacttgtgcgttctttggcggttgacccttcattcagggtcgtgcccctgggacccattctcactgctgtgtctcggtagtttttctaaattactggctagtgttcccttctgtgaatacagcaccactggttgatccactcaccagtaggtgggcagtgtttggccaacatgaatgagggcttgtgttgtttctcttgggtgagagagttgtttctctgggagcggtggactggctgggtcgcagggcaggtgtgtgagagtctccttcctcacacagtttcactaggactcagaagccatggtcttttctctcctgtgaagggcttgagactttctggaattgagttcatgtagctgtcctcagcttttgatgagggacgtgtgtgtgttccaataacacttcgtttacaaaaccaggaggcagtggagagttggcccttggtttctagtttgcaaactcctggtctagaaggtaagacaaatattaatttttaaaacccgcgtgtctgtaattgctcattttgaaagcactgtgaagggaacactaagggagaggggatgggaagactttttacatgtgtgtggggagtctgatgaatttgtaaaacctatgattttataacttttctggcctctttttagttgctactgtgagcagtagtccatatgtgaaccagagtggacctccacaagctgccttttgaagttgttacagttagcagagacgaactggcccagggttcaagaagcctttctggctggaggaatgtggatcagtccctccaggcctggaagagggcagtggggggcggggggtgcactcaatcttaccattttcacagatgagagtaatttcatttcagaggggtatgccaaggcagcgatgaaaacttcaggaatagctttgaatatctaaaggaagtgggtaagaaagtgggaggttgggagttccggagggagagttcctgtaaagcagagattcccagggctggctcaacatccacattgcctggagggctttccctgaaacacaggcttgcaggcatgccagcccttgctatttcccacctctgcccaggcctggccctcatcaaggcgggagagcccagctcccagggctcacgctctggaaccaagaatgtggctctccaggcacagagacaatagaggcctggaacagatcctcaaaatgtgtgtgctgaagacatactcagggtccgatacttgagggccatctcacattatcatctccaaatctaggcaggttctgttattgggcattaacccctcgagaaatcagtgcctgtaactatgatttggatcatctgtgctttggatttctcttttaatcttctctgtctcctcccattcttaaccacaagtgatttatcagcctctctaattcaacttcattactctttgccatccaagtccctgcaagcacaaataaaacccaaaggaagcagcagacctttttatccatctgtgaagacactcaagaaacactaaattcatctgactttctagagtaattgctttccccacatggcactagaatcctggcatacagggagcagcttcagcagagacacggcagtagagaaatgactgactgaaggatggttcagggctgttgtcctccctgaaggtggttccaacaggacacaaaagttgcagcagagcctgtgagaacagctgtgtcctttgtcgtcactagctggtctgtctgttcattgggcaatttcagtttttatgactgaaagctgggcatgcaaaggacaaccaaacagcctctagcctgctgatgctcacagtctggaaagtcctatggtaaatcaatatttcttttttgcttttcagagacagtctcactctgttacccaggcaagagtgcagtggcatgatcatcgctcactgcagcctccaactcctgggctcaagcaatcctcccgcttcagcctcctgagtagctgggactaaaggtgcccaccaccatgcctggctggtttttcaattttttgtagagacagggtcttgctatgttgcccaggctggtctctaactccttgcctcgggcagtcctcctgccttggcctccctaagtgttgggattgcaggcacggggcaccacatccaggcttttttcatttgtttttagagacagggtctccctctgtcacccaggctggagtgcagtggtgtgatcatggctcactgcaaccttgaactcccagggtcaagcaattctctcacctcagcctcctgagtagttgggactgcaggcatgcatcaccatacctggctaatttttaattttttttttatttttattttttgtagagactgggtcttgctatgttgttcagagtggtcttgaattcctcccacctcggcctcccacagcactgggattataggtgtgagccactgtgctcagcctggtaaattggtatgtctaaggagagtgtttggtgccattgttcccaggtgttcacactgtttaaaatgtttctaatacatctcagcattgataggttggttgcttggttggtttcttgcctcttttgggctccatcgccttccccactgtctcctttttccacctcatctggcctttgtggagtgctgtgttggcaaaagagctttccacctgtgcctccccaagggtgtgtgtctgtaagagctgcccagggcctgggaaggacagtggagacaccaggtactcgttcgggagacttgtgctcaaaatgacatgggtgtgccggctcttagctgcctgacccgcattctgaggcctggtggcgccgtgcttcttcagcgtgtgaacacctgcctggcagcgtctgatacacctcaccaggctgaagggcagaccagctacctgtgattcctgataaaaattctgtgctttacagaatcccttctatttatgcccacaaccaatggaggagtgctttctagatgataacctcaaactgtcagtgttgagcttgagttgatgtttgagttactgagcgttccacgttccatgctcatggaaacctggctctgtttggaagcagcaatgctgggccctaccccagttgtcccatgagataattgtgctctgtgcacacagttccggtcccagaccctggctttgtagcatacattttcaaggaggactcttgggccaccacagatactgccctatccattgctatttttgatggtatgcttgtgtataatacgtttgtatatggcataagttagcagaatatgtaaatgaaaggaggaaacacctcaatgtcattatccacgggaagtgtgttcactctgtctcttcattgtaaaaatgaggcagtgccgttgcccagagctctcttggcaccttttatacccctcaccggctggcttggtcggctgcaggggtgcccttcccatctcattggctgggtgtgttgcatggtgttatgctttgggaagaaggttgtatggtgctggtgtcacagaggcctgtgtccaggtctgccccatcacagactgaccctttggtcttaggtgctcagcaggtgcctggctcataggaagcccacgcaactccatctcccacaccagggcctttatctgctgctagctcaccgccatcctatgcgatgtggcctgtgatcagcttgtacaggagaggcagctttctggggtgtagttgcctgcctgacgtcacatagctggcacgtgatggatcccgattggatgtgtctgcccggggaaacctcaagtcacaggcagctagcacagctcaagcgtccctaatcagaaggtctgaaatcttaaatgcttcaaagttcaaaactttttgagcaccaacatgatgccataaaggaaaaattccacagctgatctcgtgggatgtgtcgcagtgagaatgcaggtagagactgggcaagctgctgctgtttgctgttgctggcgcctcacagctgaggcgggtgttctggtgccattgccgtgctgcttacttaccctggacacattcctctctcactgtattgatggtatatcgtgcttttcactgttgagtgcttatatatcagtataggaaaattattgcttgttggcagcatataaattcagagtccggaatgacggagatgccagacaactacagattgtgcacatgggtggcagagagactgacacttttgctttatgatggttcggtggatacaaactttgtttcgtgcacaaaattattaagcatattgtataaaattaccttcaggctatctatataaagtgtatatgaagcaaaatgagtgtcaggtttagacttgagtcccacccccgagatgtctcattatgtatgtgtaaatattccaaaatccaaaaacgtctgaaatccaaaacacttctggtcccaagcatttcggaagagagatgtttaacccgtactttagaaagcactcaggcgctggagttcatcgcgggcagcatttcagcagcacctgtgttgtgtgtctgcaaatcagaatgcatccctatcccatcattgacaccaaaagtagttatgatgcctgtggcagtggctcatgcctgtactcccagcactttgggaggccaaggcaaaaggatcacttgagcccaggagtttgaggccagcatgggcaacatggtgaaccccatctctacaaaataatttaaaaactagccaggccatagtggcatacacctgtggtcccagctagtcaggagactaaggcaggagggtcacttgagcctgggaggtcgagactacagtgacccgtgatcacgctgctgcactccagcctgggcaaaacagcaagaccctatctctgtctccaaaaaaaaaaaaaaaaaaaaaaaaaaaaaaaaagtaggtgaggaggaccctgtggtgtgtgttccttaagtcatctgcaagattcagaaattttcccatcctccttgctaaagataattgttaaccctattcagaaaacagtggtggattattgattacagagcagttcaaaactgtttagttgtgttgggaacattcacacacaaggtcctttcacggagaacttaaccatggtgtcttgaaaaaatgcagcttctcaccttttaaaattccgcacaaaaaaagtgaaagtgattgaaagcaacaggtgcatttacattgtgttcaagtgagggcataacatgatgcatgtaataaatatttgcttgcaaggccctgaaggaaatagcccagatccctgccctctgtagaggtgctttcagcccagggaggagcgtggaggcaggtgagcaatgggatgatttgagagagtccccttgctggggcgtgacctggaggtggggtgatgtcagggcaggactgggggagctgagggctgtgtggaggcaggggcagtgcaaggagaccttgcattcagacatggggctggctgtctcgtcgtggaagcaaaaatagagtaatgccagcaggatctctagagtgtttgtttttttcctaacagtggtttcggtcctgtcatagcatgctgggtgactgagtacactaatggtggcccttcctgcaggtttgtccccttcatataagttctgtttggctttgaggtgctgttttagagcttcatgctctgtctccttcagtggcggccagcccagggagaatggcagggccgtgggctccatgtagcagatctctgaagccactgctgcttggagcctgccggccctctcccctctgggaactgtgcaagcagctgtctccttgggaacgtggcattagcatgttttgcatgagaatgaacaccaaccaaggctgaatatcaattggatcctagagtgcagctgcctttgaaatgttcctttgtgtggccgaacttcctgctgcagttgattcctggagcttgtgcgaagacacaaagtcttaagtcatcttagtgccttgcttactctatctctggatcttgctgtcaccatttattttatccttagaagtatggcaaagagaaatgcatacatatatgcagagacacatgtctacacacaggcacaacagagacacacgtacctacacatgcacacaacatatacaacccgggcacacactcacaacatgcatctccacacagacacaacacaggcacacatacccacacacgcatacaacgcacaacacaggcacacacatacaacacacatggacacagagacatgcatctacacacatacacaacccaggcgtacacatacaacatacatctacacacagacacatgtgtacattcagacacaacccagactcctacatctacacatgcaaacaaccagacatacacatacaacgtacatctatgcagagatatacatctacacacatacacagcgcaggcacacacacagtgtacatatagacagacagacatttatacacatacaacatgcatctacacacacaaaacatagacacagacaacatctacacatagatctgtacacatacacaccagatgcatacaacatatagacatgcacgtaacacatagacatgcatctgtgcgcaagcacaacatggaccactcacacacacaacctgcagagctgcctcttggaaccagttagaaacaaaagttggaatatgaccccagcaagtccccaatccccatttttggtccttttcttcgtttgtgttgttgaccctgatggcccagattcttatcaactgcgacaataaaaaccaattagtgattttatagtttgactttgcaaggtgggggtggggggcaaacttggtccagacattgctgtgctgctgcaggtctgaatgaagtgcagtgttgggctggagcgcgccccgtgctgcacttctggcgtgggaagtgacgatgcagcacacaccactcccctgagaacagagcacccagctcctgtagtttggccctctaggaagatgggaaggagcctgtgggcaccttctgattaggagagaagccaggagccagcctgccgtccactttctcagtgggtctcttgctccatgtcattgttcacttctcacagggcctttgctccctgcaggtgagttctctttcgtttatgggtggatctcggagcacttctgcagaaggcactttgcaaatagagttcctttttaatcagtgggtgaccaaaggcacttggattttagcaataaattataggtcatttaattatctgtttctgtgatgtggtgatgtgatatggtttggctgtgtccccacccaaatctcaacttgaattgtatttctgagaattcccacgtgttgtgggagggacccagggggaagtaattgaatcatggggcctggtctttcccctgctattcttgtgatagcaaataagtctcacaagacctgatgggtttatcaggggtttccgcttttgcttcctccgttttctcttgccactgccatgtaagaagtgcctttcacctcccgccatgattctgaggcctccccagccatgtggaactctaagtccaattaaacgtcactttgttcccagtttcaggtatgtctttatcagcagcgtgaaaacgaactaatacctggcgcttttaaataacaggtaccaggtgctttcaagtgggtctatgggtgatagatttcaggagttttcaaagggaaaaaaagtgcaagtgtacctcaactctttggcatgaaatgaattattgaacgctgaaatattgaggctgggcgcagtgactcacacctgtaatcccagcacttgggaggccaaggcaggtggatcccttgagtccaggagtttgagaccagcctgggcaacatggtgaaaccctatctctacaaaaatacaaaaattagctgggtgtggtggtgcacacctgtggtcccagctgctagggaggttgaggtgggaggatcatctgccaaggaagtggaggctgcagtgagcccagattgtgcactccagcctggacaacagagtaagaccctgtctcaaaaaaaaaaaaagaaaagaaagaaagaaagaaagaaagaaatatggaaatgaaatggaatattgaattctgaaccattgaatattgaaatgcaatgtgggggagacatctgacctgtgagagcgcttctcagaatgcaaatcagtttggcagtattttaatgtcattctgtgttttataaccagacaaatgtattgttctctaacccatgcatagctgtgttcaagttttgttttgttttgttttgtttttttgagacggagtcttgctttgtcacccaggctggagtgcagtggtatgatctcagctcactgcaacctccacctcccaggttcaagcaattctcgtgcctcagccttccgagtagctgggattacaggtacacgccaccatgcccggctaatttttgcatttttagtagagatggggcttcaccatgttggccaggctggtctcgaactcctgacctcaagtgatccacccgcctcggcctcccaaagtgctgggattacagatgtgagccactgtgcccagccattcaagttattttgataacacttcaagctaggagtttctgttagtgtctgtctgatgcacatgagaaatctgacttctttgagtggggttgctgttgtctgaagctgaggttgagctatttggttacagcttgttttctaagcctgtgctgtgtcttcagcctcctctaagctgagagcagaggaggctgccctcccaacactttgggaccagacctcccaacactttgggaggccgaggcaggtggatcgcttgaggacaggagttcaagaccagcctgaccaacatggtgaaaccccatctctactaaaaatacgaaaattagccgggcgtggtggcgcatgcctgtagatctagctactccgcaggcaggcaagaggatcacttgaacccaggagtttgagaccagcctgggcagcacagtgagaccccatctctactaaaattttaaaagttagccaggcatggtggtgggcacctatagtctcagctacttgggaagctgaggtggtaggattgcttgagtccaggagttcgaggctgcagcatgctatgatcacactgtactccagcctgggtgacaaagcgagaccccaactctttaaaagagcctttgttggtcttaattttcataatacaatactgattttcaaggttttattaaagaattgatttgcagctcatcttagaaaggtttacccctttgtatatggcaatttcccataagccacataaaaatactgtgacttgaagtaaatatttctgaatctagctgtatgtgagcatttccacaaacattaatgttgtttctaaagtttttgttcatttattcctgcaaaaacaaatgcaatttgtgtgtgtatgtgtgtctgtgtgtgatgtgtgcgcctgtgtcttgaatgcttcatgttcccttgtgggacatgccagtcgacagcctcatgttgtctgaggtgcgtcacgactccccaccttgcatgaggagttgcggtggcgacaggtgtgggaaagtgcatatggatttaactcctgaaagtggcttaaggggattgtgaagatccaggtccagtcccttgtggtgggaaggtattattggaatcgttgattaatttgtacttgttcttcctctagacaagcagatgcccagtgtcgggaaggcagcccaggatcacagcagcacccaccgagtcagaaggcaccgaacccacccacattctctgaactatctcactgccggggagccccagagctgccccgggagggccggggccgagcgggaaccctacctcgagattatagatactcggaggagagcaccccagcagacttgggaccccgagcccagagccctggctcacccctgcatgctcgaggacaagactcgtggccagtgagctcagccctgctctccaagaggccagccccacagaggccaccgccacccaagcgcgagcccaggagatacagggccacagacggcgcacctgctgacgcccccgtgggcgtcctcggcaggcccttcccaacgccatcccctgcgtccctggatgtgtatgtggcccgcctgtccctctcccacagcccctctgtgttcagcagtgcccagccccaggacaccccgaaggccactgtctgtgagcgtggaagccagcatgtgagcggggacgcatcacgtcctctgccagaagcactgctccctcccaagcagcagcacctgcgcctgcagacggccaccatggagacctcgcgctccccctcgccccagttcgccccccagaaactgacggacaaacctcccctgctcatccaggatgaggattcaaccaggtactgtcctgcgacggtgttccctccccatgaggctcctaatgtgggacgcgggttctcagtgggtctttctggggagtcacctgggcaccttgctttagctcaaggcgttggacttaaagtcagtactggggaataactgtgtggacagaaagtgaagcttcagtggtggttggatttttatctcactggggggctgctgtttcctgcagggaacaggggtagatgtgaataggtgatacatcttccccttcctccaagccagatgcatttatatctgcattacccacaggcatctgcagggtagaggtctgtttttttttgtcgttgttgttgttttaatgcagtcaatatttgtgattggaatcgagtttaacctaagcatgcgacctttaggtgaaattggtatttttcatggtgtccagtattttcttactcctttttttccagatttttttttaatgttagaaagctaagctggtatataccttttgttaaagcagaagaatactcattcacatttcatggtgctatcatcaggatttcaggcatggaattattgcgtccattgagatgctgatgaatgttaggcaggaacttgacctttcaagagcactaggcccagcatggtggctcacgcctgtaatcccagcacgtcgagagttcaaggcaggtggatcgcttgagctgaaggagttcgaggctagcccaggcaacatggcaaaaccttgtctctactaaaactacaaaaaattagccaggtgtggtggtgcatgcctatagtcccagcttcccagggaggaggctgaagtgggaggatcacctgagcctggaggtcgaggctgcagtaagccaggatggcaccactgcactccagcctgggtgacagagtgagaccctgtgcaaaaaagagcaccggctgtttagctttcttcacacacaaataccacctccttgagtgccttgaaggactgagaaatggaagaaggggagaatttctgtctcattctctggagcagtggctctcaacctaggaggtggagtgtgattttggcccccaggggacattaggcaatgtctggagacagtttttgttgtcctaagtgcgatgggagtggggggtgctctctgcatctagtggtggagcccagggaggccactcagggtctgcagtgtgtgggcggcccccacagagcattgtccgaccgcagatgccagctgctcttaggctgggaaccctgctgtagagccgcacgcccagcacaggacccaccatcacctgtgctgtgtaaatgtggggcaaagaaaaccaagtcgatgaatgcaggtcctcagtcacaccaggtgtggcgggtggctgccgtcctggacaggacagataacaggtattcccatcgccgcagaaaattctgtgggacctcactgctctagagtctcaagtaattttttttcttagcttctaaataactcagcagagaaagaacatgactgatactgatcctgtatctccagccgaggcattgtaaccacagttttctctgtgggccaaaactgggctttgcatcatttaaaatgtatctaaagatcattcagatatcccttgaattggtaacattgtaaggttctgaaaggaaagtgtcttactcctttcaggctgctataataagatctcatagactgcacggctcattaacaggagaaatgtgtgagttgatgagggctggtcgctggaaggtccgacccactgtgttctgtccttattttgaagtcaaggctcgtgaaactgttctcatgtggaagtcaagactgtttttaagaagagagaccatttctgttaaaaaatgatcaggaatagatgctttgttggaaagtgtatgtgaacccgtgggagataggagatttgttttttttccttcccggtactgtattttatattattatcattattattccctgtcgcccaggctggagtgcagtggtgcgatcttgacttttgggttcaagtgattctgctgcctcagcctcccgagtagctgggattacaggcacctgccaccacaccaggctgatttttgtatttttagtagagacggggtttcaccatgttggccaggctggtctcaaactcctgacctcaggtgatctgtctgcttcagcctcccaaagagctgggattacaggggcaagccactgggcccagcctctttcccaatattttaaaacctgtgaagggagatttgtttatgttgtttaatttgtttctattgtgcacatcaaatttctgcacaaaagggggaggataccaatacaggctgatgtgaaagtcagtaataggcaagcagagcttctcccgggagccgggggggcgggggtgaagggagtgcagagggttctgcgtttgctggtgcttggataaggtggccaggttttcctccttcttttattattattattattattattatttattattattatgtttttaacagagaggtggggaggtctcactgtgttacctaggctggtctcaaactcctgggcgcaagcagtcctcccaccttagcctcccacagtgctgggattccaggtgtgagccactgtgcctagccagggttttccttcataagtctgacctatctaaatggtattttccacagttagactttgtaaattgtcttcatgaggaagcagttgtgaggtgtctgtgagtccctagataaaacacatcagatgttgctgaaccctactggagagagggaggaaaatacgcagttagttcatctcagcctgagcaccactgccttgatagggaaagagccctcctgcattcccagtcaccagtgaaagagggaaaaacagcattaaatttagagcatcgtggctgccctcctgctgtggaaaattggatacatttgtgtaacatcgtaggggcagttttgggttgacttcattagaaacacatcctaatttggggttgtggagtttggcctgtttctttttgcttccctcctgaccaccagcatatggggctgcttctccagtgctctgaaaagctcttggctgagatggccctggtcagcatggtctagcacggtgccgctgagagcagcaggtgcagggctgccccagacaagggactgtggcattgctgggcctgttcctcctgttctctctcccccagtctcccagggatgctttaggtacctctctagtccctttcatccagaaacttttcttttttttttgagatggagtcttgctctgttgcccaggctagagtgcagtggtgtgatctcaggtcactgatctcagctcactgcaacttctgcttcccaggttcaagcgattctcatgcttcagcttcccgagtaggtgggattacaggtgcgcaccaccacacccggctaatttttgtatttttagtagagacagggtttctccatgttagccaggtgggtctcgaactcctgaccacaagtgatccacccgcctcggccttccaaagtgctgggattacaggcatgacccaccacatctggctgacacttttttaaaaaaaaagcaaaactgtgccctttggaagtaatacagaaccgatgactcgctgcttactgcgagatcgtatctcactggtgtgcaaatctgtgcaacgctagcttgaagcacagcgggcggggggtacaaggacagtgttgggtgggctgtcctgcatatggcacaggaggttctcccaagtggggtggtggggggctttggcctgactccaagcacggccactccggagaggagccctccccaggccctgagaactacgcaggaacccgcgggcctgcaccaacctaaggacggatgggaatcctggaaaatgcccatccactgcaggcttcccctacaaaagaacatttaacccaacagggcttgttgaagtttgcattatcatctgcggaatgacaaatggtattaaatagtcctcacagccctccacgaacccctggaggacaccttgggatgcctcaggggtggcattggcggtttgagcatagaaaggatgctgtggttggaaggcggaggtaggagtcagagggagcttcttgaggcctctgcctcatccaggatgtgggatcatggaggctccttcgagttgggtggctggctagtgcctttgagtcaggttcccatccagaggggagggcaggggacacgtcaatcagggtctgtggctggagcatgctttgcgatttcagcagactgttcatcttccagaattgagcgggtgatggacaacaacaccacggtgaagatggtgcccatcaagatcgtgcactcggagagccagccagagaaggagagccgccagagcctggcatgccccgccgagccacctgccctgccccacgggctggagaaagaccagatcaagacgctgagcacatctgagcagttctactcgcgcttctgtctgtacacgcggcagggtgctgagcccgaggccccacatagggcccagccggctgagccccagcccctgggcacccaggtgccccccgagaaagaccgctgcacctcccctccagggctcagctacatgaaggccaaagagaagactgtggaagacctgaagtcggaggagctggccagggagatcgtggggaaggataagtccctggccgacatcctggatcccagtgtgaagatcaaaaccactatggacttgatggaaggcatcttccccaaagacgagcacctcctggaagaagcccagcaacggaggaagctgctccccaaaatcccctctcctagaagcacagaggagaggtgagtaggcgtggcctcccagcttgggcgtgactctgcctggcatctcttaggcttgtaaagggaagggggtctgcctctctgttttcatgcgtgcttttggggaagacgggttttcataagggctcctcgatgcttagcactttttggcttttttgtgagcctccggaaagagaaatggagggttaacggctttgggcctgacatgaaaatacacactgcagaccaccaagctgccttggcctgaggccagcaggatttctgatgatgcccacaggtctcctttctcgtaagacagctgttctcagtgggggccgctgtctaccctgggggacagttggcaatgtcactgtggggaggggtgttccaagcatctggtgggtggagcccaggaacactgctcaacatctacagtgcacaggagggccccccccacagagagtcatccagcccccacgtgtccctagtgccaacatgagaatgaaggcttagattgaatatatatgtgtttctttatgaaatgtttttttaaaactttatttgaaatttttttacatctgcatttaaaaaatttattataatttggccaggcacagtggtgcacacctgtaatcccagcactttggctgaccgaggtaggcagatcatttaagcccatgaattcaataccagcctggacaacatggcaaaacccagtctctacaaaaagtacaaaaaattagccaggcgtggtggtagacacctgtagtcccagctactcgagaggctgaggtgggaggatcacttgagcccaggagttggaggctgcagtgagctatgatggtgccactgcactccagtgtgggtgacagagtaagaccccatctcttgaaatagaaatgaaaaaaaattacgacaatttacacctgcctgaacaaatgtattttaattggttttgtaagtagcactttcagcgtatctccttcagccacttgaccacaaaggcatgcgtggtggcatcttccctgctgctgacatatgttctgccagcacagcgtcattcatgggtaggaaggtggagtgggtatgacacacagccaaggaggagcagctggaccaagtggacccaggcaggagggcgccgacagggctgctgggaggaagggagaagggttggtgtttgtagatagcgtcacacatgtccttgtcctcatcaacccaggctcctggtagagatcatctgtgctctcacctctgtagcagagattcttagatattcctgcttatttgagtttttgccttttttaaaaactatgtttcatacacttacgagtatccatttgacagggttgatggtttttagttttaaccttgttacctacttacttttccccctttggctgtctcatctccctggctggtgtcctttcgtgagcaccagtgttgatttgtcacaacccagggggtggggcagaggggctgtttgcgtgcacagtcccagctcattgaagttcccacacctttacccaggaaagaggagcccagcgtgcctgcggccgtgtccctggccaccaattctacctactacagcacgtcggcccccaaggcggagctgctgatcaagatgaaggacctgcaggagcagcaggagcacgaagaggattcgggaagcgacttggaccacgacctgtcggtgaagaaggtaggagagtccattccaaatgacagcgtgtgcgtgtccaggcaggggcaggcatccggatcacaccatcctgccccagcgcagaccctgcaccacgtgtcccagggcgtttgtgttcagctttcactcaggacagtggaatttgaggtgatattagtgaagccctctgttgttagttctatgtcctaatcttgagccattccacaaacgtctctttgctgtttcaataggatccaatgtcaaattagtttagtcaccattctctttcattttatcttatttatttatttttgagacagggtcttgctctgtcgtgcaggcttgagtgcaatggtgcaatcatggcccaccgcagccttgacctcctggcctcaagcgatccccctgcctcagataaaggaaaattattttcaaattagaaagtggtaacttttttttgagatagagtctccctctgtcacccaggctggagtgcagtggcacactctcagctcactgcaacctctgcctcccgggttcaagcaattctcctacctcagcccctcgagtagctgggattacaggcacctgccaccaagccttgctaatttttgtatttttagtagagatggggtttcaccatgttggccaggccggtctcgaacctcaagtgatccacccaccgcagcctcccaaagtgctgggattacaggcgtgagccactgcttccgggctggaagatggtaactttttggttcaaggtattaaaaagggaaatgaaaattaagggtttaggtcttggggcttttacgggccctccatctggcacacggtaccattcgcttcattctggttgcacattcctcttttaaaaaataataaagaatccaaaacatgttcggtttttccacacagaaccaggaaaatcataccatctggaccatttgaatttgggtcacaccctaggtttagagaactgcattctttgctcgcatgcctttgtttttcatgatataatgaatttcagaagcggcatgccttgattctgccgccctcatctgtggggcactctgtccacctgctttgggaggctggagatgctgggaagccgcctcaccagaagtgtggctccggaactgagtgagtcactgtgggctggaagttggcctcactttagttcagcaagtgtgagttgggcacctgcaccagaagcacatgctgtacatcccagctctctatggtgctgatgactcagcggtcctgttttcctgcttgattggacaaagcggccactgctgcattacattttctccctgctttcccgcagccacacgcttatgatgtcgcacattcctgcaacgcgtgcacaggcggaggcgtgttcagggaggaagcgagcatagcgcagatggggacttagcaggccacctgctctgtagctgcttcaggggaacatatgagaccctaattccgtaggcttccaacattcccagggcgaccacagttgtctcagtcacagcattgctaggtggtcatagagctgagagccaaatcagggaaccctctgttttaggagaagactaaggacagagttgagagagtggaagccccaggcagggaggcagcagggggctctggtggctggtagagaagcatcacgcagagatgacaagatatggttttatacttggggcagctcagaaggactctgcccagaaaagagggcaccatgttgagttgaaccagatagctgattggtttaagtttagaatctttgagaattatggcttttccctggaaccaggaggtgagtgcagggcccagacagaatagaccttgtttcccctatagaagggaacaaaaggtggaggaagggaatgaatggcccagggctcattcttagtggagggatgagagtggctgtgtgcctggtctctactgttgcaggctcttacctgagcctcctggaaagccacgcactgcaagaaatagcagatgggcctgccagacagtatggaccacagtggtgagcccttcagcaccctgggtggtgtggacagccactgatctgttcactgtcccaggccaggtcttgtctcagaaatctttgaaagccaacggctgttctttatacaatggccctttaacaaaggggaaatggtttcaataaaaatttgcatatgacatgtaaaagaaccaataaagaaatctggactcctttcagagagcccagtttcaaattagctcagctgaggtaggttttgagggcacatgttcatgcaccagtataaaatctacatttccgtaattgctgaagaataatggcactgaaaatttcctgagcggccgggcgcggtggctcacgcttgtaatcccagcactttcggaggccgaggtgggcggatcacgaggtcagcagatcgaggccatcctggctaacatggtgaaaccccgtctctactaaaaatacaaaaaattagccaggcgtggtggcgggcgcctgtagtcccagctactcgggaggctgaggcaggagaatggcgtgaacctgggaggcggagcttgcagtgagctgagatagcgccactgcactccagcctgggtggcagagcagagactccgtctcaaaaaaaaaaaaaaaaaaaaaaaaattcctgagcagccctggcgggcgtccttccttatccacagttccctgcattgcttgcagtcttccttcaggctagcattggtatcaggaatttgggaagttcttcatgcctgtttcctgttttgtgcttttccctcaagtgatgactatctaaaatttggccacattctcagctgtgagattctcaacttaaacagtctctccagataggtagtgagtaggaaaaggcacaaaccacttttcctctgctctcacgccacagcaaccaacacagaagacttcggtgaccacatgtgtgaggggggtttcccacacacccagcgagcagtcacttctgcagcagacaccagctgggtggcctctgattcagttcagatgtgacactgtcaaattggaggtagcgtctcatcccacgggttgagggctcagtccccaagactgcaccccccacacacaccagtcgcaagtctgagtctcagggacttctgaccaaccaccttcaagttggggttcccatgaccccctctttagtttccattactttgctagagtggctcacagaactcagggaaacatttacatctatgataaagaatgttacaaaggatacacatgaagagatgtgtagggcgaggcatggggaaaggggtgcggaagagcttccatgccctccctgggtgctccaccctccaggaaccttcttgtcttcacctgtcaggaagtctccagccccgtcttcttgggccttttatggagccttcattggataggcctgatagaaatctgtgtagaaatgtgattggacaaaaagactacaatccagtcctaacagaccgaggagaaagccacaaggtctgcctgttgagattcttgttggcctctctgtgtagcgttccttccccctaggtgtgccgcaggacccttcaggaatatggggatcttaagacctgcattcattcaaggcggtggaggatttctttatggaaaggttggggaagattagatcttgctttgggcaggtaaaagtttaagaccagcctgggcaacatggagagaccccgtctctacaaaaataaaaaaattatctgggtgtggtggtgcatgcctatggtcctagctgcttaggaggctgaggtgggaggattggttgagcccaggaggtcactgctgcagtgagtggtgatcatgccactgcactccagcctgggcaacagagtgagaccctgtctcaaaaaataaaataaaataaaataaaataaatgcatccatgtgagggaaagacctcacgcaatcaggaaataggctgcctcgtatctggcacatgtttctcctgctgtggggttgacttttcctgcctaatgctcatccggctggtcattttacccatagattatggaatcagggcacgaccacttgaagccaggagtttgaggctgtagtgcactatgatcatgtctgtgagtagccactgcactgcaacttgggcaacatagcaagaccgcttctctaaacaagtagaaaaaaggtcatcatttagaaggctggtgggaaagggcatagagtgttagtgtctaatagttacgcagtttcagttggggaagatgacagagttctagagacggatggtggtgacaggtgcatcgcagcatgaatgtaccacacaccacagaactatgctctgaaaagtggtcaagatggcaagctttatgttacatatattttactacaattttgaaaacagtcatctgtttgcattttggtcaagttgaaatcagtaggttatagtaaaagactgttaagttcattcgtatccctttattggtcttaatttttatatgctagtattagcaattaaaattttttttctttttttttctctttagcaattaaaattttaattgctaggccaggcccggtggctcacacctgtaatcccagcactttgggaggccaaggcgggtggatcacctgaggtcaggagttcaagaccagcttggccaacatggtgaaaccccatctctactaaaaatacaaaaattagccaagtgtggtggtgcacgcctgtaatcccagctactcaggaggctgaggcacgagaattgcttgaacccgggaggccattgcactccagcctgggcaacagagcaagaccctgtctcaaaaataaaaattaaataaataaaaataattgctagtgacaataattatatgtacaggacacataactaatcacggaatttggtgctggacataagactcactactttctctctatgtgaatctttaaattagaaaattccaaaggacagaatacataggtctgtgactccttccaaagatatgggttgaaactgcatctaccatgacgagcatcggggccacaactccgacgttctctaatagggcatgaacagaacgagaacaggtttattttatttttaaatgccaatagtgccattaggagtcattcttctttcccttagtcgtataaatcccctattatttggtgatgcaaaagtgagctttcacgcaggtcagctgcacctttcacgtaggtgcgccaaggtggcagtgagcagtgtggccggggtgggggccggcctaaccagtgtctccgtgttcccttgccatcccgtgcccaacagcaggagctcatcgagagcatcagccgcaagctgcaggtgctccgggaggcccgcgagagcctgctggaggacgtgcaggccaacaccgtgctgggggccgaggtggaggccatcgtgaaaggcgtctgcaagcccagcgagtttgacaagttccggatgttcattggagacctggacaaagtggtgaacctcctgctgtcgctgtcaggccgcctggcccgggtggagaatgccctcaataatttggacgacggcgcttctcccggtgatcgggtaaatgcagatacgtctgacttggaaatggggggtggtctcgtgggaaggctgtttttcaagtgtcgtgaaagtcagctccttggagcctagcatagcttccacatggcctgtccacctcctcctgcagaccttgtcgagacagtgcacgctctataccctctccttccttttatatttctttagttgtttgtttgtttgtttgtttgtttgagacagggtctcattctgttgcccaggctggagtgcagtggtgcgatctcggctcactgcagcctctgcctcccgaggttcaagagattctcccacctcagcttcccgggtagctgagctcccaggtgcatgccaccatgcctggctaatttttgtatttttttggtagagatgggatttcactatgttggccaggctggtctggaactcctgagctcaagtgatccgcctacctcagcctcccaaagtgctgggattacaggtgtgagcaactgtgcctggcctccttccttttaattgaggggaaaaggtgcttatcagatgcagggagttgaaccgtcattggactgcagggttgcgggatcttctcaaagaactgttacctctttttaacatctttttagatattcctattgactcttactgataattgtctcttcttagaaaaatcatgttgttgttgtttttacttttcttttaccatgtataagtccgtaacagacatgcctgcctgctgacgatcgtaagtactcaatgatagctattttcttgtggtggttgtagctgtgatttaacaagagggcatgtatcagtctagaaggaagcagacagtgcatctaacttcaaggcgtttctcagtgggtctgtcttttcgtcctttcacatatgaaccaagagaaataatagctgcctcgttggcttttacctcataggccaaatatcagtaaaacagctagttttgtttgcacagaacaggccttcagaatgttcatctgtatcatgaataaaacatcttaacctctctcagaaggggagcagaagaagcacccttcccctttctccaggtgagggtgatttgggccacgcagaacgctgtcctggcgctgggcttggagacggtgcccttctgcactcagccgagtgcttagtaactgtgtcgtggaactagctaggtcagggtggcaccgtgcccgagggggctgctggccgacacccgtgcacagcactgcgtcttctccaccctcaggcttccttgtgtgcagatatgctctgcaggctcgggggcttctcctcctcctgccaggagcatttagtaagcctaccctgaattcctctcgagtccacccatgtggccagctgtcccacggtgttcccatggagcggaccttgacgccaagagggccccgcagtcctttgccctttgcagcatctcagaattctgtcgttgtgagtcccttggtgactcttctgctcaccattcgaggcaggtgggagagagtcaggctcagacagcaagaggaaacccagagaggcctgtgggcggcttctgggggcctcaggctggcccgctgcaaccatgagacacatgcccccaggccctgggccctgggtttgtctgtgtggaccccatcggatctctggtggcatcagggtttccatcgataagttgtgggaccagcccacaagttgccagtgtcttcaagggttggccagtgccccagctttcatcctggtcctcaacaggcttgtttgtctgtcaacagcaatcactgcttgagaagcagagagtcctgatccagcagcacgaggacgccaaggagctcaaggagaacctggaccgccgcgagcgcatcgtctttgacattttggccaactatctgagcgaggagagcctcgcggactatgagcacttcgtgaagatgaagtcggccctcatcatcgagcagcgggagctggaagataaaatccaccttggtgaagagcagctgaagtgcttattggacagccttcagcccgaaaggggcaaataagagaccagtccccggtggaggaggggcacggggcctccgagctccagctccgttcccaaggatactcgtgaagaccccatctgtgttcatggcctggaaagagacttctcccatagcaaagaggctgttataaaagcaataacttttgtgtttgtgtgggatgatttatttaattttttagtttcccctttgattgctgagagccattttcctttacacataactacacctgacaccaggctctgctggatgtgagtttccactgcatgggctgtgggctgggcctgtggtgcctgccgagtggtcactgtcagtgggaaacccgttgttcctcccgtcttcagatgctgagccaactgcttggacagcagccagcgcgtcatgacgtgcatgagagggggaccctggtgctcatcttctcttgtcattcatccaggcatgggctgccaggttttgtccctgctcgttcaacagtgtgagcatttgtctctgttatctaatgatgttctctgacccagcagaaatcatcatcatgatgatgataatttattaactttttggaagggtgaatagtttcctaatggttaaaaaccaactgtgaaaggaaccacctgtgtggttgggttcactcattctcagattaaattgccacttaaagaaataacgtgcatgctttaaaaaacacagtcacgcaccaagcaggcaaatagctttagtccttctcacctcacatcacagttgttctgcaaagtaaaattttttggttaagagcgtgtccagtagtaatgtgcttgttagctgtttctcaagaccaacagaagattttttcagttactttccccccatgtattttgtatgcatatgattgtccgtgataattggctacttttccattgtttcctccttaaatcgtttagcatggcatgagggccacattccatggacgggaagaccccttcctcttcagaggtcccgtggactacacagctcctgagcttgatctttttctgccatgaagtttaaagattctatgcccatttccttgattgaaatggcaggattctaaagagagcctggtttgttaaaagaaaacactgtcatgctgtcagttcccaattgacaagtcacagactgggagaaaatatttgcaaatcgtgtatctgacaaaaggtttgtgtccaggatgtacaaagaactctcaaaccggatagtaagaaaacaaacagcccaagtgaaaagcaggcaaaagacttgaatagacacttcaccaaagagcatacacgcgtggcaaacaagcacacgaaaagacgttcagccgccgatggcttggttataatttataacttacttatttttatctaataattgtagattcagtgtatttcttcaaaaaatgtttaattaaatgcatgttaatggtgagtgaatcccttgggtgacttcgtgtttaggtcgtattagggcatttgttggatcaacggatcattttaaccctgacttccccttattcccataaaagaagttttccagtggaatggagatttcattttgtcagcagcagtgaccacagccttaccaaagcagacgcgtgcgcgtgcacagatgcacacacacagatgtcttaaaagactagaatccacacttcctgagccagaggggccgtgttgacggtaatgcattctctatagagccaagtccaaactggcaagctcaatgatgcaggcaataaaccgcctttttggcagcctaccaatgccaaaaggataaatgtctttccaaaagtgtgtattcctgttaaattaagctcttgctaacttgaaaaatccctgttctgccagcgaagcttcctcctcctctccagctggtagtcacttgcgtgaatgctggtcagtctgaaaaggtgaagctggctgtgcacttacccccatctttctccctcggggagacgacccaaggaatttcagagtattttgtttggcagagcttttacctgttattctttgccctcaaatacagtattgtggtcattttgatgatatgtgtgtaaaatgtgaataatccaattggtgtctgtactcagccttttgatgtctttttaggactttctcttctacacagcaatacgtcgtgctcgagtatccttgtagcaaagcacatagagccagctgtcctgtcagttcccctgtttgcctctgaaacgtctggttagtggggacccaaagattctagtgagtcaacatccataactctgtatctagttgtattattcatagaaaatcaatctggtgctaatggttggccctggtgttgttgggtggcagctgctccttcgccctcttgtagtgtggctgtggagggctctgcctatggggggtggcctgtggcttgtatccttcagtccaccacagcaaatgtgtgtagatttcatgctcgacacttaccactcacctatcaacagatcatcctgcttgactgtaacaaaataaatagtgtctcttc

SEQ ID NO: 2969 - DNA, 34025 bp, human
tttgtagttcccagtggctcttttgttctgctatcttgaagggcaggttgcttgtcagctcacaatgctgtgggtaaggtctggtgaggtcggcgaatgtgttctcattgtttattcttctgcctgaagatgagaaataatgcaaatcagggtgcagattccggctcgagctccacaggcgtgcacgtatgtgtaagggcatgctcgccggtgctgcatgtcctcgtggatgcatgcaatttttacagctttgggattcacggttagctgaaagcacattggaactggaaggcggtgctcttaacaccgtgttctaggctggaagccgtagagccatcatctgctctgatgggactgcagcccttggtatgtgggacccttgctccatgtgagttctgcagatgggttccccgagggagctggctggaggacgccagcatcgcatgaagacctgcctgcctcgtttgccttttgtttttcagtagcagtaagaaacaggcattctcactacacaggcattgaatgcggacattgagaaaaaatggtgagtcagctacatcctcaagaaaaaaaagcggcgaaatcaggtgtgcatgtttagtcatgagaaatgttccctgagtgcgtttgcacatagcctgctgattgcagtgagataatttaaatagagaaaatggaatcaccatggttcttagcattttccagttcttttattttgctctttggtgtgattgtgacagtttaagggttttactatacatgtgctttttcccccattttatgttgtgataaaagaaagagatgattagttttggctatatttctaaatggttggaatgcctttgctttactaaaggaggcttttgtgtgtgcagagggtcgatggcattttcacagggaaattgatgcataaatatgtttgcacacacaggctgtctctttggtctgcatttactgactcacaagagtaggtgtcattttgaaatgcatgtttttagcggttgtgctagttgaaaggtaaaaaggcaaaggagtttgaagaaaggtttttggaaatctacctggtagcacttacgagtaaacagcctactgcctcgtagatggtcttaagatttataagatgaatggaaaataatattttaatgtatcatataaaaaaactgaagatttggtaccaagttgatgaatggttggcatatttcttttcattacggaatagaacctttgaggtcatactctacaagtatttcttattattttattgcggaaaagcattgcatgggtggtagaggcacatttctttcttttgtcacacatagtggcaaaaacattttatactttgtccctttctgtttctccgcctccacctgcgcccacccccctgcccccccgcccctcccgccccgatcaccaccaacccaaaccaacaccatacctcttaaggaaaaaaattgcaggggaattctcatctacagaggcatgaacaacacacacagagttttttacagagtgctaggaataaccatacacgttggtgtcaagcatataggctgcggaaggctctattgcccagccagagggacaaatgaccctggtgaatgcacgctgactgctgcttgttttgcatgggctggctgctcttccagagtccgcctttggattttggaggttgaggaaggaagggaatattttatgtggcctttggaatacatttactttacactacctttaattttttacctctcatatgcattaaatttttaagaagaccagggtaggggagcagtgggaagaagctgatgtcttgtatccacccatctttcccctgtcctcgggcactgatttccagctggcttttcctagagcaagtaagacagtcgggtcatttctggaaggcttgtagacatccttggatgtctgaagaggtcctagagttatttacttatttacctttaaaacatatttgccgacaccttatttaaaattcctgaaagttcacagtgcctcttcatatgtataccttgggtcctactatgcggttaccatcttgattttataataaagcaaactgggggcggggtgactagattctcacaaccagttagtgaagagccctcgtggggcagcatggctgattttcagtctggtgggctcctgcggactaatgggtcgaggtcctccaggtaaggctgaatgtagaactggcccaagaattcctagttattctcttagtaactttcacatcccttatccagtttgctgccagtgcagtgagaaggaatttcagtttggacttctgggagtgaagtacagaaacccgttaatcaggcagagacagcatgtgtgctcctcagcctgcgttggtgtggcttgcgaagccacctaagcattctgaccctccatttcttcatccataaaacaaggaacacagattaaattatttcttatttaaaaattatttattttttatgtttaccattaccttgatcttgaagtttaaattatttcccaggtcccttccagctgtagtcatttttggttcttagggagagaagccagggactcaaatttcccttcagtcatatttccagctctgtggggtgatttgtggctgcactgttttgctcatttgccgtcattatttccaggaacaaaagcatatgaatatatatgagacacacgcacaggggtaatagcttcgatatccatttacaaataaaatcagctctgtcagcaaactcaattttctgtcaacagggctttgttgatgggaatgcccttgacagctaagcctacttcggtcttcttgtggtaatgcctcataaagccactcactgccaaggtgctcttgggtataacttgcatgaaatttgttataaaattattccgttaaaaaaatctagctggcggacccttaaatgtacttggaggccattaagggtggaaaagctagaaattctaggaaaattttcaacatttatacacgtgtgtgtgtatacacatatacatgcccatacacatatgtgtactacacacattttctatagtaattatgcatataaagttaatgtcatgtacaacaaatatctgaagtctattggataaacaatccatttccgattctggttcagctgagttagaagataggcaggcaatgatctgagatggaaggtttccacagtttggggtcacgtgcaattgtgatagaaggaagattgagattttctcttaatttatgaagctgatatgctattctaactagtttttaatatatcttaccacagggccacccaaaattcaaaattactcctgattttgtaagcttcacatatgtttttgagaatgaggttttatactaatctgggattacagctttctaggctgtgatatacagtttttattaacatttcctattttaaaaatcaattttgctaattaaaacctttttattaagaatatatagaagttctgggaagcagagtgaggatattaacaaatcaccctcaatcctatcacccagagtctccgctgtggaacatggaagtatatctgctttgaagtccttgcaaatatgtttttacacatgcaattatattacacatactgtatgtaagctgcctttttctgtaacttgtatgtgtatggtgcatgacattctaaaatctaacaaccctgtagccatactgtggacatttagggctgctgttggtgtttgacgttgtaaataatactgcagcagatatctgtagtgaaatacttgtgctcttccatgttgatttccttcggataaaattctgggcatggagttgctaggcaggcgctagaaaatatcaccacgttgccctccaaaaagtgtatgcttactatttacactctaggggcaccgatcgcccaggacagtcctacttctcccaaaactttgtcaatattagacatttttaaaattctgtggtttgataggcaaaaaagttatttcatttttaacttgcatttcttcagggactagcaaagtcagacttttttggtgcactgactagccatttgtgttttttcttttgtacattactcttcagcgcgtgttcattttcctactgaagatgagccctttcttgattattgtcatttaggttgcagataacatccctaccgtgtgctgtgtgccttccagatgttagtgggtggttacagttcaacttttttgacatacaagtgtgttgaattttagcgttgtcgcccttgcacctggagcctctgtgtggccagttctgccttttggtggctactggcttctgttagttgtacattgccattactggtctcttgttaccatgtgtgccgcagaaggtgtagccaccaggagctctgtcagcatgaattccctaggaggtgtagacatccatctcggaaggctggtagaaaaattgtctctgtggaaaaattaagaagtgcccagctttccgacaaccctaactcatcgtagttcccatcttttgctctggttgacaggaaactcgtggtcctattggaagcacaaccataggacctctgtacattctcgtgtccggtctgctctttgcataagggtgcttgcccctgcttgtgcccttctgctttttgtttacatttgctctcactgtgatgtttttatgttcattttgatactcaagttgtgtgtttgttctcctgcgtgagacacttctaaacatttcatcatttagggtatacatagatcaaagtaagtggggaccacataaacatatgtagaaacacgttctgaacaccaaagagcttctcggtcaccagttaatattgtggttctttgttgttgttgttgttgttgttgttgttgttttttgagatggagtctcgctctgtcacccaggctggagtgcagtgccgcaatctcagctcactgcaacctctgcctcctgggttcagccagttctcctgccttagcctcccaagtagctgggattacaagcatgcgccaccacgcccagctaatttttttttgtatttttagtagagacagggtgtcaccatattggccaggctggtctcgaactcctgaccttgtgatccacctgccttggcctcccaaagtgctgggattacaggcgtgagccaccacacctggccaatattgttattacagtcactgttttatggaaaaacttagtgacctcatatcgttcttactgggcaagtgagcctaacacaatctgtttctatagtaattgtggaaatgtgacgttacagtggaagaggagagttgggacatggctgtggagtggagctggggctgtccacctctcacttagtatggaatcctctcctaggcccttcagctccagcacactggaagtctaaggggttttgtttgtctgtttgcccctatgttttaatcaccgctaggatcagaagaactgcagtctctgtgaacaggtcttcaggtgacatcagtgtgttacctccctggttagcaattagcattcccgaggtcgggtgctgtgctgcatgcaaagttgaatcaggcacagacagaaccttccttgaaggagtttgtcctctcttaatagtgaagataatatagaaattgtcctagccagtttacactcctaaaacaaattaccatagactaggaggcttaaacaacagacttttattgctcacagttcttctggaggctggtagtccaacgtcaaggtgctggcctgtggattcctggttcacagatggcactttctacctgtgtcctcacatgagggagagcagagagaggaagcaagctccctcgcatatcttttctttttttgagacagggtctggttctgtcactccaggctagagtgcagtggtgcaatcacagctcactgcagcctcaaactcccaaactcctaggctcaagcaatcttcccacctcagcctcctgagtaactgggactttaggcatgtaccaccatgcctggctaattttgtttgtttttgtagagatggagtctcattatgttggccaggagggtctcaaactccgggcctcaagcagtcctcccaccttggcctcccaaagtgctgggattacacgcttcagccacaatgctatccttgagtgcttcttatgagggtactcatccattcctgagggcttcaccctcctgactgcatcaccttccaaaggctccacctcttcatcctatcccattggggttaggatttcaacttatggatttgggaggcagggcacaggcatttagactgcaacataaatgtgaatggctgaggagcatgggattcagaaggcccgagcacatcaggctgcctgctttgctttctgctcctttcttctctcttccctcctcccttcctttgtttctttgttccttctttcctgttgactcagtgagcttttgctgcaatctgctttgtgccaggcattgtgttggacctggaatacagaggtagatgaggcaggggtgagcacagtcgtttcagctaggaggagagatactaaatgaaaataccacagaatggtgaagtgcagtctaggaatcaacaggtagagattcagtactgtgcaagttcagagaagaaaggcatatctgtgtcaatgggtccaggaaatgtttcatggaggaggttgcttttttttttttttttttttttttttgagatgaagtcttgctctgttgccagtctggagtgcagtggcatgatatcagctcactgcaacctctgcctcctgggttcaagtgattctcctgccttagcctcctgagtagctgggactacaggcgcccaccaccatgcccagctaatttttctatttttagtagagacagggtttcaccatgttgggcaggatggtcttgatctcctgacctcgtgatctgcccccctcagcctcccaaactgctgggattacaggcgtgaaccaccgcacccggccccgcatttcactggatcttcagaacaggaatggcttccttggggagggtcccaaaaagtgcgaatcaaaacagagatttgggaaccaccaggcatgcataggtagggcagggcatctcaactcactgcaacccatcagagagtacatctcaacccactacagctcatcagacagtacatcttaactcactacaactcatcagactgacatctcaaatcactacagctcatcacagagtacaactcaactcagtacaactcatcagacagacatctcaaatcactacagctcatcagacagacaaatcactacagctcatcagacagacatctcaactcactataactcagacatctcaaatcactacaactcatcagacatctcaactcactataactcagacagacatctcaactcactacaactcatcagacatctcaacttcactacggttcatcagacagacatctcaaatcactacaactcatcagacatctcaactcgctacaactcatcagacagacatctcaaatcactacagctcctcagacagtatatctcaactcaccacaactcatcagacagacatctcagctcactacaactcatcagacagtacctctcaagtcactgagttttatggtctgtgactgataccccgatagagttgtggaggtgaaaagaatacaggtgaaagtgtttggtaatatgaacacctcctagatccatcctagatgtctagaaattcacatacacatttgtggctcagaagagcatgtaggtgtagggaacaaggtgtaaggtaaactcaaattcatacattgcttgttacctctgcccagaccttagtagctttaagcttttgtcaataatagatcatacctaataaatattacacaacccagatgcttctaaaactattattgaggtaaatgaaaatgtctgccacagtaagatagtatttatcacagagattcagatatgattttttttctcttttaacctaaagaaatatagtaataacaaaaaagtcagctaatatgctataagcaattgttgggaatcttggcatgaaatccagttagggtactgattgtgcccatatcagatttttagaagcagataacctgatgtgtttatgagttttatttctggtctgctttctcctcaaaatttcctgtgtatacattgaaaacaaaaagccagccacagatcacttgatcattatagcataaagagtagaataattgtgttagttaccttgctgcataacaaatcgtccaccaatttggtggcttgaacaccactaaacatttattatctcatacactttctgagggttagggaggagattagctgggttattgtggctcagcatctcctgagattgcagtcaacacgtgggccaggacagccgtcttccaaaggcttgcttggagctagaggatccgcttccaagagggcacccatatgtctgttggcaggaggcctcagttcctccccacatggatctccgtatagggctgcttgagtgtcctcacaacatggttgttggcttccccgctgtgagttatcctcgggagagaggaaggaggaagttgcaatgcctgtgtgatctggtctcagaagtcacacatcggcacttctgccatacatttttaaaccaatttattgaggtataattgacatataaaaggctgtacatatttaatgtatacaacttgatgaatttggagataagtatctataagcctgtgaaatcatcaccacaatcagtgccttaaacggatccatcacctccaaaagttttctcccaccctgtcaaccctctttttttttgttgtcattgataagatctacccccttagcaaatttgtaaatgtacaatacagaattattaactacagacgctgcgctgtgcagtaggtctctgggtaattcatcttgcgtaattgaaactttgtgccctctcaccaatacctccctgtttccccttcccccatcccctaacaaccaccattcattctatttgaaagtttaaaattcttcacgtaagtgggaccatgtagcacttgtctttctgtgcctggcttgtctcacttagcataatgtcctgtaggctcatccatgttgtcacaaatggcaagatttccctcctttttaagtcttttctattcctctatatgcacgcatcacattttctttattcactcatctgtcaatgtctgcttaggtggcttccatgccttggcattcacaatataaatagttcacacaagtgaactattcacaatagttcatgtcgtagtaaacatgtgagttctgccatattttgcttgttcaaaaggagtcagagtccggcctacttctaacaagctccacttgtttgaaggaaggagtttcaaaggaattgttggaacttctttgtttgtttgttttttagaaatgagttctctgtctgttgcccaggctggcatgcagtgacatagtcatggctcagtgcatcgttgaattcctggattcaagtgatcctcctgcctcagctttccaagtagctgggactacaggtgcatgccaccatacttggataatttttttaaaaacttttctttcggtaccagatcttgctatgttgcccaggctggtctcaaactcctggcctcaagtgaccctcctgcctaggcaacccaagttgctgggactccaggcatgagccactgtgcctggctgattttgataactttatacacctcgtaatcaaaacagtaagttccagaaagctcctttgtactctttccaatgaaaccctgccccacaaccatccctccctgatgtgtgaccctagtgagtgttgcctcttcttgagcttcatgtaaactggaccctacttgtgcgttctttggcggttgacccttcattcagggtcgtgcccctgggacccattctcactgctgtgtctcggtagtttttctaaattactggctagtgttcccttctgtgaatacagcaccactggttgatccactcaccagtaggtgggcagtgtttggccaacatgaatgagggcttgtgttgtttctcttgggtgagagagttgtttctctgggagcggtggactggctgggtcgcagggcaggtgtgtgagagtctccttcctcacacagtttcactaggactcagaagccatggtcttttctctcctgtgaagggcttgagactttctggaattgagttcatgtagctgtcctcagcttttgatgagggacgtgtgtgtgttccaataacacttcgtttacaaaaccaggaggcagtggagagttggcccttggtttctagtttgcaaactcctggtctagaaggtaagacaaatattaatttttaaaacccgcgtgtctgtaattgctcattttgaaagcactgtgaagggaacactaagggagaggggatgggaagactttttacatgtgtgtggggagtctgatgaatttgtaaaacctatgattttataacttttctggcctctttttagttgctactgtgagcagtagtccatatgtgaaccagagtggacctccacaagctgccttttgaagttgttacagttagcagagacgaactggcccagggttcaagaagcctttctggctggaggaatgtggatcagtccctccaggcctggaagagggcagtggggggcggggggtgcactcaatcttaccattttcacagatgagagtaatttcatttcagaggggtatgccaaggcagcgatgaaaacttcaggaatagctttgaatatctaaaggaagtgggtaagaaagtgggaggttgggagttccggagggagagttcctgtaaagcagagattcccagggctggctcaacatccacattgcctggagggctttccctgaaacacaggcttgcaggcatgccagcccttgctatttcccacctctgcccaggcctggccctcatcaaggcgggagagcccagctcccagggctcacgctctggaaccaagaatgtggctctccaggcacagagacaatagaggcctggaacagatcctcaaaatgtgtgtgctgaagacatactcagggtccgatacttgagggccatctcacattatcatctccaaatctaggcaggttctgttattgggcattaacccctcgagaaatcagtgcctgtaactatgatttggatcatctgtgctttggatttctcttttaatcttctctgtctcctcccattcttaaccacaagtgatttatcagcctctctaattcaacttcattactctttgccatccaagtccctgcaagcacaaataaaacccaaaggaagcagcagacctttttatccatctgtgaagacactcaagaaacactaaattcatctgactttctagagtaattgctttccccacatggcactagaatcctggcatacagggagcagcttcagcagagacacggcagtagagaaatgactgactgaaggatggttcagggctgttgtcctccctgaaggtggttccaacaggacacaaaagttgcagcagagcctgtgagaacagctgtgtcctttgtcgtcactagctggtctgtctgttcattgggcaatttcagtttttatgactgaaagctgggcatgcaaaggacaaccaaacagcctctagcctgctgatgctcacagtctggaaagtcctatggtaaatcaatatttcttttttgcttttcagagacagtctcactctgttacccaggcaagagtgcagtggcatgatcatcgctcactgcagcctccaactcctgggctcaagcaatcctcccgcttcagcctcctgagtagctgggactaaaggtgcccaccaccatgcctggctggtttttcaattttttgtagagacagggtcttgctatgttgcccaggctggtctctaactccttgcctcgggcagtcctcctgccttggcctccctaagtgttgggattgcaggcacggggcaccacatccaggcttttttcatttgtttttagagacagggtctccctctgtcacccaggctggagtgcagtggtgtgatcatggctcactgcaaccttgaactcccagggtcaagcaattctctcacctcagcctcctgagtagttgggactgcaggcatgcatcaccatacctggctaatttttaattttttttttatttttattttttgtagagactgggtcttgctatgttgttcagagtggtcttgaattcctcccacctcggcctcccacagcactgggattataggtgtgagccactgtgctcagcctggtaaattggtatgtctaaggagagtgtttggtgccattgttcccaggtgttcacactgtttaaaatgtttctaatacatctcagcattgataggttggttgcttggttggtttcttgcctcttttgggctccatcgccttccccactgtctcctttttccacctcatctggcctttgtggagtgctgtgttggcaaaagagctttccacctgtgcctccccaagggtgtgtgtctgtaagagctgcccagggcctgggaaggacagtggagacaccaggtactcgttcgggagacttgtgctcaaaatgacatgggtgtgccggctcttagctgcctgacccgcattctgaggcctggtggcgccgtgcttcttcagcgtgtgaacacctgcctggcagcgtctgatacacctcaccaggctgaagggcagaccagctacctgtgattcctgataaaaattctgtgctttacagaatcccttctatttatgcccacaaccaatggaggagtgctttctagatgataacctcaaactgtcagtgttgagcttgagttgatgtttgagttactgagcgttccacgttccatgctcatggaaacctggctctgtttggaagcagcaatgctgggccctaccccagttgtcccatgagataattgtgctctgtgcacacagttccggtcccagaccctggctttgtagcatacattttcaaggaggactcttgggccaccacagatactgccctatccattgctatttttgatggtatgcttgtgtataatacgtttgtatatggcataagttagcagaatatgtaaatgaaaggaggaaacacctcaatgtcattatccacgggaagtgtgttcactctgtctcttcattgtaaaaatgaggcagtgccgttgcccagagctctcttggcaccttttatacccctcaccggctggcttggtcggctgcaggggtgcccttcccatctcattggctgggtgtgttgcatggtgttatgctttgggaagaaggttgtatggtgctggtgtcacagaggcctgtgtccaggtctgccccatcacagactgaccctttggtcttaggtgctcagcaggtgcctggctcataggaagcccacgcaactccatctcccacaccagggcctttatctgctgctagctcaccgccatcctatgcgatgtggcctgtgatcagcttgtacaggagaggcagctttctggggtgtagttgcctgcctgacgtcacatagctggcacgtgatggatcccgattggatgtgtctgcccggggaaacctcaagtcacaggcagctagcacagctcaagcgtccctaatcagaaggtctgaaatcttaaatgcttcaaagttcaaaactttttgagcaccaacatgatgccataaaggaaaaattccacagctgatctcgtgggatgtgtcgcagtgagaatgcaggtagagactgggcaagctgctgctgtttgctgttgctggcgcctcacagctgaggcgggtgttctggtgccattgccgtgctgcttacttaccctggacacattcctctctcactgtattgatggtatatcgtgcttttcactgttgagtgcttatatatcagtataggaaaattattgcttgttggcagcatataaattcagagtccggaatgacggagatgccagacaactacagattgtgcacatgggtggcagagagactgacacttttgctttatgatggttcggtggatacaaactttgtttcgtgcacaaaattattaagcatattgtataaaattaccttcaggctatctatataaagtgtatatgaagcaaaatgagtgtcaggtttagacttgagtcccacccccgagatgtctcattatgtatgtgtaaatattccaaaatccaaaaacgtctgaaatccaaaacacttctggtcccaagcatttcggaagagagatgtttaacccgtactttagaaagcactcaggcgctggagttcatcgcgggcagcatttcagcagcacctgtgttgtgtgtctgcaaatcagaatgcatccctatcccatcattgacaccaaaagtagttatgatgcctgtggcagtggctcatgcctgtactcccagcactttgggaggccaaggcaaaaggatcacttgagcccaggagtttgaggccagcatgggcaacatggtgaaccccatctctacaaaataatttaaaaactagccaggccatagtggcatacacctgtggtcccagctagtcaggagactaaggcaggagggtcacttgagcctgggaggtcgagactacagtgacccgtgatcacgctgctgcactccagcctgggcaaaacagcaagaccctatctctgtctccaaaaaaaaaaaaaaaaaaaaaaaaaaaaaaaaagtaggtgaggaggaccctgtggtgtgtgttccttaagtcatctgcaagattcagaaattttcccatcctccttgctaaagataattgttaaccctattcagaaaacagtggtggattattgattacagagcagttcaaaactgtttagttgtgttgggaacattcacacacaaggtcctttcacggagaacttaaccatggtgtcttgaaaaaatgcagcttctcaccttttaaaattccgcacaaaaaaagtgaaagtgattgaaagcaacaggtgcatttacattgtgttcaagtgagggcataacatgatgcatgtaataaatatttgcttgcaaggccctgaaggaaatagcccagatccctgccctctgtagaggtgctttcagcccagggaggagcgtggaggcaggtgagcaatgggatgatttgagagagtccccttgctggggcgtgacctggaggtggggtgatgtcagggcaggactgggggagctgagggctgtgtggaggcaggggcagtgcaaggagaccttgcattcagacatggggctggctgtctcgtcgtggaagcaaaaatagagtaatgccagcaggatctctagagtgtttgtttttttcctaacagtggtttcggtcctgtcatagcatgctgggtgactgagtacactaatggtggcccttcctgcaggtttgtccccttcatataagttctgtttggctttgaggtgctgttttagagcttcatgctctgtctccttcagtggcggccagcccagggagaatggcagggccgtgggctccatgtagcagatctctgaagccactgctgcttggagcctgccggccctctcccctctgggaactgtgcaagcagctgtctccttgggaacgtggcattagcatgttttgcatgagaatgaacaccaaccaaggctgaatatcaattggatcctagagtgcagctgcctttgaaatgttcctttgtgtggccgaacttcctgctgcagttgattcctggagcttgtgcgaagacacaaagtcttaagtcatcttagtgccttgcttactctatctctggatcttgctgtcaccatttattttatccttagaagtatggcaaagagaaatgcatacatatatgcagagacacatgtctacacacaggcacaacagagacacacgtacctacacatgcacacaacatatacaacccgggcacacactcacaacatgcatctccacacagacacaacacaggcacacatacccacacacgcatacaacgcacaacacaggcacacacatacaacacacatggacacagagacatgcatctacacacatacacaacccaggcgtacacatacaacatacatctacacacagacacatgtgtacattcagacacaacccagactcctacatctacacatgcaaacaaccagacatacacatacaacgtacatctatgcagagatatacatctacacacatacacagcgcaggcacacacacagtgtacatatagacagacagacatttatacacatacaacatgcatctacacacacaaaacatagacacagacaacatctacacatagatctgtacacatacacaccagatgcatacaacatatagacatgcacgtaacacatagacatgcatctgtgcgcaagcacaacatggaccactcacacacacaacctgcagagctgcctcttggaaccagttagaaacaaaagttggaatatgaccccagcaagtccccaatccccatttttggtccttttcttcgtttgtgttgttgaccctgatggcccagattcttatcaactgcgacaataaaaaccaattagtgattttatagtttgactttgcaaggtgggggtggggggcaaacttggtccagacattgctgtgctgctgcaggtctgaatgaagtgcagtgttgggctggagcgcgccccgtgctgcacttctggcgtgggaagtgacgatgcagcacacaccactcccctgagaacagagcacccagctcctgtagtttggccctctaggaagatgggaaggagcctgtgggcaccttctgattaggagagaagccaggagccagcctgccgtccactttctcagtgggtctcttgctccatgtcattgttcacttctcacagggcctttgctccctgcaggtgagttctctttcgtttatgggtggatctcggagcacttctgcagaaggcactttgcaaatagagttcctttttaatcagtgggtgaccaaaggcacttggattttagcaataaattataggtcatttaattatctgtttctgtgatgtggtgatgtgatatggtttggctgtgtccccacccaaatctcaacttgaattgtatttctgagaattcccacgtgttgtgggagggacccagggggaagtaattgaatcatggggcctggtctttcccctgctattcttgtgatagcaaataagtctcacaagacctgatgggtttatcaggggtttccgcttttgcttcctccgttttctcttgccactgccatgtaagaagtgcctttcacctcccgccatgattctgaggcctccccagccatgtggaactctaagtccaattaaacgtcactttgttcccagtttcaggtatgtctttatcagcagcgtgaaaacgaactaatacctggcgcttttaaataacaggtaccaggtgctttcaagtgggtctatgggtgatagatttcaggagttttcaaagggaaaaaaagtgcaagtgtacctcaactctttggcatgaaatgaattattgaacgctgaaatattgaggctgggcgcagtgactcacacctgtaatcccagcacttgggaggccaaggcaggtggatcccttgagtccaggagtttgagaccagcctgggcaacatggtgaaaccctatctctacaaaaatacaaaaattagctgggtgtggtggtgcacacctgtggtcccagctgctagggaggttgaggtgggaggatcatctgccaaggaagtggaggctgcagtgagcccagattgtgcactccagcctggacaacagagtaagaccctgtctcaaaaaaaaaaaaagaaaagaaagaaagaaagaaagaaagaaatatggaaatgaaatggaatattgaattctgaaccattgaatattgaaatgcaatgtgggggagacatctgacctgtgagagcgcttctcagaatgcaaatcagtttggcagtattttaatgtcattctgtgttttataaccagacaaatgtattgttctctaacccatgcatagctgtgttcaagttttgttttgttttgttttgtttttttgagacggagtcttgctttgtcacccaggctggagtgcagtggtatgatctcagctcactgcaacctccacctcccaggttcaagcaattctcgtgcctcagccttccgagtagctgggattacaggtacacgccaccatgcccggctaatttttgcatttttagtagagatggggcttcaccatgttggccaggctggtctcgaactcctgacctcaagtgatccacccgcctcggcctcccaaagtgctgggattacagatgtgagccactgtgcccagccattcaagttattttgataacacttcaagctaggagtttctgttagtgtctgtctgatgcacatgagaaatctgacttctttgagtggggttgctgttgtctgaagctgaggttgagctatttggttacagcttgttttctaagcctgtgctgtgtcttcagcctcctctaagctgagagcagaggaggctgccctcccaacactttgggaccagacctcccaacactttgggaggccgaggcaggtggatcgcttgaggacaggagttcaagaccagcctgaccaacatggtgaaaccccatctctactaaaaatacgaaaattagccgggcgtggtggcgcatgcctgtagatctagctactccgcaggcaggcaagaggatcacttgaacccaggagtttgagaccagcctgggcagcacagtgagaccccatctctactaaaattttaaaagttagccaggcatggtggtgggcacctatagtctcagctacttgggaagctgaggtggtaggattgcttgagtccaggagttcgaggctgcagcatgctatgatcacactgtactccagcctgggtgacaaagcgagaccccaactctttaaaagagcctttgttggtcttaattttcataatacaatactgattttcaaggttttattaaagaattgatttgcagctcatcttagaaaggtttacccctttgtatatggcaatttcccataagccacataaaaatactgtgacttgaagtaaatatttctgaatctagctgtatgtgagcatttccacaaacattaatgttgtttctaaagtttttgttcatttattcctgcaaaaacaaatgcaatttgtgtgtgtatgtgtgtctgtgtgtgatgtgtgcgcctgtgtcttgaatgcttcatgttcccttgtgggacatgccagtcgacagcctcatgttgtctgaggtgcgtcacgactccccaccttgcatgaggagttgcggtggcgacaggtgtgggaaagtgcatatggatttaactcctgaaagtggcttaaggggattgtgaagatccaggtccagtcccttgtggtgggaaggtattattggaatcgttgattaatttgtacttgttcttcctctagacaagcagatgcccagtgtcgggaaggcagcccaggatcacagcagcacccaccgagtcagaaggcaccgaacccacccacattctctgaactatctcactgccggggagccccagagctgccccgggagggccggggccgagcgggaaccctacctcgagattatagatactcggaggagagcaccccagcagacttgggaccccgagcccagagccctggctcacccctgcatgctcgaggacaagactcgtggccagtgagctcagccctgctctccaagaggccagccccacagaggccaccgccacccaagcgcgagcccaggagatacagggccacagacggcgcacctgctgacgcccccgtgggcgtcctcggcaggcccttcccaacgccatcccctgcgtccctggatgtgtatgtggcccgcctgtccctctcccacagcccctctgtgttcagcagtgcccagccccaggacaccccgaaggccactgtctgtgagcgtggaagccagcatgtgagcggggacgcatcacgtcctctgccagaagcactgctccctcccaagcagcagcacctgcgcctgcagacggccaccatggagacctcgcgctccccctcgccccagttcgccccccagaaactgacggacaaacctcccctgctcatccaggatgaggattcaaccaggtactgtcctgcgacggtgttccctccccatgaggctcctaatgtgggacgcgggttctcagtgggtctttctggggagtcacctgggcaccttgctttagctcaaggcgttggacttaaagtcagtactggggaataactgtgtggacagaaagtgaagcttcagtggtggttggatttttatctcactggggggctgctgtttcctgcagggaacaggggtagatgtgaataggtgatacatcttccccttcctccaagccagatgcatttatatctgcattacccacaggcatctgcagggtagaggtctgtttttttttgtcgttgttgttgttttaatgcagtcaatatttgtgattggaatcgagtttaacctaagcatgcgacctttaggtgaaattggtatttttcatggtgtccagtattttcttactcctttttttccagatttttttttaatgttagaaagctaagctggtatataccttttgttaaagcagaagaatactcattcacatttcatggtgctatcatcaggatttcaggcatggaattattgcgtccattgagatgctgatgaatgttaggcaggaacttgacctttcaagagcactaggcccagcatggtggctcacgcctgtaatcccagcacgtcgagagttcaaggcaggtggatcgcttgagctgaaggagttcgaggctagcccaggcaacatggcaaaaccttgtctctactaaaactacaaaaaattagccaggtgtggtggtgcatgcctatagtcccagcttcccagggaggaggctgaagtgggaggatcacctgagcctggaggtcgaggctgcagtaagccaggatggcaccactgcactccagcctgggtgacagagtgagaccctgtgcaaaaaagagcaccggctgtttagctttcttcacacacaaataccacctccttgagtgccttgaaggactgagaaatggaagaaggggagaatttctgtctcattctctggagcagtggctctcaacctaggaggtggagtgtgattttggcccccaggggacattaggcaatgtctggagacagtttttgttgtcctaagtgcgatgggagtggggggtgctctctgcatctagtggtggagcccagggaggccactcagggtctgcagtgtgtgggcggcccccacagagcattgtccgaccgcagatgccagctgctcttaggctgggaaccctgctgtagagccgcacgcccagcacaggacccaccatcacctgtgctgtgtaaatgtggggcaaagaaaaccaagtcgatgaatgcaggtcctcagtcacaccaggtgtggcgggtggctgccgtcctggacaggacagataacaggtattcccatcgccgcagaaaattctgtgggacctcactgctctagagtctcaagtaattttttttcttagcttctaaataactcagcagagaaagaacatgactgatactgatcctgtatctccagccgaggcattgtaaccacagttttctctgtgggccaaaactgggctttgcatcatttaaaatgtatctaaagatcattcagatatcccttgaattggtaacattgtaaggttctgaaaggaaagtgtcttactcctttcaggctgctataataagatctcatagactgcacggctcattaacaggagaaatgtgtgagttgatgagggctggtcgctggaaggtccgacccactgtgttctgtccttattttgaagtcaaggctcgtgaaactgttctcatgtggaagtcaagactgtttttaagaagagagaccatttctgttaaaaaatgatcaggaatagatgctttgttggaaagtgtatgtgaacccgtgggagataggagatttgttttttttccttcccggtactgtattttatattattatcattattattccctgtcgcccaggctggagtgcagtggtgcgatcttgacttttgggttcaagtgattctgctgcctcagcctcccgagtagctgggattacaggcacctgccaccacaccaggctgatttttgtatttttagtagagacggggtttcaccatgttggccaggctggtctcaaactcctgacctcaggtgatctgtctgcttcagcctcccaaagagctgggattacaggggcaagccactgggcccagcctctttcccaatattttaaaacctgtgaagggagatttgtttatgttgtttaatttgtttctattgtgcacatcaaatttctgcacaaaagggggaggataccaatacaggctgatgtgaaagtcagtaataggcaagcagagcttctcccgggagccgggggggcgggggtgaagggagtgcagagggttctgcgtttgctggtgcttggataaggtggccaggttttcctccttcttttattattattattattattattatttattattattatgtttttaacagagaggtggggaggtctcactgtgttacctaggctggtctcaaactcctgggcgcaagcagtcctcccaccttagcctcccacagtgctgggattccaggtgtgagccactgtgcctagccagggttttccttcataagtctgacctatctaaatggtattttccacagttagactttgtaaattgtcttcatgaggaagcagttgtgaggtgtctgtgagtccctagataaaacacatcagatgttgctgaaccctactggagagagggaggaaaatacgcagttagttcatctcagcctgagcaccactgccttgatagggaaagagccctcctgcattcccagtcaccagtgaaagagggaaaaacagcattaaatttagagcatcgtggctgccctcctgctgtggaaaattggatacatttgtgtaacatcgtaggggcagttttgggttgacttcattagaaacacatcctaatttggggttgtggagtttggcctgtttctttttgcttccctcctgaccaccagcatatggggctgcttctccagtgctctgaaaagctcttggctgagatggccctggtcagcatggtctagcacggtgccgctgagagcagcaggtgcagggctgccccagacaagggactgtggcattgctgggcctgttcctcctgttctctctcccccagtctcccagggatgctttaggtacctctctagtccctttcatccagaaacttttcttttttttttgagatggagtcttgctctgttgcccaggctagagtgcagtggtgtgatctcaggtcactgatctcagctcactgcaacttctgcttcccaggttcaagcgattctcatgcttcagcttcccgagtaggtgggattacaggtgcgcaccaccacacccggctaatttttgtatttttagtagagacagggtttctccatgttagccaggtgggtctcgaactcctgaccacaagtgatccacccgcctcggccttccaaagtgctgggattacaggcatgacccaccacatctggctgacacttttttaaaaaaaaagcaaaactgtgccctttggaagtaatacagaaccgatgactcgctgcttactgcgagatcgtatctcactggtgtgcaaatctgtgcaacgctagcttgaagcacagcgggcggggggtacaaggacagtgttgggtgggctgtcctgcatatggcacaggaggttctcccaagtggggtggtggggggctttggcctgactccaagcacggccactccggagaggagccctccccaggccctgagaactacgcaggaacccgcgggcctgcaccaacctaaggacggatgggaatcctggaaaatgcccatccactgcaggcttcccctacaaaagaacatttaacccaacagggcttgttgaagtttgcattatcatctgcggaatgacaaatggtattaaatagtcctcacagccctccacgaacccctggaggacaccttgggatgcctcaggggtggcattggcggtttgagcatagaaaggatgctgtggttggaaggcggaggtaggagtcagagggagcttcttgaggcctctgcctcatccaggatgtgggatcatggaggctccttcgagttgggtggctggctagtgcctttgagtcaggttcccatccagaggggagggcaggggacacgtcaatcagggtctgtggctggagcatgctttgcgatttcagcagactgttcatcttccagaattgagcgggtgatggacaacaacaccacggtgaagatggtgcccatcaagatcgtgcactcggagagccagccagagaaggagagccgccagagcctggcatgccccgccgagccacctgccctgccccacgggctggagaaagaccagatcaagacgctgagcacatctgagcagttctactcgcgcttctgtctgtacacgcggcagggtgctgagcccgaggccccacatagggcccagccggctgagccccagcccctgggcacccaggtgccccccgagaaagaccgctgcacctcccctccagggctcagctacatgaaggccaaagagaagactgtggaagacctgaagtcggaggagctggccagggagatcgtggggaaggataagtccctggccgacatcctggatcccagtgtgaagatcaaaaccactatggacttgatggaaggcatcttccccaaagacgagcacctcctggaagaagcccagcaacggaggaagctgctccccaaaatcccctctcctagaagcacagaggagaggtgagtaggcgtggcctcccagcttgggcgtgactctgcctggcatctcttaggcttgtaaagggaagggggtctgcctctctgttttcatgcgtgcttttggggaagacgggttttcataagggctcctcgatgcttagcactttttggcttttttgtgagcctccggaaagagaaatggagggttaacggctttgggcctgacatgaaaatacacactgcagaccaccaagctgccttggcctgaggccagcaggatttctgatgatgcccacaggtctcctttctcgtaagacagctgttctcagtgggggccgctgtctaccctgggggacagttggcaatgtcactgtggggaggggtgttccaagcatctggtgggtggagcccaggaacactgctcaacatctacagtgcacaggagggccccccccacagagagtcatccagcccccacgtgtccctagtgccaacatgagaatgaaggcttagattgaatatatatgtgtttctttatgaaatgtttttttaaaactttatttgaaatttttttacatctgcatttaaaaaatttattataatttggccaggcacagtggtgcacacctgtaatcccagcactttggctgaccgaggtaggcagatcatttaagcccatgaattcaataccagcctggacaacatggcaaaacccagtctctacaaaaagtacaaaaaattagccaggcgtggtggtagacacctgtagtcccagctactcgagaggctgaggtgggaggatcacttgagcccaggagttggaggctgcagtgagctatgatggtgccactgcactccagtgtgggtgacagagtaagaccccatctcttgaaatagaaatgaaaaaaaattacgacaatttacacctgcctgaacaaatgtattttaattggttttgtaagtagcactttcagcgtatctccttcagccacttgaccacaaaggcatgcgtggtggcatcttccctgctgctgacatatgttctgccagcacagcgtcattcatgggtaggaaggtggagtgggtatgacacacagccaaggaggagcagctggaccaagtggacccaggcaggagggcgccgacagggctgctgggaggaagggagaagggttggtgtttgtagatagcgtcacacatgtccttgtcctcatcaacccaggctcctggtagagatcatctgtgctctcacctctgtagcagagattcttagatattcctgcttatttgagtttttgccttttttaaaaactatgtttcatacacttacgagtatccatttgacagggttgatggtttttagttttaaccttgttacctacttacttttccccctttggctgtctcatctccctggctggtgtcctttcgtgagcaccagtgttgatttgtcacaacccagggggtggggcagaggggctgtttgcgtgcacagtcccagctcattgaagttcccacacctttacccaggaaagaggagcccagcgtgcctgcggccgtgtccctggccaccaattctacctactacagcacgtcggcccccaaggcggagctgctgatcaagatgaaggacctgcaggagcagcaggagcacgaagaggattcgggaagcgacttggaccacgacctgtcggtgaagaaggtaggagagtccattccaaatgacagcgtgtgcgtgtccaggcaggggcaggcatccggatcacaccatcctgccccagcgcagaccctgcaccacgtgtcccagggcgtttgtgttcagctttcactcaggacagtggaatttgaggtgatattagtgaagccctctgttgttagttctatgtcctaatcttgagccattccacaaacgtctctttgctgtttcaataggatccaatgtcaaattagtttagtcaccattctctttcattttatcttatttatttatttttgagacagggtcttgctctgtcgtgcaggcttgagtgcaatggtgcaatcatggcccaccgcagccttgacctcctggcctcaagcgatccccctgcctcagataaaggaaaattattttcaaattagaaagtggtaacttttttttgagatagagtctccctctgtcacccaggctggagtgcagtggcacactctcagctcactgcaacctctgcctcccgggttcaagcaattctcctacctcagcccctcgagtagctgggattacaggcacctgccaccaagccttgctaatttttgtatttttagtagagatggggtttcaccatgttggccaggccggtctcgaacctcaagtgatccacccaccgcagcctcccaaagtgctgggattacaggcgtgagccactgcttccgggctggaagatggtaactttttggttcaaggtattaaaaagggaaatgaaaattaagggtttaggtcttggggcttttacgggccctccatctggcacacggtaccattcgcttcattctggttgcacattcctcttttaaaaaataataaagaatccaaaacatgttcggtttttccacacagaaccaggaaaatcataccatctggaccatttgaatttgggtcacaccctaggtttagagaactgcattctttgctcgcatgcctttgtttttcatgatataatgaatttcagaagcggcatgccttgattctgccgccctcatctgtggggcactctgtccacctgctttgggaggctggagatgctgggaagccgcctcaccagaagtgtggctccggaactgagtgagtcactgtgggctggaagttggcctcactttagttcagcaagtgtgagttgggcacctgcaccagaagcacatgctgtacatcccagctctctatggtgctgatgactcagcggtcctgttttcctgcttgattggacaaagcggccactgctgcattacattttctccctgctttcccgcagccacacgcttatgatgtcgcacattcctgcaacgcgtgcacaggcggaggcgtgttcagggaggaagcgagcatagcgcagatggggacttagcaggccacctgctctgtagctgcttcaggggaacatatgagaccctaattccgtaggcttccaacattcccagggcgaccacagttgtctcagtcacagcattgctaggtggtcatagagctgagagccaaatcagggaaccctctgttttaggagaagactaaggacagagttgagagagtggaagccccaggcagggaggcagcagggggctctggtggctggtagagaagcatcacgcagagatgacaagatatggttttatacttggggcagctcagaaggactctgcccagaaaagagggcaccatgttgagttgaaccagatagctgattggtttaagtttagaatctttgagaattatggcttttccctggaaccaggaggtgagtgcagggcccagacagaatagaccttgtttcccctatagaagggaacaaaaggtggaggaagggaatgaatggcccagggctcattcttagtggagggatgagagtggctgtgtgcctggtctctactgttgcaggctcttacctgagcctcctggaaagccacgcactgcaagaaatagcagatgggcctgccagacagtatggaccacagtggtgagcccttcagcaccctgggtggtgtggacagccactgatctgttcactgtcccaggccaggtcttgtctcagaaatctttgaaagccaacggctgttctttatacaatggccctttaacaaaggggaaatggtttcaataaaaatttgcatatgacatgtaaaagaaccaataaagaaatctggactcctttcagagagcccagtttcaaattagctcagctgaggtaggttttgagggcacatgttcatgcaccagtataaaatctacatttccgtaattgctgaagaataatggcactgaaaatttcctgagcggccgggcgcggtggctcacgcttgtaatcccagcactttcggaggccgaggtgggcggatcacgaggtcagcagatcgaggccatcctggctaacatggtgaaaccccgtctctactaaaaatacaaaaaattagccaggcgtggtggcgggcgcctgtagtcccagctactcgggaggctgaggcaggagaatggcgtgaacctgggaggcggagcttgcagtgagctgagatagcgccactgcactccagcctgggtggcagagcagagactccgtctcaaaaaaaaaaaaaaaaaaaaaaaaattcctgagcagccctggcgggcgtccttccttatccacagttccctgcattgcttgcagtcttccttcaggctagcattggtatcaggaatttgggaagttcttcatgcctgtttcctgttttgtgcttttccctcaagtgatgactatctaaaatttggccacattctcagctgtgagattctcaacttaaacagtctctccagataggtagtgagtaggaaaaggcacaaaccacttttcctctgctctcacgccacagcaaccaacacagaagacttcggtgaccacatgtgtgaggggggtttcccacacacccagcgagcagtcacttctgcagcagacaccagctgggtggcctctgattcagttcagatgtgacactgtcaaattggaggtagcgtctcatcccacgggttgagggctcagtccccaagactgcaccccccacacacaccagtcgcaagtctgagtctcagggacttctgaccaaccaccttcaagttggggttcccatgaccccctctttagtttccattactttgctagagtggctcacagaactcagggaaacatttacatctatgataaagaatgttacaaaggatacacatgaagagatgtgtagggcgaggcatggggaaaggggtgcggaagagcttccatgccctccctgggtgctccaccctccaggaaccttcttgtcttcacctgtcaggaagtctccagccccgtcttcttgggccttttatggagccttcattggataggcctgatagaaatctgtgtagaaatgtgattggacaaaaagactacaatccagtcctaacagaccgaggagaaagccacaaggtctgcctgttgagattcttgttggcctctctgtgtagcgttccttccccctaggtgtgccgcaggacccttcaggaatatggggatcttaagacctgcattcattcaaggcggtggaggatttctttatggaaaggttggggaagattagatcttgctttgggcaggtaaaagtttaagaccagcctgggcaacatggagagaccccgtctctacaaaaataaaaaaattatctgggtgtggtggtgcatgcctatggtcctagctgcttaggaggctgaggtgggaggattggttgagcccaggaggtcactgctgcagtgagtggtgatcatgccactgcactccagcctgggcaacagagtgagaccctgtctcaaaaaataaaataaaataaaataaaataaatgcatccatgtgagggaaagacctcacgcaatcaggaaataggctgcctcgtatctggcacatgtttctcctgctgtggggttgacttttcctgcctaatgctcatccggctggtcattttacccatagattatggaatcagggcacgaccacttgaagccaggagtttgaggctgtagtgcactatgatcatgtctgtgagtagccactgcactgcaacttgggcaacatagcaagaccgcttctctaaacaagtagaaaaaaggtcatcatttagaaggctggtgggaaagggcatagagtgttagtgtctaatagttacgcagtttcagttggggaagatgacagagttctagagacggatggtggtgacaggtgcatcgcagcatgaatgtaccacacaccacagaactatgctctgaaaagtggtcaagatggcaagctttatgttacatatattttactacaattttgaaaacagtcatctgtttgcattttggtcaagttgaaatcagtaggttatagtaaaagactgttaagttcattcgtatccctttattggtcttaatttttatatgctagtattagcaattaaaattttttttctttttttttctctttagcaattaaaattttaattgctaggccaggcccggtggctcacacctgtaatcccagcactttgggaggccaaggcgggtggatcacctgaggtcaggagttcaagaccagcttggccaacatggtgaaaccccatctctactaaaaatacaaaaattagccaagtgtggtggtgcacgcctgtaatcccagctactcaggaggctgaggcacgagaattgcttgaacccgggaggccattgcactccagcctgggcaacagagcaagaccctgtctcaaaaataaaaattaaataaataaaaataattgctagtgacaataattatatgtacaggacacataactaatcacggaatttggtgctggacataagactcactactttctctctatgtgaatctttaaattagaaaattccaaaggacagaatacataggtctgtgactccttccaaagatatgggttgaaactgcatctaccatgacgagcatcggggccacaactccgacgttctctaatagggcatgaacagaacgagaacaggtttattttatttttaaatgccaatagtgccattaggagtcattcttctttcccttagtcgtataaatcccctattatttggtgatgcaaaagtgagctttcacgcaggtcagctgcacctttcacgtaggtgcgccaaggtggcagtgagcagtgtggccggggtgggggccggcctaaccagtgtctccgtgttcccttgccatcccgtgcccaacagcaggagctcatcgagagcatcagccgcaagctgcaggtgctccgggaggcccgcgagagcctgctggaggacgtgcaggccaacaccgtgctgggggccgaggtggaggccatcgtgaaaggcgtctgcaagcccagcgagtttgacaagttccggatgttcattggagacctggacaaagtggtgaacctcctgctgtcgctgtcaggccgcctggcccgggtggagaatgccctcaataatttggacgacggcgcttctcccggtgatcgggtaaatgcagatacgtctgacttggaaatggggggtggtctcgtgggaaggctgtttttcaagtgtcgtgaaagtcagctccttggagcctagcatagcttccacatggcctgtccacctcctcctgcagaccttgtcgagacagtgcacgctctataccctctccttccttttatatttctttagttgtttgtttgtttgtttgtttgtttgagacagggtctcattctgttgcccaggctggagtgcagtggtgcgatctcggctcactgcagcctctgcctcccgaggttcaagagattctcccacctcagcttcccgggtagctgagctcccaggtgcatgccaccatgcctggctaatttttgtatttttttggtagagatgggatttcactatgttggccaggctggtctggaactcctgagctcaagtgatccgcctacctcagcctcccaaagtgctgggattacaggtgtgagcaactgtgcctggcctccttccttttaattgaggggaaaaggtgcttatcagatgcagggagttgaaccgtcattggactgcagggttgcgggatcttctcaaagaactgttacctctttttaacatctttttagatattcctattgactcttactgataattgtctcttcttagaaaaatcatgttgttgttgtttttacttttcttttaccatgtataagtccgtaacagacatgcctgcctgctgacgatcgtaagtactcaatgatagctattttcttgtggtggttgtagctgtgatttaacaagagggcatgtatcagtctagaaggaagcagacagtgcatctaacttcaaggcgtttctcagtgggtctgtcttttcgtcctttcacatatgaaccaagagaaataatagctgcctcgttggcttttacctcataggccaaatatcagtaaaacagctagttttgtttgcacagaacaggccttcagaatgttcatctgtatcatgaataaaacatcttaacctctctcagaaggggagcagaagaagcacccttcccctttctccaggtgagggtgatttgggccacgcagaacgctgtcctggcgctgggcttggagacggtgcccttctgcactcagccgagtgcttagtaactgtgtcgtggaactagctaggtcagggtggcaccgtgcccgagggggctgctggccgacacccgtgcacagcactgcgtcttctccaccctcaggcttccttgtgtgcagatatgctctgcaggctcgggggcttctcctcctcctgccaggagcatttagtaagcctaccctgaattcctctcgagtccacccatgtggccagctgtcccacggtgttcccatggagcggaccttgacgccaagagggccccgcagtcctttgccctttgcagcatctcagaattctgtcgttgtgagtcccttggtgactcttctgctcaccattcgaggcaggtgggagagagtcaggctcagacagcaagaggaaacccagagaggcctgtgggcggcttctgggggcctcaggctggcccgctgcaaccatgagacacatgcccccaggccctgggccctgggtttgtctgtgtggaccccatcggatctctggtggcatcagggtttccatcgataagttgtgggaccagcccacaagttgccagtgtcttcaagggttggccagtgccccagctttcatcctggtcctcaacaggcttgtttgtctgtcaacagcaatcactgcttgagaagcagagagtcctgatccagca

SEQ ID NO: 2970 - DNA, 162987 bp, human; identical to SEQ ID NO: 2960

SEQ ID NO: 2971 - DNA, 39001 bp, human; identical to SEQ ID NO: 2964

SEQ ID NO: 2972 - DNA, 35986 bp, human; identical to SEQ ID NO: 2967

SEQ ID NO: 2973 - DNA, 36753 bp, human; identical to SEQ ID NO: 2968

SEQ ID NO: 2974 - DNA, 34025 bp, human; identical to SEQ ID NO: 2969

SEQ ID NO: 2975 - DNA, 162987 bp, human; identical to SEQ ID NO: 2960

SEQ ID NO: 2976 - DNA, 35986 bp, human; identical to SEQ ID NO: 2967

SEQ ID NO: 2977 - DNA, 36753 bp, human; identical to SEQ ID NO: 2968

SEQ ID NO: 2978 - DNA, 34025 bp, human; identical to SEQ ID NO: 2969

SEQ ID NO: 2979 - DNA, 162987 bp, human; identical to SEQ ID NO: 2960

SEQ ID NO: 2980 - DNA, 54642 bp, human
gacctttgccgattgtgttggggacgaacttcctttaggatgggaaaccgtatatgataaacaaattggagtttattacatggaccacataaatagtaagtagtgtgcaaaatctgtggcattatatcaaagatgccaaaaactttttgtagagtttaacaatcgttaccttccaatgcagcattaaattgggttttataaatgtaatgcgaagtttccattagctcagttcttcacaaagtgaagcagttctgtagctgtaccttgcttgtgtcttgctagggactgcatataatatgtttaatggagggttttaataactattacaaggaataaatttcccaggcagtctggaaatagagatacctctcataatgaaaaaattatttgttgcagagtggaactgacaagttattggaataagtgcccaagtgattatgttcacttcatttcgtcttatacatttaactttagctttcatacaccaaaccttttcggggggtgtgtgtgtgtgtgtgtgtgtgtgtgtgtaatggtatagagaccatagcaaaaacaatgggtctttgaccatgccagcctcctttgtagaactgtctagagcagtgcttctcatcctgggtgattttatccctcagggacacttggcattgtctggaagcattttcagtggctgtgcctgggagaggtgctgctggcattcagtgggtgtagaccagggatgctgcttaacaccctacaatgcacaggacagccccccctcaccagataatgaggcgatcccaaatgtcaatggtgccaggatataggaaccctgttctagatctgttctttgccccttaatcttggctgtctcttcgtcagctttcttcgatggggtcccagctgggaatccatttttcactctctctcattttcattctggcttccctcagtggctctgtcattgtcatttcactaccaggatatgaagcatggcttccccttggcttactttctgtcctttggttggtgaagtgcggggcggctgcagggtctgaaggtgcatggtgccccccacctgagtgattttgaggcacttttctagtccagtgccatgactcctcatgtccccactgtgcagtcaactcagattggtgtcttcagggctgattcctacattgtcagttgctggcacccaagatctgagtcccccatctcagatctcggggcagtggggtttttggtgcctggcactcgtccttgggcacgattgcagctcttatccagagattgagcagtggtgattggagacaggggatacctaccgttatggccctgctgccctcccaggcaggtccgggtggcaggaggacttctaggtggacccactgctttttggacagggaaagtacctggcagaagagaagctgagaggccccagtggctctctgccagcctggcacttcacggctgtgtgtgtttgggtaaatgtggccttttgagctaggcttcccagctgatagtctaagcggcagctggtaacacgtaagagctgctcacttcacagggccaccatgctgtggacctgggcacatgcccgtggcttcgttaacacgcttcgtccttcccagggcttggtggtacggatgccccacgcccactgaatctcatctctgagacaagagcaggactctgattttgcatttgttttggtttgtaaatctcctcctgtgagcttttatggcttggagaggctttctaggaggggctttctaggatggtgtgaaaaggggtgagcaaaggatattgacaggagagcagacagggaaggcatttccaaggagaacttacctggaaacattctagcaagcacaccgtgtgtgtgtgtgtgtgtgtgtgtgtgtgtgtgtgtgtcaaaacagacataatgtaaaatttaccattttaaccattttgaggtgtacttcacggaacgtaaaacgaaccatttttaaagtgaatagtttggtagcatttggtgcatttgcagtcttgcacagccatcacctctatcttgttccagaacattttcctcaccccaaagggaaatctcatctccattaagcagtcattccccattccccttcccctatgtcccggtgacccctagtctgctttcggtctctgtggagtctcctgttctgggtatttcatagacatggaatcagatgctatgtggccttttgtgcccggcatctttcacttagctgttttttgagtttcttccatgtcatagcgagcatcagaactttattcctttttatggaattttattcctttgtatatggtttatacaaaccactctgttgtatgcactaagtgaaaggtcctgagagtataaaggtgactgaggctgtgcccctgccatctagaggccatagtttagatgggaaacagaaaagatataaaaacactcatgtgctcagtgttaagggggaagaagggcagcccgcgtaagcaggggagagacgcatgtgcctagaggatcagagaaggcttcagaagaaaaggtgcctttgcagcgtgcctgggaagacggcaggccttcctgtgacagaagaggtctgagtcagcatggcaaaggcaccggggggccagccaagcatatttggggacttcgcagaagttcagtctgtgtagacaatgtttttggggaaaaagacggaaaatagagatgaggctgataagtgagttttgggactcctgtatcaggctaaggagattggactttgtgctttcaaagaggtttctgtgtgaaagcattgcatcccagttaggaaggtcactttggagagtgccctgaggatgggttttggtgggatgagaccagaaggcccagagagtctgactgaagtaaggagagacagagacaagggcgtgtcgccagtgatgatcatatccaggggcaggaacctccagttcttcataacccaccgaatgtttcgggaggaagaggagtgggattctttgaggatgagtcccaggttgcactcccaggctggctccgcagttagatccagatgatgcggctccccacaaggggaagacaggagattgcggaagacaggagaagcaggcgtgtgctgtgtgatgtttcgtttggttttgctcttggtggtgaaaggtggtgtggagaatgagggctgctttggatgaatggctgggaatgactttgggtccatccatgtggaggtgcatccaggaggcaggggggaatgaaagtttggagccggggagagaggctggagctggagttaggcacaggcccttggagagctggacggggaggaagcaggagtgcacatgagggaagctatggtgggaggagacaaggaagtcggtgaggaatgggaaaagactacacagtctagtctggaaaatgaaaggagaagggggctagccaggccaggggcacagaagagtttccatcatctcacacagaaggagtcaatgaggagaaggtcataaatagcaattagtgtcacagttctgagctcttgtgggttcatctcctcccatgcttatttagagtgtggtctttgttggtaaaaacattgtcttgtattgtcttccctcctccaatggactgtttcatatctgtagagtttccttctcatctgcactgtggatataaaaatggaaactgttccacattttggaaaggtttgtgatataaaatcttccataatatgcatcctggtaactaattaattttcacattgatgagtgacatcactgcatgactcttggtcaacctaaggattttacttttaagtcacttatgtttttacctttttaaatttcagaacttacccagattgaggatccaagagaacagtggaggcgagagcaagagcgcatgttgaaggaatatttaattgtagctcaggaggctctcaatgccaagaaagaaatctaccagattaagcagcagcggttcgagctggcccaggaggaataccagcagctgcacaaaatgtgtgaggatgacagccgctcgtacgccagctgtgagttgacttatctcctgttaaaagccattgtgactttaaaagccatctctctgctaggttacctgcaaacactgaaccttccctgggcaagatagcttcataaaggttctaatcgcatactgttaggtcatcagtatttggcactgaaatcaggtgggcacctggcagccactcctgtagcaaggatttatcaaatgcttactttgtgcccagacactgggttatggttggtggtgactaagaaaggaaaggtctctgcccttgagctcacattcaggtggggaaggtaaaaaataaacaagaaaacaaaatttcaggtagggatgtgtaccagctgcctgtctcatgcatgtcagttttgaagagggcttccctcagaaatctctgcagttaacactgcttgtctgggatgatctcttgggaaatccacacagtggcttcattcattctgagtgggaagactcaggagacctcagccatgtcaagccccctgtctctttgtagagttctcctcttgggctgtaggctttagtacgcagtacagggaaggaggaggaacaccatagaacccagagaatcggaggactctccttctgcccctcaggtgagatgaccatgtacagcttgctgttctctaaagggacctctctctagttttggaggctgccagagtggggggcttcatttcattagtactcagcaagtgcttggtgttgaagaaaccaggtccactctcagaacccaaagcattttgctgtggacacggtcagtcaccacatgagccagttccttcccagcagactttcaccctcaacagaccccaacagatgtgcatgactgtgactggcctgggcactcgtgagcttggaaagaatggatgaaagttggtaccactgggttgaattttataaaaacctgtctgtttgagacttggggcctttcctgtgatattagtgccatgttgccatggcagatattaaacacacagctatagctttattctgtgttgcaagtcagaatggaggtaaggctaaggggccacacgttttgtgctctgttttattgcggcaactgttgacggggcagaagccttagaagctatggccaggagtggggtattccctctgcaataggaattgaagatatttctatttccgtgtgtcttgagggaaacagggaactcagttttactgatgtgttgcttccaagccatcttatctccatctctgcagatagtggcacatacctggttggtttttttgagggctttgttttgtttttaacttcccatcagattgtgataggtcagctatgtgtggagttttagaggctggtttcttatcttcacagtcatcttttcttggaatatctttctctgattttggtatgagggtaatatactggcctcatagaatgaattgggaaatgttccttcctcttctgttttctcaaagagtttgtgtaggattggtattagtgctttcttaactatttcatagaattcaccaaaagagccacctggacctggagttctttgtggaatgtttttaactacaaatccaatacttttaatagagaggtatccagattttttgtttcttcttgaatcagttttggcatttgtgtttttcagagaattgtcttatttcatctaatctaaaagtcggcaaacttttctatgaagagtcagatagtaaacattttagactttgtcgaccatatgatctcagtgccaacgattctaccctgtagttatattgcaaaagcatccagaaacaacatgtagacagatgtgcctagctatgttccagtagaagtatcaaaacaggtagcaacctagatttggcccacagggagtttgctgcccagtgatctaagctgtcaagtctatgaagttgtttgtagaattcccttattagccttttaatgtctgtaggctttgaagtgatgtcctctctttaattgctgatattaataatttgtgtcttcttaatcagtatagctaaacttttattgatttttatctatctttacaatacactggcttttgccctgttctcccatttcttgtctgtttctatcttactggtttttcttctttattatttctttccttctacttagtttggctttaatttgttcttccttttctagcttcctaaagtggaaatttagatcactggttttagatctttcttacttcctcatatagccattaaagataaggattctcctctaagtactactttaactgcatctcataaattttgatatgctgtattttctttcagttcaaaataatttctcctttttttttggtggtttttgacccatgggttgtttagaagtaagtcagcaggactttttaaagatgtcatgttgttgttgatttctaacttagttccattgtggtcagagactatgtaacatttcagtcttttgaaatctattgagattacttttatggcctagaatactggttttttttttttttgagatggagtcttgctctgtcgcccaggctggagtgcagtggcacgatcttggctcactggctcactgcaacctccacctcccgggttcaagcgattctcctgcctaagcctcctgaggagctgggactacaggtgtccgccaccatgcccagataatttttgtatttttagtagacacgggattttgccatgttggccaggctggtgtggaactcctgacctcaggtgatccacctgcctcggcctcccaaagtgctgggattataggtgtgagccaccgtgcctggccagtctttttgatgaccagaagcccatgggcttggtgccttgatgtctccctagctgaagcattggcctataacctgttctgagattatatagttagcaattctaaacatttcagaaagctgcttggtagaagttgggttgaatggtataaaattgctgtttttgtatctagaaaagggctgaatattggctattcttataatccaacctaatagtgtgtttctttccagcagtctttgggtaccttatcttttacatgcttgcgtttggttaggtctccaaagaggctctcaaatcagtctttcaaagaatgaaatggaagaaatacatatcagaaaaacttggcaggatgtttcttgccagtgattgaaaagaaaaattgagaccaggtacagtggcttacacctgtaatcccaacactttgggaggccgaggcaggaggatcacttgagaccgggaattcaaaaccagcctgggcaacctagcaggaccctgtctctattaaaaaagaaagaaagaaaaactgagtctagagaaagtgtgtattatgtactggctaccaccagtgcagccaggatgtcagctgcagtgactgtggggaccctggactggatgccctcaatgatgcagacattagaacatcctgtctgattccacacccactctgaggggcagtgaacggggaaccccaatgcagtgccaagctgtaggttaagagtattcagtacttcagcatcctgagttgctaaggatcctgcaggatcaggttttgtatttccatgggcttttcacttctttgatgtttgggcaaatagggaattctactcaattacatttctttttgtgccctatgggattttattaatgctcgtttaaaaagatacactcaagaggctctttttgaagtggtatctgttccttcagtagaggaagctgatgactctgttgttgacttgaggttctaaggtgctcaccagattccatttcctgacctgctggatgtctctgtgtggatacgatctctccctccacttgtgtaggttgccttcgaggccaaaagtgggcctgcctgttttcgtgaaagggctggagatgccagtgggtcttcctggggcctgtcagctcatcagggaaaaagccaactctgaacggaatctaggagttgatccaagtgttttatcaacttgctgctgtccctagggctcccaccaagctctctcaatctgccatttaacccgaactaccaggtacaacaaggaaaaccctgctagagtggactcagatgaattctttctggccacaggataaagtccaatgcagtgattttgttggcttgaccatgatctaacagatggcttctacagccatgccagagggcctgggcccatgttgggagctgctggtggcagtttccatagcacacgttggctgtgtagccacacgggtctcactgcccagatctccctcagtgccagtcatctaaagcaggaggcgtctcctttttctgatactgtgaacagaataacatctggacttaattcccacttctttcttcatgggtaatgacttgaagtgaaaggaaccgatatccaatgagctggtgttttctgtgcattgttgtgatcacagtgttgtcaagcacgtgctgttttctttattgttcacatgagaaactgaatatcagggaggctaaattatttcttcaggattacatacccagcagatggtagaagttggatttaagcccagatctgtttgtgttggtggccttcagtgctctgtacggtttcctagacatggaagaggccactcagaacagctgatggtgtttgtggaacccctcccccatccaactttcaggttatctgaaaataaagactagttataaattgacaagttgtcgggaaattttgcagcaataaagggggcaagtggaaggcagagcactttctagatcttgacttttccatggcccatgtaagatcactaaactgttcatttatttttcgacagttagcacctgctgttgatatatactaaatggcgggaacatgttttttttgttgtttgtttgttttgttttgttttgtttttcgagacggagtctcgctctgtccccaagctggagtgcagtggcgcgatcttggctcactgcagcctctgtgtcccgggttaaagcaattctcctgcctcagcctcctgagcagctgggactactggcgcatgccaccatgcccagctaatttttgtatttttagtaacagggtttcaccatgttggccaggatggtccctatctcttgacctcgtgatctgcctgcctcagcctcccaaagtgctgggattacaggcgtgagccactgcgcccagccgggaacacgttttattcctaatggttgcttgttgggaaagatgaggcaataatgtgtgaacagaggaattaactggaacagccatttctaatgtgggagcagaaggtagggaggagaagtgcatctcacctatacccctcacacatttccctcgagctatggaaatcaccagaagaaaacttcatgcattggagaggaaagattttgtgtcagtattgggccatctggtatctaagaacatccgtgccttgacctgaaagcaaattcagatatttggctggatgctttgcacacttgtctgcatgagagtaggaacccaaccctgcttgatttcaatgagcttctgtgctagctgcctggtgatgcccaggcctcatttatgcttcgtagaacactggggtgaaactgctcaacaatggactcattctctctgagacacacctgctactttttctacagctccattttgtagagttttcttctactttctttattgcaacatgttcttctatttgcctgccttttaacactgaatacgttcattatctcagacacattttttcctggagttattcctttattcttcctgagaaactctagccccaggcacattcagatgaactatatatgaccatttgcaggatcttttggaagaaattcttgcatggggtaggataatagtctaaacctcaggtctgcaaactatgtcaagcctgtgggctggatcctatccactgtgggtgtttgtaaataaagttttattggaacacagccatgtccatttagtaacctatcgtctgtagcagctacagtggcagaattgagtatttgagacagattgtatggcccacaaagtcaaaaatatttagggtctggcccattagagaaaaagtttgctaattcctggtctatacccatagttctcagacctggctgcaagctagaatctttaaaaacttgctgcttggacctcaccccaagagattttgatagaactggccttgggtgggaccaggcttttttttttaagcttcccaggtgatccccagggttgaaatccactgggctagacagagtgtgaatggcccttgtagcagcaggaatatgactttgtttattatcctagttcctaggagttactcaaagtctacattgaaagtctttctgggtggctaggaaagaggcagcgttatctctggtgagaaagtgctgatccaccctgagttcttggattaggtggtggtgaagcttgaccttatcagccatcagccttgccagcattccttctgaggctccaagcctgtctcacaatgactcttccattggtgctctgtttttttttttttgtttttttgtttttttgttgttgttgttgttgagacaggatcttgctctgttgcccaggctggagtgtggtagtgtgatcttggctcactgcagcctcaacctcccgggctcaggcgattctcctacctcagcctcttgagtagctgaaactccagatgtgcgccaccatacctagctaattttggtactttttgtagagatggggttttgccatgttgcccaggctggtctcagactcctggactcaagagatctgcccgcctctacctcccaaagtgctgggattacagatatgagccaccgcacccggcctcattggggctctcgctgttgaaggatttctcatttgctgtctttggttaggaacagggctacaggcaatccattccaattcaaccttttgttttccttcacacacgcatgttggagcaggcaggagaaaaaaggatcatggagcatttttcccatgtattagtcagcaagccagattttggaggttgcagcaaagcacatgtgtttcctgagaaataatcccctagtctgtcctggagggagaattcctggttaggatttggtggcttcttgggttacttctgtagatcacccccaggtggccttacttgattgtttttggtcttttgcttatattgccttaaaaaaaacccatcctgcccgctttgttggccttgcgtatttctccatgtgcctctctggtagatagtacctgtcaacctggaacctgtcagggcttgtcggccttttgcccagagtcattcttggctcccttgagcaactcctgacagtgctgatccctggaggcctacacctggtcctaaggagcaacctgctccagaggatgtctttgaagaaggactgctggtcttttaaagcatgtcttgtctctggggtgaccttaggtacccatagctcagaagacgcctgtacataagagagacaaagacaaacagactcatggacacacacatttcccctttcagtaatctgtcaaactgaaatccagagttaagtactggggtttgcagcattttgagtcctaaatacacaggtcaagttcacctgttgggtggtgggcactggggagctggaggaccgtttcttcttctgggaaagctagcccaattaaaggatctttggcagctgacccaccggagcccagattctagacatgaagccctctatgaatgatggcataatgtattatagatcaagtcactacagactcagtcttttaatctataaaatgggcaaggacacataagtatcatttcaccttcacaaagattttatgagaatagattaaataaatgtgaaaggcaccctgtaatagcaaggtataataatttacattgctgtggtccagctaggctataaccttgttattatattatctgaggcaatgttgtatgcctgagcagactccatatgctatttaatagctctgcccacttaactcttcaagagagaagaaagcttcagaggtgaaagtctggtctttagcataaacctcgagattggagacatgtcttaatagaggaagatactccgtttataaatgttgtggaaggccgggcacggtggctcactcctgtaatcccagcactttgggaggctgaggcaggtggatcacttgaggtctggagttccagaccagtctggccaacgtggcaaaaccccatctctactaaaaatacaaaaaattagccgggtgtggtggcggcgcctgtaatcccagctacttgggaggctgaggcaggaggatcgcttgaacccaggaggtggagtttgcagtgagctgagatcacaccactgtgctctggtttgggtgacagagtgagaccctgtctccaaaagaaaagaagtgttgtgtagtacacgctattatgaggtctggagtcctgatctgttcttggactctgtaaatggttctagtagtcttattggcagatctgaggaactgagaattttatttataaatttaattacattattaaaagttatgccagtgttcacaaccatccttagtatttgaagataaaatgtattcactgtgttagttacttgagtagacttttcccttatcccagtcctggaattttataattttatagagaccatagcaaaagtaacatgaatgggatccacataattaaaaggtattctgtcacttatgatggtttcagctgcagcagagaagaataattctcatgggcctagacaataagaaaattcattgtcacatagcggagtcctctggaggtggggtgggattccccataggtggattcagtgactcagtggagtcattggtttgtcagtttccccctctaggagtggatacatgctgagtctcttggggagaggtagctacccaacacttccggggttctggtacttaggaaggagaaatgggggaaggttgccgtgtagatgtccaacagtatccaagacacctcccctgcgtatttcaagtctctttgctaattttccttatgaaactgcatagacagaggaagattggtacagatttttttttttttttttttgagacagagtcttgctctgtcgccaggctggagtgcagtggcgtgatctcggctcactgcaacctccgcctcctgggttcaagcaatcctcctgcctcagcctccttgagtagctgggattacaggcacctgccaccacacccagctaatttttgtaattttagtagagatggggtttcaccattttggccaggatggtctcgatctcttgacctcgtaatccgcctggctcggcctcccaaagtgctggaattagaggcgtgagccacggcgcctgaccggtactaatgtttagcattgcagtgaactttgttgaactttggtggtaggcttactttctacccttaatgggaaagatcccaggtgataactcttgggcttgtgttcctcccactgcaagttgacaagttgacacatgtgttgtagtgttgtaagccaggattcagcaagccctaacctcatagcctcatttgcatattatctctatcccaagtgaaagaaggcctttaagctcagatctgggaaacttaaagtcccaggagtttaatatggagatgttttctataagttatttctgccttttaaggacattgttggagatgttgctttcattactgattttaaatgaaaccaaagagtcaggcaagatggaagatgtaggatttggaaataggcagtcttgtctaagaaagaattgtttgtaaaatattttactccatgtctttgagagatcatgagtctaagtataagaaaattggagataaagttggcaaacatttagctcttccagttgtttatttccagtagattctgttgtttgaaattctgactgaatgggacttaaatagtagattttccatagaactgttattaaaataggagatccaactgctcaagtgaactttggatgtggttctaattgaggtttgaagtaattgtgctgttgaagctactcaatggtgttgagccatcctctgcagtacatagtccacaaatgattttgaattggtttctcattgttggcacctgagttatctgaatgacagccagcctttgattctcagatcaaaggcgttaaagaaaggactccgtccctgcagatgtgtcttctgagcaggtgatgttaatgacaatagctgggaggcagagggcaccagagtggggtggttcacagatgaagacagaccagcattccactagctaagcagaagaagggaagccatgcagcagtggtatagagcccatgccttcagaaacctaaagaaaggaggcagaagcatcaagaaaaagcaccgcagagcggtggatggggtggtagaaattaggaatagccactcgctgctccagcttccgtaacactggaaaaagcttgcagctctctgtgtgcacagaaatttgctgactgtgcctagcgtgtaaacagctctgtggctcttactcatccctaggtattggttactcacgataatgatgccatgtctgtaaaaagactttaaatcatatacactgcactgtttaggaaagcattgaggtatgtgatgtcttttagctaaacattcatcaaaacaaattattagagtaaaagcacgagtgcctcacttcagtttctgggacaaacaacttgggggcccatcttttttctcaagcctgccagatcctgacgtattactagaaatcttttttattttacaaatttctaatgtttttttcctttcttgtgtcaaaaattgttcatccggagaatataagtgtgaagaaaataaaaataaaatcatttttaatgcagccattgagaataactgcagttaactttttggttctatctttccagtgacgtctgtgtgtgtgtgttttaaaagaaagtaaaagtaggttcatactgcaagtactattcacgtattaagtacagtttcctatgtcataatcacacctcttccccctcaccccgtacccccgctgtgtctatatggtgtttaactgtagtagttttatagtagaactaaacagagttttgattgacctacagccatgtattttattatatgggatcctatagaaagtcctgatgcaaatatcaaacatcaggaagatttgaggatgttaaatgtcaattctttaggagccagtgaccacttgtaaatcagagatttagagtcctttaatgcagtaaatcagaagttccttgtgtgtatgtattttgaaggatccattataaaataaaatattttctttctatttagcattctctggatattcaacaaatacaaagtatgacccacaccaaattaaagcagaaatagcaagtcgtcgggatagggtgagtaaaaccgctgtttttacaaccaggtggacggaagcctggggccttatagcctaggccgctggtgttctactctggttgactcctcctggagggatcgctagcagtgttagactggaagagttctgagggttctgatgctcttccctggtgacccctgaattatctatgtgctaccatgtttcgtctcttcagacccttgtcttggttgtctgggaagggaaacacttttgttgcatttgggacaaagcacaagaaacatcttggcaatgaagcctgctcctctcttggtgtgtcattccctgaatcagggtgtatcttttagtgcagtggttctcaaattttagcacagctaagaaaaatacctgggagcttgttccaagtgcgagcttccaggcctagcccctgagttttgacgtgggcctggagcgggtcccagaatctgtttaaagaagcactccaggagccattgagtttcaggtagtcagagagctcgcttctggacacaaagtttcatgtgcggggtctgagaggagtgggtagaaggaaagatgaagaatgcgttacagaagttgccagctgtaatgtggaaaccttgaaaatgcaaatagttgctggttccccacttgcgtaagagtctgtcaacaatctgggatttttgtatctaagcacagcaggtcttctagaaaggctgcttcttatgcatgtgaatggaagtttgtagtgagaatagatgatcttatgaactgcaagctgagtagaaactcagatgacagtgctaataacaactgtagaaatcattcttcacagctggtttttgggaaaaaaaatgtgatttgtctttagctttccagattaaaacgagagctgacccagatgaagcaggaactgcagtacaaagaaaagggggtggagaccctgcaagagtgagttgcctggacacttgtcccaaagcttcatgcccttcactttcatgcctttatttatgctcatgattttccaatgctaacttcagaatctctcttttccttgaagatatttcgttgctttaaatggaaatacttgggaaacaagacctttatttttatgtttatgcacgtttactatagctgtgcaagacactcatggctagttacatttaaatttgactttttcttagttttagtcttttaaattttttgttctaaaattgacatttaaagtaaaagaaaattaaaagtttagtttcccagtctcagtagtcacatcagaagtactcagtagtgacatgtggctagtgcaggttttctccaccacttagcactagtgggatttggggctggatcattcttgtcttggggggactatcctatgcactgtagaattgtcttgtcttggccaggcctggtggctcacgcctgtaatcccaacactttgggaggccaaggcgggcagatcacctgaggtcaggagttcaagaccagcctggccaacatggtgaaaccccatctctactaaaaagacaaacattagccaggcgtggtggtgcatgcctgtaatcccagctactcgggaggctgaggcacaagaatcgcttggcgggcacctgtcatcccagctattcgggaggctgaggcagggagaatcgcttgaacctgggaggccgaagttgcagtgagccgagattgcgccattgcactccagcttgggcgacagagcgagactgtctctcaaaaacaaacaaacaaacaaaaacacaaagaatgttgtctttactctttacccgctagatgccagtagcaccttccacctgtattgtgacaaccaataatgtttctagacattgccaagtgtcccctaaagtacacatttgctcccagtggagaaccaccgtgctggtggctactgtattgaacaccataggtgacagatttccatcatcacggaaagctcctttggacattccagtctgtaggtcttcctcctgttctcatttttacaataagaacgttatccctactaagagattggggatgaattgtttacaattagtgagctgtatcgagtctgcaggtttcatgaactaaaggtggtgtttgagaaatggtgctggtgtgggtctgaaggtttgctgagccgttctctccattcactggctttccttgctgaacttgcgcatgtgccgcacgccttctgcacctacttttctcatctgcaaatggtgattgttttaggcagctcgggctgctatgacaaataccatagactgggtgacttgaatagcagatatttgtttctcacagttctggaggctggaggtccaatatttggttcctggtgagggcccgattcctgatatgcagatgaccatcttgtcgcagtttcctctcatggctaagagagcaaaaactctgttctctcttccttttcctaatcccatcatggggtcccaccctgtgacctcatctaaccctaatcacctcccaaaggccccaccttcaaatgccatcacattagagggtaaggctgcaacataagaatttggaggacacacaaacacacagtccataacagcaatcactgtgctcagttatactgaggacagcaccagcacctggtacatgcccagcccgaaacaattagtccaactctgtgtggttactgttactgacgcaggtgggcaccatgttgccgtctttcatcctgcatgcagatgcatgaggtgacacacgtgactgcagcactgctctttatggggaggtaataaaggaatgtgaggtacagatgtaattatctaccattacccagctatgtgtttgtgtgcattttggatctacagtcagagcttccttttattaaccctagttagtattagcacagcttcttctttagctttttttttttttttttttaagacagagtcttgctctcgtcgcccaggctggagtgcagtggtgtgatcttggctcactgcaacctccccctcccaggttcaagtgattctcgtgcctcagtctccccagtaactgggattacaggtgcccgccaccacgcctggctaatttttgtattttagtagagatggggttttgccacatttgccaggctggtttccaactcctgacctcaggcgatctgcccgcctcggcctcccagagtgctgggattacaggcatgagccaccgttcccggcctcttctttagttttgtcttaagcaaatcaagcttcttttccaactaaccggctgctggttttgtcattcatgcggtgcataggccagagtgctttccaaatgcaccgacgtgtgttttgtccttttagccccccactccagccagcctccagatactccaacacctcctcagatgcgactgtgtgtgctgtggcagtgtcatcctgtgtcactttggctaaggtggtggataaagaataagcagaaacaaatcatttgatttgtgacaggtcaccaaaagttattaggactacctagttggatttgaggtgaattttctaccttcattaggccacactgtagctgtctctcattgtgatacagtgtctctggacaatatgtagttgtttgtttttttttggtttttttttgagatggggagtctttgtcacccaggctggagtgcagtggtgcaatcttggctcgctgtaacctccatttcctgggttcaagcagttctcctgtcttagcctcccaagtagctgggattacaggcacacgccaccatgcccagctaatttttatatttttagtagagaccgggtttcaccatgttggtcaggctggtctcgaactcctgacctcaggtgatccgcctgcctcagcctcccaaagtgctgggattacaggcatgagccaccacgcccggcccagtaggtggttttaatgttagtcattgtgtgtgccggaggttgcagttaatgtcattctcatttgcagctctgaggaaggtgactggggttcaggaagagtctgagtttgctcaggatccctgagcatcagcagggagccacgtctggcacttccctcatggccatggtttctgtagtgggttgctgggctcagcgcccgttgctttgccttggctccatcgttctggtgaactccatttccttatttgaagacaaaggccatatagcagtgtcagctgtagatggactgatttagaaactgaaacgtactgctgactgagaaaacccccttctccttagcatggctaggatgtgaattcatcttttgtagttgcagtggtttcaagaataggaaaaggcagcctctgtttccctaggggcattagacagagaagcaggagccagaataacgagaattttaacttaacacctgcggccaaaacggagcgcaagttgtgctcctggaagagaggcgggccagtgctgtttggattgtctttctgctttcattatcaagatcccacgcttgggaacagcaattgtaaacttgccacttgccaaggggaggctcctcctgtctgcctgagctcatgagaatacccgccctccccctggaggccaaggagtggcctggggaaggctctggacctggccttggtcctgaggggcccaccccacctcatgcctgaccaggggcaagttagctttcaggagggagctgcccagagctgttgtttaatgggcacgttgccttggctctgtctgacgctgcgttgttactgtgcatgtttactttattctgggacagacacagcctcacaggaagaagagaaaacccaggcacccgtgccactcttaaaatatttttgtaagtggaagataatctggtagcctttctctgagttccacagcttatgagatgaaaacagcctcattatttttctggtattgaacattgggtgtttaggtttggattgaatcatgcaaatgtatatttttttaattgagaaattttagaaggccttttcaagcattgaaaatgtgattaccccatctctactgggaaatcctgactatacgtacagatagcaggtgagctgttatacctaaacatgaagcatctctgattttatcaccaacattgcttaaggcagtggcctgagattttcctccagaaaatttcctgctgttcttgcttcccagaatatccagtgtattcttttccagagcacctcactaggagtttggctgcttataacattttaagcttgccttgtttatcttggtgaatttcctggctagcaaggaaattcatcattacacttgggtccaagtaaggaaaaaagaaccttttgtattttactttaaatctatatatgttgttgattgttgtagagaggaattggccacagatatgttcgctgggttaatgatagaatatgtacacagatgtgtgttttatgtgtatctatgtgaagtgtacacatgtaagcttttaatgatggaaaatatcaaacacaaaagcagagagaatagtatactgaaaccttcctgtacccctcaccccatttaacctgcacaattgccaatcttgtttcggtggtgaccccaccccatctgctaagctctcacggccttattgaagcaaatgccagaatcccatttaatccataaatatgtctcctaaagttatggactccttttgaaaataactctaatccctgtaccccatttactaggcatcttgtgtccagtgagctcttgcatttcttcaggtgtttgggtccagtttgggccacagagtgcctttggttgatgtgtctcttacgtcttttcttttctactctccctcctttttttcccctgacagcttatttgttggagaaagtaatttggttgtcctatagaatttccctaatgttgggttttgctgctgaaattcacatgatgtcattgaacgtgttcctctgtctcttgttatttatgcaaatgggcgtaatagtttgagaggcttgatctgattcaagttggatttcttttctttttttagtaagaatgtttttaggtggtggtgttacttccatcaggaggcaccactctgtgcttgtttctttttgcggtgtgaagatgatcagtaggttctggccttgttagcccaatgctttgatttatattaataacatttcttgtcagctttttacctaagttatggatgtgtatcttccaggataagttcctgaaagcgggcttggtaggttaaagggtgaatgtatttgttgtattataggttgtatttcttatctgaaatgcttaggaccagaagtgttttgaatttcagtttttttttttttttttttttttttttttttttttttggtttggaatatttgcattatacttactggttcaatatccctcatccaaaaatctgaaacctgaaatgcttcactggtcattttctttgggtgtcatgtcaatgcttaaaaagtttcagattttgaagcactttggatttcagattttcagattagggatactcagcttgtattagatatggccaaattcctttgctgaggggttgcaccattttgccttcctaccactaacatatgagtgttctcgtttcctgtgactttgccaacaggatgtgttgataagcatttgcatttttgccagtctcataggtgagagatagtatctcagtgtagtttcaatttgcatttttcttgaggccttttataaaagtcttcagaaaataggagcaccatttacaatgactaattaaagtttagagaaaaattgagcttttccagtgaaaggtcccctggactctgttgccctaaagtttctgaaacgttttggaaaaattaccttactgtaacttactactagtgtccagaggcaaagggaagactcaggaccaggacacgtgcaatgtttcccaactgggtgatgtgcgtgaacggaccaagtgcaccaacagatgtgggcaaattcccctctccagctcctgcctggagctctagaatgtaccttgtgttagattttttttttttttttttttttttgagatggagtctcactctgtggcccaggctggagtgcagtggcacgatcttggctcactgcaacctctgcctcccgggttcaagcgattctcatgcctcagcctcctgagtagctaggactacaggtgcacaccaccatgcccagctaatttttatatttttttagtagagacggggtttcaccatgttgcccaggctggtctcgaacttctggactcaagccatctgcccgtctcggcctcccacagtgctgagattacaggcgtgagccactgcacccggccccttatgttagattctgagtggtcctgcagctgggaagctcatttaacattgcccttccctgagtttcctgctcgtgttattagagccttttcctgccatgatacctataatgtccctgagcactggcttgatggcagaagatgcttttgggtaacactgcctggccaccttgtccatggtgtgctgtttctacacccggcctctgatccttctcacagcttccaccaccacggctctgggccaagcactaatgtgagtctccatcctcacacagtagccatggggttcttccacagctagtgctctccttgtggtccttctgtggctctctctcacctacaacacaagccagactctacataggctggcccccggccctgcctcatttacctctagtttcacctttgaaagggatgtcctgcctttaccgtgggtacttggagctccctctgcttggaatgctctttcccccagattctcacatgcctgctcccccacttccgtgggcctttgcttagtgacatctcgagagatcctggcttaaccatccatctaaaaatgtactctgtcacactctatccccaaactgcttcatttttttttgaaaacatttgtgactgcctgacctaaggatgtacttttcattgtctgtctccttggctcgaatcgtgctgcacgaagacaaggacttggctttgttcgccgcttcatcctgaggacccagccagttctcagcacagggtggggcttgggagtgaatgcagattgcccgggtgctggggggagtggctgaggttgctgttcctgcccgctagtagccatcacagggtccacttctttctcggacactgggacactctgagtgagggcagatgtttccttggccaaaacttttgtccctgggctggaggaactcagggaggcctctagacattgtccagtcaccttcttgccaactgtcctctagcacagcattctcttctgcattttgtgtgatattgttttggcctgggttttaagaagtcctattatcactgctattcaaatcacagaaagggatgctcaccagatgttccactaactagtttccatgaggtacattcttagccactaggtgagcctctgcttcaagacttttgatttcttgattaacttcccaaatggggtgaaacccatttgtctccttaaatatgagccactacatccttctaagcatgcaataccagaatgaagcattactgcatattagaattagcattttctgtctgaagggatttagtagtttcaagaaagagtgggattgttcagtagaacaggcttaaagtaacaatctcccattagcgtagcacctaaggaacagcccacgcgaaaacctcggcaatgctcagataacaacagcgaaacgtacagaaatgggctggaaacaaaaagaggattgttcctggttgtgggacaggtctggtgttccacacaggtcttgctgttgatagaaagccgccggaagctttctgaggttcacccaaggccgtctgccagagctgctgatagaaaatgtagaagttgtaacaaacctttccattcttctgggttgtaatctgtggtattaacacagaatatctttagagggctggcagctctttccttcaagatgtggggttaagaagttatgtggttttactcttatttttcctagtgcagttctcttgacatcttaaattgaacaaccaatatggaaattttagggtggcaggaggtagaggttgacaataaacatctctaaaatgccttttccattgtactaggttcctcatctgaagctgtatcttcttcttttctctccagcccatttctttcaaaagcacaccataaagagcaccagtttactttgggatgacatttgactggttatatgggtggccttcaggtttgacacaatgggcatttagaggccttgactttgaatatattgcgaacctggtgatggagcagacaagtcctggtgtggggggccttggctgtgaacttcactttgcctgttactggctgtgtgaccctcagcaaatcacttaacgtccctgaagctgaatgcaaaatgtagagggtgcaaaagtaaagactgtgagtctgtgcactgaattttgatttcatactgcataataactcatgtccttgtttagtctccttgagcagttaccttttctatcattttatttgtgatgtatggtaaaggcactgtcttgcactcttaattaaaattaagaccagaataaggcagttctttggcagtcacagatcttatgattttttaaacgaactggaatacatcaatatttttaaaaaataccaaatcattgagcacatcatctacattggaccaaagttttttagggaagttttagagagagagagtgtgctctcaaataaatgaattttacagaagtaaaagaagacatttactgtcctttgaagtttttgttggatgaaaatggatcacaattgaaaaaatggaggtgttgtgaagctatgacagctaagaaagtataaggtagcccttccatgaatatcccagtgagttacgagcagtgagtgagaaggccagccattttgatggaagtggggctggttttgagggacaaacaaaagagttttgaaaatgtacaatgggtttatatgcctactgtcaccattcttgctattggctcccacgttttagtagccaccaactggcctgctggtactgtgctgggaactttttctattttattgccaaatctcccgaggaccctcaggtgatgtagactgttaaagtttaccaccttgatcatttggatgaactgttttgtgaaagaagggatttaatgagagcagaataaaaagaaaaaatatgcccacagctcaaactttagttcatgctcacttattttaacttttggcatggaatactctatagttaaagatacgtgtaccttttaataaagatgtataaataaagacttctgctttgtaggaacagacaaggcaatgtgtatttgagaaacctacaagtctgtaacagccattatggaagtgcctgcagggtcaggacacgttggcatttaggagtgtcattattcaccatgcacggtgtgcctctatctgctctcctcggggcagaactcaggactagtgtttataaatattttatttgtagctgatggcaatcacagcaatgctgccgagccccagagccctattcaaagggagtcaatggcttcctgcttgtgttgtttgccctcttcctaggccatggatgctgatagctcaggttgactctggtgccgagttttgcttgagttgtgacatatttggcaaggaatttgttaatgataataaaacaccagagttggcaagttatttactttttctcccatgagtaaggagattctgtgttatcctgataataacagtcaccgcaaacaccatatgccaggcctcctgccaagcaagctcttaccttgcattttctcattaaatctcatgcccatcccatgggagaaatatttttagtgtccccatttgagacaggaagaagcaggtggaaagaggggaagtgactcacccaggtcccacagccagtgagtggcagagctgggtgccactcgcacccaccagcatgccagaggttcctgtgagcggtaagcaagggagttggggctggcagttaatgatccaggttttcaggataacatggagggaaatgttagaaccagaacctgtgaactgggagactcggaacctgaaagaagccagttgctttccagagaaggaattcattccactctggaccaaaatttctcaagttccttagccttagggcttcccatgctggagcctcaggtgtaggggatgtgacaaaggacatgctccagaggccacctccctttgaaggcagaaccaagtcttgttttgttctgtgctctgcgtccagccccagacccaggcctggtgtgtacaggagctggctgggaggatggaagcttggaggaaaggtgggaggaaggggaggaaggagggagggagggacattgccattttccctggatgagtgtttggattgaaggaaagaattgaggacttggtaggagaaagagtgagtaataaattagaaccagaatgaaatcagagttataggagacagaaaaggtttccagcttttgtacaaagcaccattatcgaaagctcactacttcttgctgtgtcccatatattctccctgtacacagatctcattcatatgtttatttaacaaagattttgaccactaacctggagataaacaaaacatgtcctcttttcagagagaggaatttacagtctcgggaaattactcaagcaagcaatcttgttgcgcaatcattagcggaggacgtgggcatcctgtctcggacgtcttcacctgcccagggtgctcctgagcaaagggtgttgtatcgaccagaaggagggacgcttccgtggggtctttctttttcttagccaaaacattactttaactgtttccacctctctatgaagcttttgggttttcgtagttgtatgtttaatggaatgctaggatctcatgtgaaatgacattgatttttctgttttaactaggattgatcggaagatgtcaagtactcacaccagctacaaactggatgaggcgcaggctatcatgagtgagctccggaccatcaagaaggccatttgcacaggcgagaaggagaggcgggacctgatgcatgtaagctgcctgcctgctcatgtgttttattttaagatgtttttaatatacttatgtattacatgttatatagttattgtatatataacatatatgtgtatataatacacacacacacacacatgcatacatacatacgcaccccccactgtatttaagtacgtatatagtcatccctctgtatccttgggggattggttccaagacacacccccatccctcaggataccaaaatcattggatggtcaagtcccttatataaaatggtgtagtatttgcatataacctgcacagtcctcctgtatacttttctttttttttttggagacaggatctctgtcacctaggcttgagtacaatagcacaaaaatggctcactgtagccttgacctcccaggctcaagccatcctctcacctcagcttctagagtagctgggaccacaggtgcgcaccatcatgcctggctaatttttatatttttagtagagacagggtctcaccgtgttggccatgctggtctcaaactcctggcctcgagcgatcctcccgtctcggcctcccaaagtgctgggattacaggcatgagccactctgattgctgcctccatggtcacatgactgtctctttgtctgaatttcctgttcctgtaaggacaccagccattggataacgacccaccctaatccagtatgacctcatcttaactagattacatctgtaaagactatttccaaataaggtcacactcacaggttcctggggttaggacttgaacatatctcctgggggaacataattcaacccacagcaatgggtgatacatttatattgttcaataatcaagataattccaaaggtctatgataagaagtctcgctatcgccccatcctcctactgcccctgactgcctttattacctttttgcctacccttccagcattcatgtgggcacacaaaaagagaatacatgtttagccgccctcacgcaaagccaggactgtgatactgttccgcactagcttcctcacttaacagcaatatcccctacctttccccatatctgtacacaaagagctgcttctttccttgagatggttgcatagtattttactatgtgggtgtatttgtattatatatagctgggatcattgtagctttatactgctttatgtttttttccccttgagcttttgtagtttctgttatttttagaaaaagttgaacttttgcaaatgcaaaaagctgcctccatggtgggaaactcaagcaagacatctgagtggctggccctagtgctgcacatggtggcctcagagaggccaaggcaggggagcgctgcttgacctcatgacgtaaagtgctggaatgcattcagtgcttttggttacagcttttatttttcatctgctaccctaagtgagcacctactgcctgctggcatgtgtctagattctgtagagtataagacccacaggacagaacaagcaaagctcaaactcataggcaaaatgagacagatgcacaaaaaaactaccctgcctgggtagtgccttctaaggtcaaggccatgagggacttgcggagagtcctcatggtgcttgttaagatgcagattaccaggccccaccctagactcactgaattagaatctctggaggtagggcctaggaatctattttcagatgacctctccaggttgtgataagtaaatggttaattgttagattttttttttttttggcacacaggtagcactgagaacagctaccatttattgaggtctctgctcagctgacatcaaacaagatgccccatgtttgttacccatcgtcaataccgcaggctgaaccatgtggtgttccatggtggagacacagaggctttacgccatgaggccaagcagggctgcctgccccggcctctctgaggccaccgtgtgcagcaccagggccagccactcatttgccttgcttgaattcccaccgtggaggcaacagatagaatttctggaagaagcttcaggctcgagcaccttctttgacgtctccatagcctctcaaactctgagaagctccaggaagaggcacaggcagagtcctcttctatccaggttaaataagttgttttgcctttcttatgtgaacttaacaatattggcccctcccaagaaggccttatctcaatctcaagccagttttgtgagttctactgcacttgggcatttttggttctggtgtctgtagtaaaatttgctgaaagtgaatatattcagaagtctaaaagaaatggtcaaaaatctgatttctggctgggtgcagtggctcatgcttataatctcagcactttggggggctgaggcaggaggatagcttgagcccagaactttgagaaaagcccaggcaacatagtgagacctggtctctacaaaaacaaacaaacaaacaaaagtttagctgggtgtggtggcatacctgtagtcccaagtactcaggaagctgaggtcggaggatcacctgagccaaggaggtcgaggctacggtgagctatgattgtgccactgcactccagcctgagtgatagagtgagaccctctctcaaaaaaaaaaaaaaaaaaaaaaaaaatcagaattctgatttctgcttaaaactgccacacagagagatttcatgtgccagaatgcatactaactctaatttttggcaaaccaacatacatatgagattacttttgaccatgtagaattatgactgagaaatgaggtttataaaaatacgtaagctaaaacagcaactcaaagaactgaaaaagaaatacgtaagcattgtctgggagctgttttccccttccctgtttttcctctgtaacaatctcaaggcagcattcatctctgtcaggctcatttacattttcgatagaaatacttatttttttctttaggaaacatgaaggtttaagaaccagtaaaaatggtaccataattgtcctctattttattcacatgctgccagggggacttagttgcgatgtgatttaaatgactaagaattttattagaggtgcctgtgatgaagggcatttatgtgaaatctaacgagcatgggggtgaggtggggcaactgttcagtaataaataatgcagcagacctaaaacaaatgagagaaccacttctggagggaagagacacatcaccatctccgttcaaagagcttgtctcattgtgttccagagcctggccaagctgaccgatagcttcaagaacagctgctccgttaccgactctctagtggacttccctcaccatgtaggcgtgcctggcgatgctggtgtaccccagcagttctgcgatgccggctcccagactgatatcatcggggaggtatatgcgcgcccagggggagaaatgcaccgggagaggggagggctgcttcagtgttgccatcactggtttggtgtaattttccatgttcacttaagaaatgccttcacttttgtgccattaagtttgaagaaaaagtgttgtgtctcacatccagctgtgtgatacaattgaattgcttattactgctgcccttatgatttggactcttataaatgacatactccttgtgagagttgagtttcactgttcttttgacagacatatcactttttagagcatgagtccccacgctttttctgtgaagggccagatagtaaatatagtcactattttaggctttgcaggtagttctgctggaactgccccaccctgtcattgtagtgtacatgcagccataacagagatgccttgcaagcatgtaagactggggcctcgagctgctcaaacgttcacttacggaacagccagtgggctggatttggccccagggccatagttactgattcctgccttagaccactgatttccaaaggctttatagctgtgccaccttgggtgttactttattgctgtttcttactcttctaaaagaatgtcaggaaattgaattgaactaaaagtcatttttgtttgagacttggaagaatgtcataatgcctcctttgttaattagcgaagccttgagttagccacaaaaacaaagttgggaaaatcaccatttgaagcaggatggtggatattcaaagacgctagtattgtaatatcattgagtgaagcttgacattaatttgttaccaaatggaaaaacagtttaaagagcttctttttttttttttaaggattattaagtaaagatgaggtatcaatggaatgcacagtgccacccctcccccgaaattaaataaataaaaggaaagcaacaaaaggaggaaaaaacaattgatggaaaactctgggttttaaataattagctaattaatattttgaaatcttagcaactagtgcctcttcgagtggagtataatgtaggaaatcacggccctttatgtcttgggtgtcctggaacagtcctattttcaaatttgcctgcgttgttccaaacgtacacttggccgtttttgactaggcatcttctttggatgaaagaatatggtcgccatctgtaacacacagaggagaatctgtaattcaaaaatgtttggcatttttgcgtaaagattttggagcgagagaaggaaacaagtgtaagactcattgaattcgtgaataattcattgctgcttattgtaaggttagaattagaatttagtttgagagaaacagttaagatagaaggttctccagtgatttaggtcaacccttctaaaaatgtcaggtgaggagtggtggctggttatgctacttgagcagtcactgctcattgttgataagctcctgaagtttaccggggctgaccctaggtcagcaatctcatagctgttatctcagtttaagtagttgttcccatcctgtgtgatgtgcaggagaccgagatgccaggttacctaaggtcttgtagctgaggagaggcaggtctggttttgaaacatttctcatccctaaacccctgtactttctaagaaaccacatcatgttatagaaaaatagatcaaaaggctatgactgtattagctaaccattgctgcataacagatttccccaaaacctagcctcttacaacaacactcctttattatctcatgcttgatgtggtccaggagactgggctgggtcttctgctccagggtctctcaggaacttccctgcaatcaaggtgtcagccaggactgtggtctcatccaaaagctcacctgggggaggggccactcttaagctcatgtgattgttggcaggattcagttcctcacaggttgctggactgagggcttcagttccttgccacatgggctgctccagcacggcagcctgcttcgtcaaagtgtaccagctgagagtctgctagcaagatggaagtcacagtcttttgtaacctattcacagaaatgacttcccatcacctttgttctgttctattggttagagtcaagttatagacccagtttattctcagggggagggaatttcacacggggagaatcccaggaggtgttggtcattaggggccttcttagaagtctgcctacctcactttgtgcttgtgttgagtctgttttgtggggtggatattgctgtatgtcagatgtgctttttgagactggagatttgcagccacagggttgcacacgctgtagcgctgcataggaactctgaagcaggagtctcttggatccatttggctgtcttttcttttcactaaaatgtccatttaattctcaaagaagagtacagaaacaaagcttagagagaggtgcatacagctttgagaagaggtttgagagatgatgtttactgatcttgatgagttgattgcagggtcactaataaagaggggactgaaatggcaagtagctcatctccactgtggacagcttttggagctgtggcactgccacttaaatatatttatactgaggaagctggagaggagcattggatgaggccgtttaaacatgtataattgtggccaggcacagtggctcatgcttgtaatcctagcactttgggaggctgaggtggccagaggtggccagattgcttgagcccatgagttgaagaccagtctgggcaacatggctgggcaaccacctgggcgtggtggctcatgcctgtagtcccagctacttgggaggctgaggcaggaggatcgcttgagcccaaggggttgaggctgcagtgagctgtgattgtgccactgcactctagtctgagcaatagtgcgagaccctgtctcaaaaaaagaaaccatgaacaattgtcattctggttggagaatgctcagtcccttgtaaggcactttttcatcttgccattcaaggcaataaatttgcgaagacatttttcatcaacatagatcaaaactcgtgtcgataaattcactgctaatcattcaagttgaatattttcagatacttgttgatgggaagttatttcaaaaatgtaaagacttggtggccataatatgtgatctagtaaggtcagatcaacagatggagctgatttattgaaactggagttgtgtgaatatttgcaggaatgaggaattaaccaaaatgtactacagttacttcctgtacatgtctttttttgttttgtgtaggattttattgtcatcaatgtaactggtacaaaaatatttaagtatatctactcgtcacagagcaccgcatttaggctaactctatattggtactccccgagctctggctttttgagaccttgcttgctttccttttgcccttggttctttttttttttttttttttgagacggagtcttgctctgtcgcccaggctgaagtgcagtggctcagtctcggctcactgcaagctccgcctcctgggttcatgccattctcctgcctcagcctcccgagtagctgcgactacaggcgcctgccactacgcccgactaattttttgtatttttagtagaggcggggtttcaccgtgttagccaggatggtctcgatctcctgacctcgtaatccgcccgcctcagactcccaaagtgctgggattacaggcgtgagccaccgcgcctggcttgcccttggttctttaacacacctcgtggcatcagaaggcgtccaccagcccatccgtcacacagctagtccagcttcctcagaccgtggagcttctgagtagaacatcattattttacgtttactgaggaattagagaatgtactgcacaaaatcgggtgactggtttttgcctttgtatcaacttttactaagtaatttcctacttcttttaaaacctaatttgtggttgttgtttggaattacagaatagatagatatgctgctgctgtaaaaaaaaacaaaaaaccctaccagtttaggcaagcaagagtcttcccttccccctcccccctccccagccaggggtggccgcaaagggttattcagtgtttccttccagaccttgcacagattgaaagtgaaagagatgaagaatatttctcattgctgccgaaagtttaagtgaagttgctattttggaaatatgtttttaatatgcgtttcctttctttttttctctcttctgttccggaaagtttgtctttgatgataaaacaagacttgtagaccgagtcagacttaattggcaatatgaagaagccagaaagaggtaagaagcacttttttccaacctcgccttctgcttacttacttactttctcctgtggaaggaagcgtggcatagttcctgtgtgtgattggtcacgtctcatcggagaacagcgtttgatagaataccaagtcaaggatcttcatttacgtgtagcttaatacatacatatgacaacatttcaagtgcatttaaaatgtgaaatttgcaatattacaaacagttatacagacgtgattccataagaatagaaacttttttggctttgtcatccccggtggttcagaacctctacccctccttcccttccctccttccaatagacgagcatcagttccagagggtgtcataagtgaaaccacttgatcttttatatgtgtggcttctaactccataagctaatgggcaaagccatgtatcttggttataagacattcaataagcattaggtcaacaggtgagcagtacctaattgatttcattccatttatgttgtcctgtgtcgtaaaccattggcctcctgcaaattgcagcttgacccactttgtgcacttgtgtttctctttcctcacttccctccctcccttccagtcttcatcctctgacatgcacaaagctgagaggcttccgaaccctcgcatggcatagtattttagggcgtcacgtgtctcctcagctgtgcagggctcccgttttcaatattcttctcctctctgacttttgtattctctttttagggactttctctagtttgtgccttctggaaagagtcttaaagccaaattatttccaaataagtgcttcagaagagtatcaagcatatcttttttaaaaagttacttgagtcacaaatgaaatattgtcatggggggcggggagagcagaatagcagaatgtcgggtggggtgagggagttctttctggaagctaaacagttaggcctgctcagcacactgtaccattcatggacgtctggaaagctactttgttggctttttaaaaaatgtaaaaatagcaacaaaagcacatcatatgattcagtgctccagggccaacttaaacggacatgggccttctgttttctaggaggttttctaaccagtgcctcttggctttttaggatggactcgtggtgggctttaaatttccccacagaacagtgccaagttcatttggcaataccagttgtctgtgtggtgattcttcattatcatgcatattccttctctgtagcctgcaagagtttgtgaggagcgattgtctcttctgagtattcgtctgctcttgcctgtttctggtgaaactgcggagtgtgggtgctggaatttgctacacttaggaacatgattgttacgtgtttggttgtgacatttaccaaacatagcaagtgatttctttgttttctagagatggtgccagtatatggtgagtaaccttctaaatgttgggataatacatttgggtgaaaagtcgagtatttaagaaaattgttcaaggggcaggcatggtacttcatcagttcttttgaataaaataccatattatttcaagatggccagaaccttgttaggaaacgcaccacagctacagaggaaggtccaccttccactgacagtagcggcatgtcagaagtgcctctgtgggctgtgttggagcatttaaaaatcagagatttcttttaaactccacctgggtgggcctgcacaggtgctgcctgtccttttcccactagcatagtggggctccacacagggagcaaggccttcaccctccaggagacctccagcagtgtctgcagacatgtttaggtgtcccaactctagggcaggggccagggaggctgcttgacatcctgttgtgtacaggatggcccccgcagcaaagacttacccggctcagcatggccgcggtgccaaggtccagaaacctcgccctggggcttcttcctgtcttgctcctgaatcttcacgatgcatggacaacaaggggcctacatgagcaggtcgcctgctgactcacaggcatcagcctgctccccactcaccctgctccagccaatcggcccctcgatgttcctcagatgtacaagcacgcctgcactgagcagcccctcgggcctcccaccgggcctcagtcccaccgagccaactcctgacctagcatctgcagctggcagaatgatggtccgtcaaggtgtctgcatcctgatctccacagcctgtgaagatgtggctttccatggcaaaagggacttcgtggatgtaattaaattagggatcctgagatgatggggaaatgagcctatatgatccaggtgggctcagtgtcatcacaagagtcctcataagagagagacaggacggtcggcagtagagaaggagatgtgaggttggaatcagagatcagaatagtgtggggccaggagccaaggagcacgggcagcccctagaagctggaaggtgcaaagaaacagattttcccctggaacctccagaaagaacgcagccctgtagacccattttcgacttctgccctctagaactgtaagggaataataggtgttgctttaagccattaagcttgtggtaatttggggcagaaaagagcaaactcatacagtgcccttggcctgttctgtcttctctgtctggaatggggtggcttttctccaaattgtcacatgacctctccttttgatcaccttgttaagagaggtttccttgaccatcctgaataaaacctcaccaccctgtcctcaccccggtccccctgattggctgagcaaatgttattacctaaccagtgtttacttttcttactgcctgtctctccctgtgaaaatgtaaataaccctcatgagtgcagggattgtaggtcattgctgtaagcccagcagctacatacttggtgaatatttattgaatgagtaaatgagggtcccgtgtggttgcatttgctatttggcctttgcccctgggacggggcaagccagggcagtcccggggccaggtcagctccaggccaactgctctgctcctgggtcccttcctcaaacctccatccaggtgtgagccttggggtctctcgccttgacttgagaagggaaagggcttcaagacatgggtgcctttagggatctgaggtaggcaaggaactgtctctccctttcaaggactatgttcaaggtgtgatacgtcaacacaccgagctagactaacagttctgggccttcatggacattcaaaagggctactagcctttgaactccataattaatcctctccttgggggttggagaaaatggcattggagttgggtcctgaaggagtgctgggattccagtcgccgtccattggggatgggctttctcaggtaagagtgggggtcaggagtgggggtaaggtgtcactctgcagcagctggactggcctggaattgcagagcaaaggccagccaggctggaatggaggatgcatgagcagggaggcaggccacggcatgggggccacgatgccccgaagaggggtcagaattgctgggcatgctgggacgtttgagttggaaagattaagtgtgagccattcagatggtggtatgtggaggagggccatttgaggaacccagatggcatagagatgaagtcaccgagcagctgggctcaccttgggagatggaacacagggagaaaagaggagatgccaggactgagcctgaggaagtccaatcaaaggcctggcgaggacgagactggccagaggggtgtagtaaaaggtccgagaggggatggctggggctggaggaaacaagaagaggaagtacacctgagaagacacttatgtccacgggcccagtggctgtgaaggaacgaaaagggggtggtaccgttggccgacaggcaggcctctgcttcccaagcccagcctgaggtgtccttagtccacagtgcatgggaaaaaggagggccagcggcaggtgttcctaaagccaactcgctgctttccagtcaaagaagcctctcattctcagagatacatacatatgtacatacatacatataaatatatataattaatatatgttttatatatatttaatacatatttattgtatatttttatatattatatttataatacgtgtttaatatacattttttcatatatatttttttctgttaaaacatctttctcttaattaactaatgatgatcattgatgtgaattggttttttccaaaagtctttacttggcaaaataacaagctggcagtcctaaattgttgccatcagcacatcccctttcttaaattggactggcctgggggaagtgtgactgagatggtgctctccctggaattaaaggagaaggatgaccctaaacagggtttccagaggctcacagtaaagtggagggtcatttgaaaggcagatcttggttttgaccatgagtttggtgttttcagtggacttgaagctgctgagaaacatccatgaagtgttcttgtcggtggagtccgcagtggagattgcagttcgctgagtcattgattgcagctccctccgggctctggttcccagatgcggcggtgcacgtctccagtccccttggtgtgattgtttctgcctccagtcattccacattggttactgtagctaaggcttgaccagtaagtgcatgcctgccatgtgaactactcagctgtaggtcacataacccttagcagcctgggcaaggccctagactttacataccttgtagcgttgtcaggatagtcttggctcccctctgccccatccctgtagacagatggaaggctaggaagggttgatgttatcaggtctccccagcaccagatgagcgatttcattacaatggtgttttccgagtgttctgatggactgcctctaagtgaggcacgagagtagaacgatacagacttggggagagagcagtggcaagtggttctctggcaagaactcaacattaacattccaggagccaggtgctgagtaccacaggcaaagcatggtggctttgaggtcccgtccatggtctcttcctcggcccccttgatcaggctgggagataatgtctctgatatccctgtgagcgtccctggagaagtggtgtgccatgagcaggaaggcatcatgtacccccatcaacccaccaaagcatgaaaaagaacacgttgctcttagtggcagtgttagcaaagaataatgcgttcttccctgctccctcattccaagcctaagggacatcatgtgccctttcctcttgcccaggtgaacttctattagattagtgccacaattcagtgtcgtcttttcgttctgctacttcgccgttggacattaatctcccagctctcattcctgaaatcatttcaccctgcaagcttaccttccctactgtattaggttctgcagagaaacagaaccaacaagagtaggggtagggaagagaagggagagagattattttattataggaattggctcacgcaattatggaggccaggaagtcccaccatctgcaagccggagacccaggaaagccagtggtctcattcagtccaagtctgaaggcctgagaactgggggtggggtggggtgtggagtggggtgggtgggtgggtggtcatagtgtaagtcccagagtctgaaggcctgagaaccaggagctttggtgtctgagggcagaaggtggatgtcccagctcaagaagacagacagaattcacccttcctccacccttttgctctattcagtccctcaatgaattggatggtgcccacccacattggtgagggtggatcttctttgctcagtccactgattcaaatgcttatctcttccagaaattccttcccagacacactcagagataatgtttgtaccagctatctgggcaagctttagcccaggcaagttgacacacaaagtaaaccatcatgtatatcctctgcagaacctcctgtgctttgccacttctgaacagtggaggattttatgccttaggcattttggacgtctttccttgcacatatatatttgagattatttttaagatgtgggaaattgtcaaaaatgccgaattctggacaatgagggatttcatatatatatatacattcagattttttttctttcctttttttttttttttttttgaagacagggtctcgctctgtcacccaggctggagtgctggagtgctggagtgctggagtacagtggcgtgatcttgactcactacaacctctgcctcctgggtttaagcgattcttgtgtctcagcctcctgagtagctgggattacaggcacgtgccaccatgcctggctaatttttgtatttttagtagagacggggtttcaccatgttggccaaggctggtctcgaactcctgacctcaagtgatccacccacctcagccttccaaagtactgggattacaggtgtgagccaccccactcagctggatttcatatatattcagatttaaaggaagtttgtggaagtggaactcataattctgagtggtgatgtgatttctagagaattctctggccaaacgaccactatcatgatgactagttttgtgtttttaactgtgggtcctgtgaagcgtaccaaaaggactgcttgcaccttgcctcaggagcgcctcttcggattcccaaggcagacctaatgataggaatattcacactattgattttaaaatttcagaaattttaaaagtgaagttgaaagagcaagtcttcttgaagcaatcccgatgacgcagatggctccttatttttaacttaagggcgcttgttccagaactgtgcacaaactgtagctgttaccatagaaacactctcagtccagataggaacaaaacattcggtccatccagtttctctgcctcttagtttttgttgccaggatcagtcctgctgttcatcagttgtcgaggatcagtgtagtgttatgattccagttgaatttgatcaatcacttggattttttcatttctcaaatgacttcctatctgggttttaggggtggggcacagttgtgagaaataaggaaaagcatctttgccactgtggctctgtcttccctattctggtcaacacggagaagcctgtagactcactgctttttatttgatgaagttgctctctgaagatctgtctgttgcaaagggagaagatgtcagggctgggaagctgaggacggggtgagatattggtgtattagtagacctttcttatcccacatattctagattcagacttctcaaacttctgacataaagagttgagtagaatggacgctggtttagttcaatcagctgaagtgatttcattgtccatctgacttacatctcagctgttttctttaacctttgctttttatttaaatgggtatttacaacaagaaaactaagagaaaatgtaaggagtatcgaacctgtagccgtaattgcaatctgaaggtatgaggctctaagctgaccccgcgtcctggaatgtgccattgggatccctcacgactcatcaccatgggataggaccgtgggctgtccagagttctgcttgctattccagaaagcagcaggattttaggaccatgagaaatgatattgtagactgcagatttttggtataaattcaaataattagggattattcttgatatgcctcagaactttttattattgaaagtgcattgttttcctataaaaatgcaaatcgtatttaagattttcatgtgaattgtgagagtctaaatagtttctgcggcataaatgcatggtttaatggtgcctgggttgtaacagaaaagtgtttgagcaaaaatcataagggaaaaatgattcatattttatgtctgtctacattagacctgctcagggaatagaatttgggaaacacataataaataagaaacctgcatgcttgattgaacatttgctttcttcactatcaggacacgggggcatatattttaaggcttttaaaggcatttgggagagattttatataggccataaaatgcattacccctcaaaaataaaaatcactgaagaatatagttggctcacagaaaaaaaaaaaaatcctctctaattttaagctgctattagttctctttacaaaaaactcgggaaagttattttgttttgcaaactttaaccatgaccttgctttacttccatgtatttaatttcactgaaatgatatttcaaagaaaagcctttctggaaattgtttttcctttaatacccaaaattggaacaacagcactcacaggagcgaggctccaaccagtggatcagctgtttggcgtggatgtagaagaaggtgcattgaaactcagtacatctgtgtttagccttaggcaggaagtctgtttcttcaagtaaacctaacgtactaaagatactccctgcagatggctcgtttccggcccacggcaaggtagacaagtcatacggttttaaaggcaaagccgtcttgtctgtctcatggggacataagaacaatcgattgttgaaggaatcctagtgcttttggcttccagtacagacagacagacagatgtgcctctctcgaccttgctgaagcaggccccaaatgttcacacctagaacatggggacaaagaaagaaattgaacttttcaatatgttccagtttcttctagattcatatatagctctgaaatgaagatgagattgtttgcattgttgcattgttttgaaattttattattaaaccccacaattggaaggcacagaaatgtttgcctagcattcagcacagcccaaacatttccagatgggttgcagattttgtttctgctggagaggtcgtcccttgccgtttgtccttgcatatttttcctgccagctgtgggaagtgacaggacatggtttaatttgggctgctgttctgtttctttatgcctgcagcagacaggtcttttgaaactcaccctttgcctctcctccctcctataattcatttttttcctcattctttttttcctgacagtgcatattacttgagattttcctggaaaggttgtgattatctggaattggatcttccgccaccttcaacagcttgaatccttgtaggctagcagctaacctagagctggcagactcaaatggaatcttgatctcttcatatttaaggctcagaaaactcaaaaggagtgttctgtaaaatacttctgtttatattatatgtatggtaattagtatgagtataaaatggtcgggcaaaatttagctgggctcagactttcctgtggatcagataaatggaaatgaaaaaaagtatgaggacacagatttgctgattgttcttcatcttttatatttatttcttaacttgtcttggtctactgtagaatgttccagaaatgtcattgggtataatgtctgatttagcactgacttatttgtgggtttgcttggagtgtattttccttgggctttggatatatgactgccataaattttaattacactaattagacgtaggtggatgcttaagcccagttggagtcctagccctgttcagctgcctctgtcattagtttttctggtgacatggtttggcaccatcttccaacacgttttccagacattagttttaagttagaaaataacttgtctaataaagctactgacattcaactagtgtctttaccttgttgaagtggacttgagtaaaatgcatacatttaaactgtaacttgtgtacccgtttctttccttaactgtgggctttcagattcgtttggtggctagagagggagtcatgcccgatcctcatgagtccatgtgctcgtgtctagtttaggtggagcctgacttggcacaaggctgggtggcaggttttaacatgtgtggcaatgctagtcaattggggatatccacatggctcatagtgtagagaaggcttctgaggtctagacccagcaggtgggaagccagccttggttagtgccgtggaccgcgggcacaggaggaggcagtctcaggagcacctctgccctgcatctccctcggaggatatagggccacgtgtgcctgccacttccctgttctcacagctctttgtgatctcagagaagcctctggattttgtttttgggcgagtatgccaactatgtcctccacagcatggggttcaggttgagtttgccattcctagtttctccctagaaacatatccctgatctttaaccctacttaaagggcttaaaacattctactcttacttttaaaggatgctttaaaaatacaggccacatctgtttcacttaatctgcattcaacagcacctcatgacacaaaaagtaatgcagtctgtttgccaagcaagcacttggaaatttcgaggcatggaaactgataggagcctctgtttttccaccttgaggattgttgcgctttgcatccacccagatcatctctcaccagcatccatgctcacagggctgcctctcttcctctcacatatttgcaggcgtgtttgttcactgttcaatgcactcagcttttgtcgagtgcccacttgctctccgcaaggtgttttgaattcatgtatggccaggggctctggtgcaggaaggagcacacagaaccagaagacgcggagcatggggcttcgaaggtctttccttcaggacgccagatgatgagtgcatttctcctttgttattttgctaaagcggctgacagtggttagacacagctgaggaggcgggaggccggcagcacttctgggggtccagcatgctgtttagctactgatgagggtgggcagaagaaacaagcagactccctcctgctctgggacagtttcatgtaggaaaccaggagtctgagccgccgagtatgggcatgttgagggctgctggcctttttgtcagttcttcggaacaggcacgatggggttattttcatctcgaatctcaggctaagggagcttcaggaaaagacttctgcaccattttttaggacattgtttccatatccttttaagtgtaagggtcacttggtgtaatcatttcactacttatttggcaaaaggagtttatagaatcagtgtgagacgtggagaaggtgtgaagacggcgttttcagtccgccgatgtccttttttcctccccgtctctcttgcagagtcgccaacatccagcagcagctggcccggcttgacaatgagtcctggccaagcacggccgaggctgacagggaccggctgcagctcatcaaggagaaggaggccctgctgcaggagcttcagctcatcattgcacagcgccgctctgcgggagatgtggcccggctggaggaggagcgggagcgcctagaggaggagctgcggcgtgcacgggccacctccgcacagggcgccacggagaggtgggtcagcggggacacgacctccagcggaaagcctgctggaaaaactccacggggtggcttgtgtgtggctggagggtgttcctgatgatcactcagagcctctcctgcctggatgttccctggcctaggaggggcatgcggtggggggcactgccttctgctccctgggtctctggagcctctgctccgaagcaggaggtgattgacaagggggaaggagtgagggaagatgggtgacctccatctccgcccacgccccacccttcctgaagttggtgcttggtgcttccacctgcctttgtgggacagtgccctgagcaggctgtggtcccgctccggcccgggcagctctgttgcatgggggaagaattccctgttcctgacgtggtgagcatggtgggtatccacctactgctttcctctccaactttgatttctagccaggagagcctgctcttctctggcattgggaagctggccacctgtcgtgcgtctgtcctgaggctccttcaccacgcaggacatgcaaagccagcatagtggctttggtattcggtggcactgagtcgttcagcctttcctcgtgtgccgtgtgtcctggtttccatttgctgtgtgagactgcagattgtgtcaaaggctgggcctgccttccacacttaacagcagtttctctgtggctatcagctgggcttttggagagcagcccctcccccacgtgttaaagtcttgcccccttgagctcacatgagcagctctacagagactctaatagatgcttggatgattcgatctgttcagatgctcttactcctactgtttcacgatggttgtattgttgggcgtcctttatgcttgatgttcatgggtcatcttcataggagacaagtctgtggcttggcacgaggggctcacggcagcctcagggaagcggtggtgtttggagagttgagctcagagtcctaggcaggtgaatttcattttgcctgagatggtggcatgccctgtcacctcacccggaatcaaccgcgaggagaatctgaatgtgaaagagctcttgcacggctgcgtttgttttcagctaaacatttccttctgttccacccctggtattcttgtatgtgtgttctgcgtaggagggcctgggagttcctgttgcttctctgtgaaggggggaggacttggccccacaaatgtcgcctgcatctcagggccccacacccacgctcctttgactgtggctgctgtcaccatgtggaaatccagcacacacgagtgctgtggcccctgagtacaagtctgcagccctccatggagccagtgttagccccgatgcctgggttcaagggtggggacagcaaagccggaccagctttgactcccatgggggtctctcgtgagaccagcccaggtgctgagtcctgggactcagagccctcgaccaggacctaatcgccccaagcgtgtttcctgaatctgctgctaaatgaccttggccggaaaagcacatccacatgtgctaagcacttgcacgcacatcgcatgggggtggggctcttgtagctctgggctttctgtgccggtacacgcagggcccatttctccactccacctcccttcattggaggggtgtttgcagtttgcaagtatgaggccacatggtaggaggcttcccccagcacaggctggcagcattaggagacccggcgtgggccaggtgcagagagagagtgaggttggtgccttaaggctgagccgtgccagctgtagagctgggcccagtctgcctgtctcacctgcagtgtcatcagcagcaaatgggaggcgtttgccgggctgggggtgtcatccgggggagaaagagagagatgcgcacctccttcaggcctcccgccccggcagatgatacgtgcggcggcctcccagctgctcagagccagcatctctggagggagctggtgcacgtctcctgggctgagggagcaggcttgaggtgaaggacacataccctagataatctctcggatggctcgtgtcaacgcttgcaacatcctttgctattttagcttgctcatgttagtgtgtggcaggcatttatacaagatgctgatgttcaacagagaaccccacggctctattacaagatgcctgccatcctgagaaattctctttccaaggatgactgcttttattataggggtgattataaaatgaaagatctatcaaaaagcaaaaattttgttctgctgaacctgaagtcatgttttcctttgtcataatttaatgacatctttacaataaagtactttatgtaaagtaaataaagacagtaaattagactttatattttcttaatctgttagcttacttttctactccttttcatagcagtggtaaatattctttgaagttcgtttcatttgaattggagacacaaggctatgtgctttaggagttgggccctggccagttttctgccaggaaactgtatccccttttctttttgttgaaaaaataagtacagaagtcaggcaaatgtctaagactcttattttagcagtttatgttccagccagttttttagatgtctcagttattgccagcgtggcccctgtttggtaaggaagttacatttttagtcatctgcaactttcagaataaccagcataaaattagactgcaaatgtgggcagtcatgggcacttgtgtgtgatcttgtatccagatgcgctgtctcttgtgcgctccgaaatgcacctgtttgtataatgacaaatgtgttgtattggatagaaggggggaatttgatctaaaacttttttcactacagataaaacaatctgaaaataagtcatgactaaagacagtctaaaaccgagccgtacatatgaatgtatctatatgtcatatgtgtgaaaacagagctggaatgcgctgacggatttagcgatgggttggaaattctaccctggtcactcaagagtggagccagttttcagtaggaactcaatttagattctattaatttgggatttgagctaatagaattcaggttgggttagaatttctgaaaagcattaagaaaaaagttagtagccttggaccgggcttgggtaaattccctacaacaaatggcttcttggagctggtcactgtttgccactggatacgctctgctggtgtcgtctctgcccctggagtcctctgtgacttaatagtgtcccggtgcttgtgagagtgggttccaagttacagctccaaagctcaatgaaggatgtattttgaactcacttttaaactccctttgaaaactctcggctctccatcttctgaaaaagatggggtttttgaggatatcgcccttgataagcgtcagataggatgtgagtatcacagaaaattggggaaatgtttttcagtagtaaaggaaatgcctgtttgttggtagtgtgccttggctttagggtcaatccagcctgaccgaactttgagcttgcgtagcagacgcaagctactttatatgagtttcttcatctgtaaagcaggaatagaatccaaagaccagtaaggaatgaggcagtgcatagaaagcagtgtgcctttctataagcccctcagtggaactttttttttttgagatggagtctcgctctgtcgcccaggctggagtgcagtggcacgatcttggctcactgcaagctccgactcccgactcccgggttcacgccattctcctgcctcagcctcccgagtagctgggactacaggtgcccgccaccacgcccggctaattttttgtatttttagtagagacggggtttcaccgtgttaaccaggatggtctcgatctcctgacctcgtgatccgcccgcctcggcctcccaaagtgctgggattacaggcgtgagccaccgcgcccggccccagaattgctttttaaacgttactttcatttgtacaagctatcaaaacattttccttaaaaattaaaatatcataggtaagtggaatcttagaacattctactcaagagtttattacagctgttctcaaacattttggtctcagaacctccttccgatgttaaaatgctgaggatcccaaagagcttttgtttgtgttggtttttttaaagttcttttttctaactgttttgttttgtttttcatttttccccacccagggacctatcagtgtttatgtggatttttatctgtcagtatttgctaatttagaagttagcgctgggaaatttttaaaatatttatttattaaagataacaataggccgggcacagtggctcatgcctgtaatcccagcactttgggaggccaaggcaggaggattactttagttcaggagttagagaccagcctaggcaacatgacaaaacctcatctttacaaaaaatacaaaagttagctgggtatggtggcacatgcctgtggtcccagctacttgggagcctgaggtgggaggatggcttgagcccgggaggtggaggtggcagtgagctctgatcgcaccactgcactccagcctgcacaacagagcaaggccccatctcaataaataaaaaaagacaatacaaaccctattatgtgttaatattagtaacatttttatgactgataacttttttgaaacaaaaaactatagtgagaagagtggtattatttgcccttgctatccatctctttagcgtctggcttgctagaaggcagctgctttggccattggtgcattcggcctgttgagatagggtcattttgagtgaacacgtgaagaccatctagctgcttaccgatatgccattgggaaggaggggacctcataggacccctgaaggagttttggggatccgccaggggtctttggatcatgctttggaaaccattggtttcaatatatgatattgaacttgaaagtgggttgtgtcgtggctccatttaggacgatgcttgttactctcttgccagctgacctctgcatggcaccatttggaattttgtttgcatcaagagaaacaaaggctcatcagaatttatggcatgtggttgaaacttgtaaacaaactcagactggtttgtcttccttatcctaagttggtggcgcatctgtttcctttatgggtgatagcagctctttgtcaatcacgtgtcatctgccgtacattattttatctatgcagcatcagttccctgagctggagattgtggactccatttttacaggtaatgaaactaagggctcagagagggtgagacatttgcctaaggccacacagcttgtgagtgactggccaggtgggattctctgaatcccaggctgctgtcagacactgtgtctggtttcctctcactcccacctagccaagctctttaaaccccttcggcatgtccccttccctgttggtggaaagaggaaggtattaaaggggcctactgtggccacacgtcacagtgtcatttccatttgtaaaccaggagtgtttccttctagaggcaaacatatttattcatggagttgtccaacaactgtgtattgagtgcctatccacaataggctcgattctaggcggtgggcctactgcagtaggaataaattttattctacaaaattactaagtagaaaaaagtagaaggaaggaaaacaaaaatacctccaaccccatggcctggagatggcaacggctgctgttttgtttcatttgcttctaatgttttaactgtatagatcttagaattatatttgttcttctctagaaggtggcctagtatgagggaatctgatttgttccaaggaatttcaacagatgactgcgtgctctgcgtttgagctcatctgctagttatctgtccttctgctcacttaccactcctcccatccatccaagcagccatccccagccacccacccagccagccatctagccacccacccagccacccacccagccacccatccagccacccatccagccacctacccagccagccatccaccaacccagccacccatccagccacccacccagccacccagccacccatccagccacccacccacccatccagccacccacccatccagccacccacccacacattgacccatccctgtgcccactcctcttctcacgcatcccctcccccgtgcactgtgcctggcgcttccacagagtagcaggcactgctcagggtgccagggatgtatttttcaaacgggacaaaagcagtctctgtgatcttggcccttgtgacctgggtgcttttagaatgggtggtgattgcaacctaattcagctggagggaattgatagtggactgtcttgttatgaaaatattctccctgtctttgaaatgtactaatcgactgtcttcttacctacaggattctgcttcaggaaaaaaggaattgtctacttatgcagctggaagaagccacccgcttaacatcctacctccagtcccagttaaaaaggtaggttactttcaaagagaaaactgtacttgttcatcatgttccaatgactggtacatgaactcgtttcttgtagcttgacctgaaatgttgttaacacagaatggatacattatatttttaacatgctactactgtatgactcaaggaatatggagagaaccacatttggcttcagggtaaataagaggcctgaagtcagatgtattcaaggattttgtaacctaattaacagtttcagaagtgtacatctatacacgtgcgcatttttgttttgggttttttttaaaagcatacgaactttttaagctagtaagatttggctgctcaagaatggccaatgtcaagggcctcagatgtgtcattttctcagatattcctcctaacaatgccccaggtgggaactgttctcaccccagccccagtgggagcccagagggggtgaatggcttgaccaagtgtacctggctagtatgtgttccagccaggactgggactgggacttgggcacgggtctctgctgttgcccactgctctctgccaccctttccgtgctcacagggtgagcaggggtggctgccctgccatctcagatggccatgctgtctcatttcagcctgtgtgccagcaccctgacggtgtcctcggggagcagccgcgggtccctagcctccagccgtgggtctctggcctccagccggggctccctgagctcggtcagcttcacggacatctacggcctcccgcagtacgagaagcccgacgctgagggcagccagcttctacgcttcgacctcattcccttcgactctctggggcgagatgctcccttttcagagcccccaggcccctcgggcttccacaagcagaggcggtccctggacacgccccagtccctggcatcgctgtcctcccgctcctcgctgtcctcgctgtcgcccccaagctcgcccctggacacgcccttcctccctgcctcacgggactcgccgctggcgcagctggcggacagctgtgaggggccaggcctgggcgccctagacagactgcgggcacacgcctcggctatgggggacgaagacttaccaggcatggcggcccttcagccacacggggtccccggggatggggaagggccgcacgagcgaggacccccaccagccagcgctcccgtgggtggaagtaagtgcggatgtggcctcctgcggggcgagggttacctgcagggcggaaactgtggggtccagagtgaggatggctggctttccaggtccatggtgagctttacgtttaggaatattgatgtgatcgggaagagcacacacctgctctttctgatctgtgttggggaaagatcattgaaattgacaaagttgtctttcctaggtatttggcttgttttcaaaaaatacttaattgttgaaaactagggtaagaactacacaggcttccacattcagaggctgctggagatggattagggccttcatgacctttgcagcgtgcgtgccgagatggaaccgtcagtgtgtgcccgcctgagaccattatgccaacaggtgtctggttgtagctagtggaaatcttgacttct

SEQ ID NO: 2981 - DNA, 74367 bp, human
taagtcacttatgtttttacctttttaaatttcagaacttacccagattgaggatccaagagaacagtggaggcgagagcaagagcgcatgttgaaggaatatttaattgtagctcaggaggctctcaatgccaagaaagaaatctaccagattaagcagcagcggttcgagctggcccaggaggaataccagcagctgcacaaaatgtgtgaggatgacagccgctcgtacgccagctgtgagttgacttatctcctgttaaaagccattgtgactttaaaagccatctctctgctaggttacctgcaaacactgaaccttccctgggcaagatagcttcataaaggttctaatcgcatactgttaggtcatcagtatttggcactgaaatcaggtgggcacctggcagccactcctgtagcaaggatttatcaaatgcttactttgtgcccagacactgggttatggttggtggtgactaagaaaggaaaggtctctgcccttgagctcacattcaggtggggaaggtaaaaaataaacaagaaaacaaaatttcaggtagggatgtgtaccagctgcctgtctcatgcatgtcagttttgaagagggcttccctcagaaatctctgcagttaacactgcttgtctgggatgatctcttgggaaatccacacagtggcttcattcattctgagtgggaagactcaggagacctcagccatgtcaagccccctgtctctttgtagagttctcctcttgggctgtaggctttagtacgcagtacagggaaggaggaggaacaccatagaacccagagaatcggaggactctccttctgcccctcaggtgagatgaccatgtacagcttgctgttctctaaagggacctctctctagttttggaggctgccagagtggggggcttcatttcattagtactcagcaagtgcttggtgttgaagaaaccaggtccactctcagaacccaaagcattttgctgtggacacggtcagtcaccacatgagccagttccttcccagcagactttcaccctcaacagaccccaacagatgtgcatgactgtgactggcctgggcactcgtgagcttggaaagaatggatgaaagttggtaccactgggttgaattttataaaaacctgtctgtttgagacttggggcctttcctgtgatattagtgccatgttgccatggcagatattaaacacacagctatagctttattctgtgttgcaagtcagaatggaggtaaggctaaggggccacacgttttgtgctctgttttattgcggcaactgttgacggggcagaagccttagaagctatggccaggagtggggtattccctctgcaataggaattgaagatatttctatttccgtgtgtcttgagggaaacagggaactcagttttactgatgtgttgcttccaagccatcttatctccatctctgcagatagtggcacatacctggttggtttttttgagggctttgttttgtttttaacttcccatcagattgtgataggtcagctatgtgtggagttttagaggctggtttcttatcttcacagtcatcttttcttggaatatctttctctgattttggtatgagggtaatatactggcctcatagaatgaattgggaaatgttccttcctcttctgttttctcaaagagtttgtgtaggattggtattagtgctttcttaactatttcatagaattcaccaaaagagccacctggacctggagttctttgtggaatgtttttaactacaaatccaatacttttaatagagaggtatccagattttttgtttcttcttgaatcagttttggcatttgtgtttttcagagaattgtcttatttcatctaatctaaaagtcggcaaacttttctatgaagagtcagatagtaaacattttagactttgtcgaccatatgatctcagtgccaacgattctaccctgtagttatattgcaaaagcatccagaaacaacatgtagacagatgtgcctagctatgttccagtagaagtatcaaaacaggtagcaacctagatttggcccacagggagtttgctgcccagtgatctaagctgtcaagtctatgaagttgtttgtagaattcccttattagccttttaatgtctgtaggctttgaagtgatgtcctctctttaattgctgatattaataatttgtgtcttcttaatcagtatagctaaacttttattgatttttatctatctttacaatacactggcttttgccctgttctcccatttcttgtctgtttctatcttactggtttttcttctttattatttctttccttctacttagtttggctttaatttgttcttccttttctagcttcctaaagtggaaatttagatcactggttttagatctttcttacttcctcatatagccattaaagataaggattctcctctaagtactactttaactgcatctcataaattttgatatgctgtattttctttcagttcaaaataatttctcctttttttttggtggtttttgacccatgggttgtttagaagtaagtcagcaggactttttaaagatgtcatgttgttgttgatttctaacttagttccattgtggtcagagactatgtaacatttcagtcttttgaaatctattgagattacttttatggcctagaatactggttttttttttttttgagatggagtcttgctctgtcgcccaggctggagtgcagtggcacgatcttggctcactggctcactgcaacctccacctcccgggttcaagcgattctcctgcctaagcctcctgaggagctgggactacaggtgtccgccaccatgcccagataatttttgtatttttagtagacacgggattttgccatgttggccaggctggtgtggaactcctgacctcaggtgatccacctgcctcggcctcccaaagtgctgggattataggtgtgagccaccgtgcctggccagtctttttgatgaccagaagcccatgggcttggtgccttgatgtctccctagctgaagcattggcctataacctgttctgagattatatagttagcaattctaaacatttcagaaagctgcttggtagaagttgggttgaatggtataaaattgctgtttttgtatctagaaaagggctgaatattggctattcttataatccaacctaatagtgtgtttctttccagcagtctttgggtaccttatcttttacatgcttgcgtttggttaggtctccaaagaggctctcaaatcagtctttcaaagaatgaaatggaagaaatacatatcagaaaaacttggcaggatgtttcttgccagtgattgaaaagaaaaattgagaccaggtacagtggcttacacctgtaatcccaacactttgggaggccgaggcaggaggatcacttgagaccgggaattcaaaaccagcctgggcaacctagcaggaccctgtctctattaaaaaagaaagaaagaaaaactgagtctagagaaagtgtgtattatgtactggctaccaccagtgcagccaggatgtcagctgcagtgactgtggggaccctggactggatgccctcaatgatgcagacattagaacatcctgtctgattccacacccactctgaggggcagtgaacggggaaccccaatgcagtgccaagctgtaggttaagagtattcagtacttcagcatcctgagttgctaaggatcctgcaggatcaggttttgtatttccatgggcttttcacttctttgatgtttgggcaaatagggaattctactcaattacatttctttttgtgccctatgggattttattaatgctcgtttaaaaagatacactcaagaggctctttttgaagtggtatctgttccttcagtagaggaagctgatgactctgttgttgacttgaggttctaaggtgctcaccagattccatttcctgacctgctggatgtctctgtgtggatacgatctctccctccacttgtgtaggttgccttcgaggccaaaagtgggcctgcctgttttcgtgaaagggctggagatgccagtgggtcttcctggggcctgtcagctcatcagggaaaaagccaactctgaacggaatctaggagttgatccaagtgttttatcaacttgctgctgtccctagggctcccaccaagctctctcaatctgccatttaacccgaactaccaggtacaacaaggaaaaccctgctagagtggactcagatgaattctttctggccacaggataaagtccaatgcagtgattttgttggcttgaccatgatctaacagatggcttctacagccatgccagagggcctgggcccatgttgggagctgctggtggcagtttccatagcacacgttggctgtgtagccacacgggtctcactgcccagatctccctcagtgccagtcatctaaagcaggaggcgtctcctttttctgatactgtgaacagaataacatctggacttaattcccacttctttcttcatgggtaatgacttgaagtgaaaggaaccgatatccaatgagctggtgttttctgtgcattgttgtgatcacagtgttgtcaagcacgtgctgttttctttattgttcacatgagaaactgaatatcagggaggctaaattatttcttcaggattacatacccagcagatggtagaagttggatttaagcccagatctgtttgtgttggtggccttcagtgctctgtacggtttcctagacatggaagaggccactcagaacagctgatggtgtttgtggaacccctcccccatccaactttcaggttatctgaaaataaagactagttataaattgacaagttgtcgggaaattttgcagcaataaagggggcaagtggaaggcagagcactttctagatcttgacttttccatggcccatgtaagatcactaaactgttcatttatttttcgacagttagcacctgctgttgatatatactaaatggcgggaacatgttttttttgttgtttgtttgttttgttttgttttgtttttcgagacggagtctcgctctgtccccaagctggagtgcagtggcgcgatcttggctcactgcagcctctgtgtcccgggttaaagcaattctcctgcctcagcctcctgagcagctgggactactggcgcatgccaccatgcccagctaatttttgtatttttagtaacagggtttcaccatgttggccaggatggtccctatctcttgacctcgtgatctgcctgcctcagcctcccaaagtgctgggattacaggcgtgagccactgcgcccagccgggaacacgttttattcctaatggttgcttgttgggaaagatgaggcaataatgtgtgaacagaggaattaactggaacagccatttctaatgtgggagcagaaggtagggaggagaagtgcatctcacctatacccctcacacatttccctcgagctatggaaatcaccagaagaaaacttcatgcattggagaggaaagattttgtgtcagtattgggccatctggtatctaagaacatccgtgccttgacctgaaagcaaattcagatatttggctggatgctttgcacacttgtctgcatgagagtaggaacccaaccctgcttgatttcaatgagcttctgtgctagctgcctggtgatgcccaggcctcatttatgcttcgtagaacactggggtgaaactgctcaacaatggactcattctctctgagacacacctgctactttttctacagctccattttgtagagttttcttctactttctttattgcaacatgttcttctatttgcctgccttttaacactgaatacgttcattatctcagacacattttttcctggagttattcctttattcttcctgagaaactctagccccaggcacattcagatgaactatatatgaccatttgcaggatcttttggaagaaattcttgcatggggtaggataatagtctaaacctcaggtctgcaaactatgtcaagcctgtgggctggatcctatccactgtgggtgtttgtaaataaagttttattggaacacagccatgtccatttagtaacctatcgtctgtagcagctacagtggcagaattgagtatttgagacagattgtatggcccacaaagtcaaaaatatttagggtctggcccattagagaaaaagtttgctaattcctggtctatacccatagttctcagacctggctgcaagctagaatctttaaaaacttgctgcttggacctcaccccaagagattttgatagaactggccttgggtgggaccaggcttttttttttaagcttcccaggtgatccccagggttgaaatccactgggctagacagagtgtgaatggcccttgtagcagcaggaatatgactttgtttattatcctagttcctaggagttactcaaagtctacattgaaagtctttctgggtggctaggaaagaggcagcgttatctctggtgagaaagtgctgatccaccctgagttcttggattaggtggtggtgaagcttgaccttatcagccatcagccttgccagcattccttctgaggctccaagcctgtctcacaatgactcttccattggtgctctgtttttttttttttgtttttttgtttttttgttgttgttgttgttgagacaggatcttgctctgttgcccaggctggagtgtggtagtgtgatcttggctcactgcagcctcaacctcccgggctcaggcgattctcctacctcagcctcttgagtagctgaaactccagatgtgcgccaccatacctagctaattttggtactttttgtagagatggggttttgccatgttgcccaggctggtctcagactcctggactcaagagatctgcccgcctctacctcccaaagtgctgggattacagatatgagccaccgcacccggcctcattggggctctcgctgttgaaggatttctcatttgctgtctttggttaggaacagggctacaggcaatccattccaattcaaccttttgttttccttcacacacgcatgttggagcaggcaggagaaaaaaggatcatggagcatttttcccatgtattagtcagcaagccagattttggaggttgcagcaaagcacatgtgtttcctgagaaataatcccctagtctgtcctggagggagaattcctggttaggatttggtggcttcttgggttacttctgtagatcacccccaggtggccttacttgattgtttttggtcttttgcttatattgccttaaaaaaaacccatcctgcccgctttgttggccttgcgtatttctccatgtgcctctctggtagatagtacctgtcaacctggaacctgtcagggcttgtcggccttttgcccagagtcattcttggctcccttgagcaactcctgacagtgctgatccctggaggcctacacctggtcctaaggagcaacctgctccagaggatgtctttgaagaaggactgctggtcttttaaagcatgtcttgtctctggggtgaccttaggtacccatagctcagaagacgcctgtacataagagagacaaagacaaacagactcatggacacacacatttcccctttcagtaatctgtcaaactgaaatccagagttaagtactggggtttgcagcattttgagtcctaaatacacaggtcaagttcacctgttgggtggtgggcactggggagctggaggaccgtttcttcttctgggaaagctagcccaattaaaggatctttggcagctgacccaccggagcccagattctagacatgaagccctctatgaatgatggcataatgtattatagatcaagtcactacagactcagtcttttaatctataaaatgggcaaggacacataagtatcatttcaccttcacaaagattttatgagaatagattaaataaatgtgaaaggcaccctgtaatagcaaggtataataatttacattgctgtggtccagctaggctataaccttgttattatattatctgaggcaatgttgtatgcctgagcagactccatatgctatttaatagctctgcccacttaactcttcaagagagaagaaagcttcagaggtgaaagtctggtctttagcataaacctcgagattggagacatgtcttaatagaggaagatactccgtttataaatgttgtggaaggccgggcacggtggctcactcctgtaatcccagcactttgggaggctgaggcaggtggatcacttgaggtctggagttccagaccagtctggccaacgtggcaaaaccccatctctactaaaaatacaaaaaattagccgggtgtggtggcggcgcctgtaatcccagctacttgggaggctgaggcaggaggatcgcttgaacccaggaggtggagtttgcagtgagctgagatcacaccactgtgctctggtttgggtgacagagtgagaccctgtctccaaaagaaaagaagtgttgtgtagtacacgctattatgaggtctggagtcctgatctgttcttggactctgtaaatggttctagtagtcttattggcagatctgaggaactgagaattttatttataaatttaattacattattaaaagttatgccagtgttcacaaccatccttagtatttgaagataaaatgtattcactgtgttagttacttgagtagacttttcccttatcccagtcctggaattttataattttatagagaccatagcaaaagtaacatgaatgggatccacataattaaaaggtattctgtcacttatgatggtttcagctgcagcagagaagaataattctcatgggcctagacaataagaaaattcattgtcacatagcggagtcctctggaggtggggtgggattccccataggtggattcagtgactcagtggagtcattggtttgtcagtttccccctctaggagtggatacatgctgagtctcttggggagaggtagctacccaacacttccggggttctggtacttaggaaggagaaatgggggaaggttgccgtgtagatgtccaacagtatccaagacacctcccctgcgtatttcaagtctctttgctaattttccttatgaaactgcatagacagaggaagattggtacagatttttttttttttttttttgagacagagtcttgctctgtcgccaggctggagtgcagtggcgtgatctcggctcactgcaacctccgcctcctgggttcaagcaatcctcctgcctcagcctccttgagtagctgggattacaggcacctgccaccacacccagctaatttttgtaattttagtagagatggggtttcaccattttggccaggatggtctcgatctcttgacctcgtaatccgcctggctcggcctcccaaagtgctggaattagaggcgtgagccacggcgcctgaccggtactaatgtttagcattgcagtgaactttgttgaactttggtggtaggcttactttctacccttaatgggaaagatcccaggtgataactcttgggcttgtgttcctcccactgcaagttgacaagttgacacatgtgttgtagtgttgtaagccaggattcagcaagccctaacctcatagcctcatttgcatattatctctatcccaagtgaaagaaggcctttaagctcagatctgggaaacttaaagtcccaggagtttaatatggagatgttttctataagttatttctgccttttaaggacattgttggagatgttgctttcattactgattttaaatgaaaccaaagagtcaggcaagatggaagatgtaggatttggaaataggcagtcttgtctaagaaagaattgtttgtaaaatattttactccatgtctttgagagatcatgagtctaagtataagaaaattggagataaagttggcaaacatttagctcttccagttgtttatttccagtagattctgttgtttgaaattctgactgaatgggacttaaatagtagattttccatagaactgttattaaaataggagatccaactgctcaagtgaactttggatgtggttctaattgaggtttgaagtaattgtgctgttgaagctactcaatggtgttgagccatcctctgcagtacatagtccacaaatgattttgaattggtttctcattgttggcacctgagttatctgaatgacagccagcctttgattctcagatcaaaggcgttaaagaaaggactccgtccctgcagatgtgtcttctgagcaggtgatgttaatgacaatagctgggaggcagagggcaccagagtggggtggttcacagatgaagacagaccagcattccactagctaagcagaagaagggaagccatgcagcagtggtatagagcccatgccttcagaaacctaaagaaaggaggcagaagcatcaagaaaaagcaccgcagagcggtggatggggtggtagaaattaggaatagccactcgctgctccagcttccgtaacactggaaaaagcttgcagctctctgtgtgcacagaaatttgctgactgtgcctagcgtgtaaacagctctgtggctcttactcatccctaggtattggttactcacgataatgatgccatgtctgtaaaaagactttaaatcatatacactgcactgtttaggaaagcattgaggtatgtgatgtcttttagctaaacattcatcaaaacaaattattagagtaaaagcacgagtgcctcacttcagtttctgggacaaacaacttgggggcccatcttttttctcaagcctgccagatcctgacgtattactagaaatcttttttattttacaaatttctaatgtttttttcctttcttgtgtcaaaaattgttcatccggagaatataagtgtgaagaaaataaaaataaaatcatttttaatgcagccattgagaataactgcagttaactttttggttctatctttccagtgacgtctgtgtgtgtgtgttttaaaagaaagtaaaagtaggttcatactgcaagtactattcacgtattaagtacagtttcctatgtcataatcacacctcttccccctcaccccgtacccccgctgtgtctatatggtgtttaactgtagtagttttatagtagaactaaacagagttttgattgacctacagccatgtattttattatatgggatcctatagaaagtcctgatgcaaatatcaaacatcaggaagatttgaggatgttaaatgtcaattctttaggagccagtgaccacttgtaaatcagagatttagagtcctttaatgcagtaaatcagaagttccttgtgtgtatgtattttgaaggatccattataaaataaaatattttctttctatttagcattctctggatattcaacaaatacaaagtatgacccacaccaaattaaagcagaaatagcaagtcgtcgggatagggtgagtaaaaccgctgtttttacaaccaggtggacggaagcctggggccttatagcctaggccgctggtgttctactctggttgactcctcctggagggatcgctagcagtgttagactggaagagttctgagggttctgatgctcttccctggtgacccctgaattatctatgtgctaccatgtttcgtctcttcagacccttgtcttggttgtctgggaagggaaacacttttgttgcatttgggacaaagcacaagaaacatcttggcaatgaagcctgctcctctcttggtgtgtcattccctgaatcagggtgtatcttttagtgcagtggttctcaaattttagcacagctaagaaaaatacctgggagcttgttccaagtgcgagcttccaggcctagcccctgagttttgacgtgggcctggagcgggtcccagaatctgtttaaagaagcactccaggagccattgagtttcaggtagtcagagagctcgcttctggacacaaagtttcatgtgcggggtctgagaggagtgggtagaaggaaagatgaagaatgcgttacagaagttgccagctgtaatgtggaaaccttgaaaatgcaaatagttgctggttccccacttgcgtaagagtctgtcaacaatctgggatttttgtatctaagcacagcaggtcttctagaaaggctgcttcttatgcatgtgaatggaagtttgtagtgagaatagatgatcttatgaactgcaagctgagtagaaactcagatgacagtgctaataacaactgtagaaatcattcttcacagctggtttttgggaaaaaaaatgtgatttgtctttagctttccagattaaaacgagagctgacccagatgaagcaggaactgcagtacaaagaaaagggggtggagaccctgcaagagtgagttgcctggacacttgtcccaaagcttcatgcccttcactttcatgcctttatttatgctcatgattttccaatgctaacttcagaatctctcttttccttgaagatatttcgttgctttaaatggaaatacttgggaaacaagacctttatttttatgtttatgcacgtttactatagctgtgcaagacactcatggctagttacatttaaatttgactttttcttagttttagtcttttaaattttttgttctaaaattgacatttaaagtaaaagaaaattaaaagtttagtttcccagtctcagtagtcacatcagaagtactcagtagtgacatgtggctagtgcaggttttctccaccacttagcactagtgggatttggggctggatcattcttgtcttggggggactatcctatgcactgtagaattgtcttgtcttggccaggcctggtggctcacgcctgtaatcccaacactttgggaggccaaggcgggcagatcacctgaggtcaggagttcaagaccagcctggccaacatggtgaaaccccatctctactaaaaagacaaacattagccaggcgtggtggtgcatgcctgtaatcccagctactcgggaggctgaggcacaagaatcgcttggcgggcacctgtcatcccagctattcgggaggctgaggcagggagaatcgcttgaacctgggaggccgaagttgcagtgagccgagattgcgccattgcactccagcttgggcgacagagcgagactgtctctcaaaaacaaacaaacaaacaaaaacacaaagaatgttgtctttactctttacccgctagatgccagtagcaccttccacctgtattgtgacaaccaataatgtttctagacattgccaagtgtcccctaaagtacacatttgctcccagtggagaaccaccgtgctggtggctactgtattgaacaccataggtgacagatttccatcatcacggaaagctcctttggacattccagtctgtaggtcttcctcctgttctcatttttacaataagaacgttatccctactaagagattggggatgaattgtttacaattagtgagctgtatcgagtctgcaggtttcatgaactaaaggtggtgtttgagaaatggtgctggtgtgggtctgaaggtttgctgagccgttctctccattcactggctttccttgctgaacttgcgcatgtgccgcacgccttctgcacctacttttctcatctgcaaatggtgattgttttaggcagctcgggctgctatgacaaataccatagactgggtgacttgaatagcagatatttgtttctcacagttctggaggctggaggtccaatatttggttcctggtgagggcccgattcctgatatgcagatgaccatcttgtcgcagtttcctctcatggctaagagagcaaaaactctgttctctcttccttttcctaatcccatcatggggtcccaccctgtgacctcatctaaccctaatcacctcccaaaggccccaccttcaaatgccatcacattagagggtaaggctgcaacataagaatttggaggacacacaaacacacagtccataacagcaatcactgtgctcagttatactgaggacagcaccagcacctggtacatgcccagcccgaaacaattagtccaactctgtgtggttactgttactgacgcaggtgggcaccatgttgccgtctttcatcctgcatgcagatgcatgaggtgacacacgtgactgcagcactgctctttatggggaggtaataaaggaatgtgaggtacagatgtaattatctaccattacccagctatgtgtttgtgtgcattttggatctacagtcagagcttccttttattaaccctagttagtattagcacagcttcttctttagctttttttttttttttttttaagacagagtcttgctctcgtcgcccaggctggagtgcagtggtgtgatcttggctcactgcaacctccccctcccaggttcaagtgattctcgtgcctcagtctccccagtaactgggattacaggtgcccgccaccacgcctggctaatttttgtattttagtagagatggggttttgccacatttgccaggctggtttccaactcctgacctcaggcgatctgcccgcctcggcctcccagagtgctgggattacaggcatgagccaccgttcccggcctcttctttagttttgtcttaagcaaatcaagcttcttttccaactaaccggctgctggttttgtcattcatgcggtgcataggccagagtgctttccaaatgcaccgacgtgtgttttgtccttttagccccccactccagccagcctccagatactccaacacctcctcagatgcgactgtgtgtgctgtggcagtgtcatcctgtgtcactttggctaaggtggtggataaagaataagcagaaacaaatcatttgatttgtgacaggtcaccaaaagttattaggactacctagttggatttgaggtgaattttctaccttcattaggccacactgtagctgtctctcattgtgatacagtgtctctggacaatatgtagttgtttgtttttttttggtttttttttgagatggggagtctttgtcacccaggctggagtgcagtggtgcaatcttggctcgctgtaacctccatttcctgggttcaagcagttctcctgtcttagcctcccaagtagctgggattacaggcacacgccaccatgcccagctaatttttatatttttagtagagaccgggtttcaccatgttggtcaggctggtctcgaactcctgacctcaggtgatccgcctgcctcagcctcccaaagtgctgggattacaggcatgagccaccacgcccggcccagtaggtggttttaatgttagtcattgtgtgtgccggaggttgcagttaatgtcattctcatttgcagctctgaggaaggtgactggggttcaggaagagtctgagtttgctcaggatccctgagcatcagcagggagccacgtctggcacttccctcatggccatggtttctgtagtgggttgctgggctcagcgcccgttgctttgccttggctccatcgttctggtgaactccatttccttatttgaagacaaaggccatatagcagtgtcagctgtagatggactgatttagaaactgaaacgtactgctgactgagaaaacccccttctccttagcatggctaggatgtgaattcatcttttgtagttgcagtggtttcaagaataggaaaaggcagcctctgtttccctaggggcattagacagagaagcaggagccagaataacgagaattttaacttaacacctgcggccaaaacggagcgcaagttgtgctcctggaagagaggcgggccagtgctgtttggattgtctttctgctttcattatcaagatcccacgcttgggaacagcaattgtaaacttgccacttgccaaggggaggctcctcctgtctgcctgagctcatgagaatacccgccctccccctggaggccaaggagtggcctggggaaggctctggacctggccttggtcctgaggggcccaccccacctcatgcctgaccaggggcaagttagctttcaggagggagctgcccagagctgttgtttaatgggcacgttgccttggctctgtctgacgctgcgttgttactgtgcatgtttactttattctgggacagacacagcctcacaggaagaagagaaaacccaggcacccgtgccactcttaaaatatttttgtaagtggaagataatctggtagcctttctctgagttccacagcttatgagatgaaaacagcctcattatttttctggtattgaacattgggtgtttaggtttggattgaatcatgcaaatgtatatttttttaattgagaaattttagaaggccttttcaagcattgaaaatgtgattaccccatctctactgggaaatcctgactatacgtacagatagcaggtgagctgttatacctaaacatgaagcatctctgattttatcaccaacattgcttaaggcagtggcctgagattttcctccagaaaatttcctgctgttcttgcttcccagaatatccagtgtattcttttccagagcacctcactaggagtttggctgcttataacattttaagcttgccttgtttatcttggtgaatttcctggctagcaaggaaattcatcattacacttgggtccaagtaaggaaaaaagaaccttttgtattttactttaaatctatatatgttgttgattgttgtagagaggaattggccacagatatgttcgctgggttaatgatagaatatgtacacagatgtgtgttttatgtgtatctatgtgaagtgtacacatgtaagcttttaatgatggaaaatatcaaacacaaaagcagagagaatagtatactgaaaccttcctgtacccctcaccccatttaacctgcacaattgccaatcttgtttcggtggtgaccccaccccatctgctaagctctcacggccttattgaagcaaatgccagaatcccatttaatccataaatatgtctcctaaagttatggactccttttgaaaataactctaatccctgtaccccatttactaggcatcttgtgtccagtgagctcttgcatttcttcaggtgtttgggtccagtttgggccacagagtgcctttggttgatgtgtctcttacgtcttttcttttctactctccctcctttttttcccctgacagcttatttgttggagaaagtaatttggttgtcctatagaatttccctaatgttgggttttgctgctgaaattcacatgatgtcattgaacgtgttcctctgtctcttgttatttatgcaaatgggcgtaatagtttgagaggcttgatctgattcaagttggatttcttttctttttttagtaagaatgtttttaggtggtggtgttacttccatcaggaggcaccactctgtgcttgtttctttttgcggtgtgaagatgatcagtaggttctggccttgttagcccaatgctttgatttatattaataacatttcttgtcagctttttacctaagttatggatgtgtatcttccaggataagttcctgaaagcgggcttggtaggttaaagggtgaatgtatttgttgtattataggttgtatttcttatctgaaatgcttaggaccagaagtgttttgaatttcagtttttttttttttttttttttttttttttttttttttggtttggaatatttgcattatacttactggttcaatatccctcatccaaaaatctgaaacctgaaatgcttcactggtcattttctttgggtgtcatgtcaatgcttaaaaagtttcagattttgaagcactttggatttcagattttcagattagggatactcagcttgtattagatatggccaaattcctttgctgaggggttgcaccattttgccttcctaccactaacatatgagtgttctcgtttcctgtgactttgccaacaggatgtgttgataagcatttgcatttttgccagtctcataggtgagagatagtatctcagtgtagtttcaatttgcatttttcttgaggccttttataaaagtcttcagaaaataggagcaccatttacaatgactaattaaagtttagagaaaaattgagcttttccagtgaaaggtcccctggactctgttgccctaaagtttctgaaacgttttggaaaaattaccttactgtaacttactactagtgtccagaggcaaagggaagactcaggaccaggacacgtgcaatgtttcccaactgggtgatgtgcgtgaacggaccaagtgcaccaacagatgtgggcaaattcccctctccagctcctgcctggagctctagaatgtaccttgtgttagattttttttttttttttttttttttgagatggagtctcactctgtggcccaggctggagtgcagtggcacgatcttggctcactgcaacctctgcctcccgggttcaagcgattctcatgcctcagcctcctgagtagctaggactacaggtgcacaccaccatgcccagctaatttttatatttttttagtagagacggggtttcaccatgttgcccaggctggtctcgaacttctggactcaagccatctgcccgtctcggcctcccacagtgctgagattacaggcgtgagccactgcacccggccccttatgttagattctgagtggtcctgcagctgggaagctcatttaacattgcccttccctgagtttcctgctcgtgttattagagccttttcctgccatgatacctataatgtccctgagcactggcttgatggcagaagatgcttttgggtaacactgcctggccaccttgtccatggtgtgctgtttctacacccggcctctgatccttctcacagcttccaccaccacggctctgggccaagcactaatgtgagtctccatcctcacacagtagccatggggttcttccacagctagtgctctccttgtggtccttctgtggctctctctcacctacaacacaagccagactctacataggctggcccccggccctgcctcatttacctctagtttcacctttgaaagggatgtcctgcctttaccgtgggtacttggagctccctctgcttggaatgctctttcccccagattctcacatgcctgctcccccacttccgtgggcctttgcttagtgacatctcgagagatcctggcttaaccatccatctaaaaatgtactctgtcacactctatccccaaactgcttcatttttttttgaaaacatttgtgactgcctgacctaaggatgtacttttcattgtctgtctccttggctcgaatcgtgctgcacgaagacaaggacttggctttgttcgccgcttcatcctgaggacccagccagttctcagcacagggtggggcttgggagtgaatgcagattgcccgggtgctggggggagtggctgaggttgctgttcctgcccgctagtagccatcacagggtccacttctttctcggacactgggacactctgagtgagggcagatgtttccttggccaaaacttttgtccctgggctggaggaactcagggaggcctctagacattgtccagtcaccttcttgccaactgtcctctagcacagcattctcttctgcattttgtgtgatattgttttggcctgggttttaagaagtcctattatcactgctattcaaatcacagaaagggatgctcaccagatgttccactaactagtttccatgaggtacattcttagccactaggtgagcctctgcttcaagacttttgatttcttgattaacttcccaaatggggtgaaacccatttgtctccttaaatatgagccactacatccttctaagcatgcaataccagaatgaagcattactgcatattagaattagcattttctgtctgaagggatttagtagtttcaagaaagagtgggattgttcagtagaacaggcttaaagtaacaatctcccattagcgtagcacctaaggaacagcccacgcgaaaacctcggcaatgctcagataacaacagcgaaacgtacagaaatgggctggaaacaaaaagaggattgttcctggttgtgggacaggtctggtgttccacacaggtcttgctgttgatagaaagccgccggaagctttctgaggttcacccaaggccgtctgccagagctgctgatagaaaatgtagaagttgtaacaaacctttccattcttctgggttgtaatctgtggtattaacacagaatatctttagagggctggcagctctttccttcaagatgtggggttaagaagttatgtggttttactcttatttttcctagtgcagttctcttgacatcttaaattgaacaaccaatatggaaattttagggtggcaggaggtagaggttgacaataaacatctctaaaatgccttttccattgtactaggttcctcatctgaagctgtatcttcttcttttctctccagcccatttctttcaaaagcacaccataaagagcaccagtttactttgggatgacatttgactggttatatgggtggccttcaggtttgacacaatgggcatttagaggccttgactttgaatatattgcgaacctggtgatggagcagacaagtcctggtgtggggggccttggctgtgaacttcactttgcctgttactggctgtgtgaccctcagcaaatcacttaacgtccctgaagctgaatgcaaaatgtagagggtgcaaaagtaaagactgtgagtctgtgcactgaattttgatttcatactgcataataactcatgtccttgtttagtctccttgagcagttaccttttctatcattttatttgtgatgtatggtaaaggcactgtcttgcactcttaattaaaattaagaccagaataaggcagttctttggcagtcacagatcttatgattttttaaacgaactggaatacatcaatatttttaaaaaataccaaatcattgagcacatcatctacattggaccaaagttttttagggaagttttagagagagagagtgtgctctcaaataaatgaattttacagaagtaaaagaagacatttactgtcctttgaagtttttgttggatgaaaatggatcacaattgaaaaaatggaggtgttgtgaagctatgacagctaagaaagtataaggtagcccttccatgaatatcccagtgagttacgagcagtgagtgagaaggccagccattttgatggaagtggggctggttttgagggacaaacaaaagagttttgaaaatgtacaatgggtttatatgcctactgtcaccattcttgctattggctcccacgttttagtagccaccaactggcctgctggtactgtgctgggaactttttctattttattgccaaatctcccgaggaccctcaggtgatgtagactgttaaagtttaccaccttgatcatttggatgaactgttttgtgaaagaagggatttaatgagagcagaataaaaagaaaaaatatgcccacagctcaaactttagttcatgctcacttattttaacttttggcatggaatactctatagttaaagatacgtgtaccttttaataaagatgtataaataaagacttctgctttgtaggaacagacaaggcaatgtgtatttgagaaacctacaagtctgtaacagccattatggaagtgcctgcagggtcaggacacgttggcatttaggagtgtcattattcaccatgcacggtgtgcctctatctgctctcctcggggcagaactcaggactagtgtttataaatattttatttgtagctgatggcaatcacagcaatgctgccgagccccagagccctattcaaagggagtcaatggcttcctgcttgtgttgtttgccctcttcctaggccatggatgctgatagctcaggttgactctggtgccgagttttgcttgagttgtgacatatttggcaaggaatttgttaatgataataaaacaccagagttggcaagttatttactttttctcccatgagtaaggagattctgtgttatcctgataataacagtcaccgcaaacaccatatgccaggcctcctgccaagcaagctcttaccttgcattttctcattaaatctcatgcccatcccatgggagaaatatttttagtgtccccatttgagacaggaagaagcaggtggaaagaggggaagtgactcacccaggtcccacagccagtgagtggcagagctgggtgccactcgcacccaccagcatgccagaggttcctgtgagcggtaagcaagggagttggggctggcagttaatgatccaggttttcaggataacatggagggaaatgttagaaccagaacctgtgaactgggagactcggaacctgaaagaagccagttgctttccagagaaggaattcattccactctggaccaaaatttctcaagttccttagccttagggcttcccatgctggagcctcaggtgtaggggatgtgacaaaggacatgctccagaggccacctccctttgaaggcagaaccaagtcttgttttgttctgtgctctgcgtccagccccagacccaggcctggtgtgtacaggagctggctgggaggatggaagcttggaggaaaggtgggaggaaggggaggaaggagggagggagggacattgccattttccctggatgagtgtttggattgaaggaaagaattgaggacttggtaggagaaagagtgagtaataaattagaaccagaatgaaatcagagttataggagacagaaaaggtttccagcttttgtacaaagcaccattatcgaaagctcactacttcttgctgtgtcccatatattctccctgtacacagatctcattcatatgtttatttaacaaagattttgaccactaacctggagataaacaaaacatgtcctcttttcagagagaggaatttacagtctcgggaaattactcaagcaagcaatcttgttgcgcaatcattagcggaggacgtgggcatcctgtctcggacgtcttcacctgcccagggtgctcctgagcaaagggtgttgtatcgaccagaaggagggacgcttccgtggggtctttctttttcttagccaaaacattactttaactgtttccacctctctatgaagcttttgggttttcgtagttgtatgtttaatggaatgctaggatctcatgtgaaatgacattgatttttctgttttaactaggattgatcggaagatgtcaagtactcacaccagctacaaactggatgaggcgcaggctatcatgagtgagctccggaccatcaagaaggccatttgcacaggcgagaaggagaggcgggacctgatgcatgtaagctgcctgcctgctcatgtgttttattttaagatgtttttaatatacttatgtattacatgttatatagttattgtatatataacatatatgtgtatataatacacacacacacacacatgcatacatacatacgcaccccccactgtatttaagtacgtatatagtcatccctctgtatccttgggggattggttccaagacacacccccatccctcaggataccaaaatcattggatggtcaagtcccttatataaaatggtgtagtatttgcatataacctgcacagtcctcctgtatacttttctttttttttttggagacaggatctctgtcacctaggcttgagtacaatagcacaaaaatggctcactgtagccttgacctcccaggctcaagccatcctctcacctcagcttctagagtagctgggaccacaggtgcgcaccatcatgcctggctaatttttatatttttagtagagacagggtctcaccgtgttggccatgctggtctcaaactcctggcctcgagcgatcctcccgtctcggcctcccaaagtgctgggattacaggcatgagccactctgattgctgcctccatggtcacatgactgtctctttgtctgaatttcctgttcctgtaaggacaccagccattggataacgacccaccctaatccagtatgacctcatcttaactagattacatctgtaaagactatttccaaataaggtcacactcacaggttcctggggttaggacttgaacatatctcctgggggaacataattcaacccacagcaatgggtgatacatttatattgttcaataatcaagataattccaaaggtctatgataagaagtctcgctatcgccccatcctcctactgcccctgactgcctttattacctttttgcctacccttccagcattcatgtgggcacacaaaaagagaatacatgtttagccgccctcacgcaaagccaggactgtgatactgttccgcactagcttcctcacttaacagcaatatcccctacctttccccatatctgtacacaaagagctgcttctttccttgagatggttgcatagtattttactatgtgggtgtatttgtattatatatagctgggatcattgtagctttatactgctttatgtttttttccccttgagcttttgtagtttctgttatttttagaaaaagttgaacttttgcaaatgcaaaaagctgcctccatggtgggaaactcaagcaagacatctgagtggctggccctagtgctgcacatggtggcctcagagaggccaaggcaggggagcgctgcttgacctcatgacgtaaagtgctggaatgcattcagtgcttttggttacagcttttatttttcatctgctaccctaagtgagcacctactgcctgctggcatgtgtctagattctgtagagtataagacccacaggacagaacaagcaaagctcaaactcataggcaaaatgagacagatgcacaaaaaaactaccctgcctgggtagtgccttctaaggtcaaggccatgagggacttgcggagagtcctcatggtgcttgttaagatgcagattaccaggccccaccctagactcactgaattagaatctctggaggtagggcctaggaatctattttcagatgacctctccaggttgtgataagtaaatggttaattgttagattttttttttttttggcacacaggtagcactgagaacagctaccatttattgaggtctctgctcagctgacatcaaacaagatgccccatgtttgttacccatcgtcaataccgcaggctgaaccatgtggtgttccatggtggagacacagaggctttacgccatgaggccaagcagggctgcctgccccggcctctctgaggccaccgtgtgcagcaccagggccagccactcatttgccttgcttgaattcccaccgtggaggcaacagatagaatttctggaagaagcttcaggctcgagcaccttctttgacgtctccatagcctctcaaactctgagaagctccaggaagaggcacaggcagagtcctcttctatccaggttaaataagttgttttgcctttcttatgtgaacttaacaatattggcccctcccaagaaggccttatctcaatctcaagccagttttgtgagttctactgcacttgggcatttttggttctggtgtctgtagtaaaatttgctgaaagtgaatatattcagaagtctaaaagaaatggtcaaaaatctgatttctggctgggtgcagtggctcatgcttataatctcagcactttggggggctgaggcaggaggatagcttgagcccagaactttgagaaaagcccaggcaacatagtgagacctggtctctacaaaaacaaacaaacaaacaaaagtttagctgggtgtggtggcatacctgtagtcccaagtactcaggaagctgaggtcggaggatcacctgagccaaggaggtcgaggctacggtgagctatgattgtgccactgcactccagcctgagtgatagagtgagaccctctctcaaaaaaaaaaaaaaaaaaaaaaaaaatcagaattctgatttctgcttaaaactgccacacagagagatttcatgtgccagaatgcatactaactctaatttttggcaaaccaacatacatatgagattacttttgaccatgtagaattatgactgagaaatgaggtttataaaaatacgtaagctaaaacagcaactcaaagaactgaaaaagaaatacgtaagcattgtctgggagctgttttccccttccctgtttttcctctgtaacaatctcaaggcagcattcatctctgtcaggctcatttacattttcgatagaaatacttatttttttctttaggaaacatgaaggtttaagaaccagtaaaaatggtaccataattgtcctctattttattcacatgctgccagggggacttagttgcgatgtgatttaaatgactaagaattttattagaggtgcctgtgatgaagggcatttatgtgaaatctaacgagcatgggggtgaggtggggcaactgttcagtaataaataatgcagcagacctaaaacaaatgagagaaccacttctggagggaagagacacatcaccatctccgttcaaagagcttgtctcattgtgttccagagcctggccaagctgaccgatagcttcaagaacagctgctccgttaccgactctctagtggacttccctcaccatgtaggcgtgcctggcgatgctggtgtaccccagcagttctgcgatgccggctcccagactgatatcatcggggaggtatatgcgcgcccagggggagaaatgcaccgggagaggggagggctgcttcagtgttgccatcactggtttggtgtaattttccatgttcacttaagaaatgccttcacttttgtgccattaagtttgaagaaaaagtgttgtgtctcacatccagctgtgtgatacaattgaattgcttattactgctgcccttatgatttggactcttataaatgacatactccttgtgagagttgagtttcactgttcttttgacagacatatcactttttagagcatgagtccccacgctttttctgtgaagggccagatagtaaatatagtcactattttaggctttgcaggtagttctgctggaactgccccaccctgtcattgtagtgtacatgcagccataacagagatgccttgcaagcatgtaagactggggcctcgagctgctcaaacgttcacttacggaacagccagtgggctggatttggccccagggccatagttactgattcctgccttagaccactgatttccaaaggctttatagctgtgccaccttgggtgttactttattgctgtttcttactcttctaaaagaatgtcaggaaattgaattgaactaaaagtcatttttgtttgagacttggaagaatgtcataatgcctcctttgttaattagcgaagccttgagttagccacaaaaacaaagttgggaaaatcaccatttgaagcaggatggtggatattcaaagacgctagtattgtaatatcattgagtgaagcttgacattaatttgttaccaaatggaaaaacagtttaaagagcttctttttttttttttaaggattattaagtaaagatgaggtatcaatggaatgcacagtgccacccctcccccgaaattaaataaataaaaggaaagcaacaaaaggaggaaaaaacaattgatggaaaactctgggttttaaataattagctaattaatattttgaaatcttagcaactagtgcctcttcgagtggagtataatgtaggaaatcacggccctttatgtcttgggtgtcctggaacagtcctattttcaaatttgcctgcgttgttccaaacgtacacttggccgtttttgactaggcatcttctttggatgaaagaatatggtcgccatctgtaacacacagaggagaatctgtaattcaaaaatgtttggcatttttgcgtaaagattttggagcgagagaaggaaacaagtgtaagactcattgaattcgtgaataattcattgctgcttattgtaaggttagaattagaatttagtttgagagaaacagttaagatagaaggttctccagtgatttaggtcaacccttctaaaaatgtcaggtgaggagtggtggctggttatgctacttgagcagtcactgctcattgttgataagctcctgaagtttaccggggctgaccctaggtcagcaatctcatagctgttatctcagtttaagtagttgttcccatcctgtgtgatgtgcaggagaccgagatgccaggttacctaaggtcttgtagctgaggagaggcaggtctggttttgaaacatttctcatccctaaacccctgtactttctaagaaaccacatcatgttatagaaaaatagatcaaaaggctatgactgtattagctaaccattgctgcataacagatttccccaaaacctagcctcttacaacaacactcctttattatctcatgcttgatgtggtccaggagactgggctgggtcttctgctccagggtctctcaggaacttccctgcaatcaaggtgtcagccaggactgtggtctcatccaaaagctcacctgggggaggggccactcttaagctcatgtgattgttggcaggattcagttcctcacaggttgctggactgagggcttcagttccttgccacatgggctgctccagcacggcagcctgcttcgtcaaagtgtaccagctgagagtctgctagcaagatggaagtcacagtcttttgtaacctattcacagaaatgacttcccatcacctttgttctgttctattggttagagtcaagttatagacccagtttattctcagggggagggaatttcacacggggagaatcccaggaggtgttggtcattaggggccttcttagaagtctgcctacctcactttgtgcttgtgttgagtctgttttgtggggtggatattgctgtatgtcagatgtgctttttgagactggagatttgcagccacagggttgcacacgctgtagcgctgcataggaactctgaagcaggagtctcttggatccatttggctgtcttttcttttcactaaaatgtccatttaattctcaaagaagagtacagaaacaaagcttagagagaggtgcatacagctttgagaagaggtttgagagatgatgtttactgatcttgatgagttgattgcagggtcactaataaagaggggactgaaatggcaagtagctcatctccactgtggacagcttttggagctgtggcactgccacttaaatatatttatactgaggaagctggagaggagcattggatgaggccgtttaaacatgtataattgtggccaggcacagtggctcatgcttgtaatcctagcactttgggaggctgaggtggccagaggtggccagattgcttgagcccatgagttgaagaccagtctgggcaacatggctgggcaaccacctgggcgtggtggctcatgcctgtagtcccagctacttgggaggctgaggcaggaggatcgcttgagcccaaggggttgaggctgcagtgagctgtgattgtgccactgcactctagtctgagcaatagtgcgagaccctgtctcaaaaaaagaaaccatgaacaattgtcattctggttggagaatgctcagtcccttgtaaggcactttttcatcttgccattcaaggcaataaatttgcgaagacatttttcatcaacatagatcaaaactcgtgtcgataaattcactgctaatcattcaagttgaatattttcagatacttgttgatgggaagttatttcaaaaatgtaaagacttggtggccataatatgtgatctagtaaggtcagatcaacagatggagctgatttattgaaactggagttgtgtgaatatttgcaggaatgaggaattaaccaaaatgtactacagttacttcctgtacatgtctttttttgttttgtgtaggattttattgtcatcaatgtaactggtacaaaaatatttaagtatatctactcgtcacagagcaccgcatttaggctaactctatattggtactccccgagctctggctttttgagaccttgcttgctttccttttgcccttggttctttttttttttttttttttgagacggagtcttgctctgtcgcccaggctgaagtgcagtggctcagtctcggctcactgcaagctccgcctcctgggttcatgccattctcctgcctcagcctcccgagtagctgcgactacaggcgcctgccactacgcccgactaattttttgtatttttagtagaggcggggtttcaccgtgttagccaggatggtctcgatctcctgacctcgtaatccgcccgcctcagactcccaaagtgctgggattacaggcgtgagccaccgcgcctggcttgcccttggttctttaacacacctcgtggcatcagaaggcgtccaccagcccatccgtcacacagctagtccagcttcctcagaccgtggagcttctgagtagaacatcattattttacgtttactgaggaattagagaatgtactgcacaaaatcgggtgactggtttttgcctttgtatcaacttttactaagtaatttcctacttcttttaaaacctaatttgtggttgttgtttggaattacagaatagatagatatgctgctgctgtaaaaaaaaacaaaaaaccctaccagtttaggcaagcaagagtcttcccttccccctcccccctccccagccaggggtggccgcaaagggttattcagtgtttccttccagaccttgcacagattgaaagtgaaagagatgaagaatatttctcattgctgccgaaagtttaagtgaagttgctattttggaaatatgtttttaatatgcgtttcctttctttttttctctcttctgttccggaaagtttgtctttgatgataaaacaagacttgtagaccgagtcagacttaattggcaatatgaagaagccagaaagaggtaagaagcacttttttccaacctcgccttctgcttacttacttactttctcctgtggaaggaagcgtggcatagttcctgtgtgtgattggtcacgtctcatcggagaacagcgtttgatagaataccaagtcaaggatcttcatttacgtgtagcttaatacatacatatgacaacatttcaagtgcatttaaaatgtgaaatttgcaatattacaaacagttatacagacgtgattccataagaatagaaacttttttggctttgtcatccccggtggttcagaacctctacccctccttcccttccctccttccaatagacgagcatcagttccagagggtgtcataagtgaaaccacttgatcttttatatgtgtggcttctaactccataagctaatgggcaaagccatgtatcttggttataagacattcaataagcattaggtcaacaggtgagcagtacctaattgatttcattccatttatgttgtcctgtgtcgtaaaccattggcctcctgcaaattgcagcttgacccactttgtgcacttgtgtttctctttcctcacttccctccctcccttccagtcttcatcctctgacatgcacaaagctgagaggcttccgaaccctcgcatggcatagtattttagggcgtcacgtgtctcctcagctgtgcagggctcccgttttcaatattcttctcctctctgacttttgtattctctttttagggactttctctagtttgtgccttctggaaagagtcttaaagccaaattatttccaaataagtgcttcagaagagtatcaagcatatcttttttaaaaagttacttgagtcacaaatgaaatattgtcatggggggcggggagagcagaatagcagaatgtcgggtggggtgagggagttctttctggaagctaaacagttaggcctgctcagcacactgtaccattcatggacgtctggaaagctactttgttggctttttaaaaaatgtaaaaatagcaacaaaagcacatcatatgattcagtgctccagggccaacttaaacggacatgggccttctgttttctaggaggttttctaaccagtgcctcttggctttttaggatggactcgtggtgggctttaaatttccccacagaacagtgccaagttcatttggcaataccagttgtctgtgtggtgattcttcattatcatgcatattccttctctgtagcctgcaagagtttgtgaggagcgattgtctcttctgagtattcgtctgctcttgcctgtttctggtgaaactgcggagtgtgggtgctggaatttgctacacttaggaacatgattgttacgtgtttggttgtgacatttaccaaacatagcaagtgatttctttgttttctagagatggtgccagtatatggtgagtaaccttctaaatgttgggataatacatttgggtgaaaagtcgagtatttaagaaaattgttcaaggggcaggcatggtacttcatcagttcttttgaataaaataccatattatttcaagatggccagaaccttgttaggaaacgcaccacagctacagaggaaggtccaccttccactgacagtagcggcatgtcagaagtgcctctgtgggctgtgttggagcatttaaaaatcagagatttcttttaaactccacctgggtgggcctgcacaggtgctgcctgtccttttcccactagcatagtggggctccacacagggagcaaggccttcaccctccaggagacctccagcagtgtctgcagacatgtttaggtgtcccaactctagggcaggggccagggaggctgcttgacatcctgttgtgtacaggatggcccccgcagcaaagacttacccggctcagcatggccgcggtgccaaggtccagaaacctcgccctggggcttcttcctgtcttgctcctgaatcttcacgatgcatggacaacaaggggcctacatgagcaggtcgcctgctgactcacaggcatcagcctgctccccactcaccctgctccagccaatcggcccctcgatgttcctcagatgtacaagcacgcctgcactgagcagcccctcgggcctcccaccgggcctcagtcccaccgagccaactcctgacctagcatctgcagctggcagaatgatggtccgtcaaggtgtctgcatcctgatctccacagcctgtgaagatgtggctttccatggcaaaagggacttcgtggatgtaattaaattagggatcctgagatgatggggaaatgagcctatatgatccaggtgggctcagtgtcatcacaagagtcctcataagagagagacaggacggtcggcagtagagaaggagatgtgaggttggaatcagagatcagaatagtgtggggccaggagccaaggagcacgggcagcccctagaagctggaaggtgcaaagaaacagattttcccctggaacctccagaaagaacgcagccctgtagacccattttcgacttctgccctctagaactgtaagggaataataggtgttgctttaagccattaagcttgtggtaatttggggcagaaaagagcaaactcatacagtgcccttggcctgttctgtcttctctgtctggaatggggtggcttttctccaaattgtcacatgacctctccttttgatcaccttgttaagagaggtttccttgaccatcctgaataaaacctcaccaccctgtcctcaccccggtccccctgattggctgagcaaatgttattacctaaccagtgtttacttttcttactgcctgtctctccctgtgaaaatgtaaataaccctcatgagtgcagggattgtaggtcattgctgtaagcccagcagctacatacttggtgaatatttattgaatgagtaaatgagggtcccgtgtggttgcatttgctatttggcctttgcccctgggacggggcaagccagggcagtcccggggccaggtcagctccaggccaactgctctgctcctgggtcccttcctcaaacctccatccaggtgtgagccttggggtctctcgccttgacttgagaagggaaagggcttcaagacatgggtgcctttagggatctgaggtaggcaaggaactgtctctccctttcaaggactatgttcaaggtgtgatacgtcaacacaccgagctagactaacagttctgggccttcatggacattcaaaagggctactagcctttgaactccataattaatcctctccttgggggttggagaaaatggcattggagttgggtcctgaaggagtgctgggattccagtcgccgtccattggggatgggctttctcaggtaagagtgggggtcaggagtgggggtaaggtgtcactctgcagcagctggactggcctggaattgcagagcaaaggccagccaggctggaatggaggatgcatgagcagggaggcaggccacggcatgggggccacgatgccccgaagaggggtcagaattgctgggcatgctgggacgtttgagttggaaagattaagtgtgagccattcagatggtggtatgtggaggagggccatttgaggaacccagatggcatagagatgaagtcaccgagcagctgggctcaccttgggagatggaacacagggagaaaagaggagatgccaggactgagcctgaggaagtccaatcaaaggcctggcgaggacgagactggccagaggggtgtagtaaaaggtccgagaggggatggctggggctggaggaaacaagaagaggaagtacacctgagaagacacttatgtccacgggcccagtggctgtgaaggaacgaaaagggggtggtaccgttggccgacaggcaggcctctgcttcccaagcccagcctgaggtgtccttagtccacagtgcatgggaaaaaggagggccagcggcaggtgttcctaaagccaactcgctgctttccagtcaaagaagcctctcattctcagagatacatacatatgtacatacatacatataaatatatataattaatatatgttttatatatatttaatacatatttattgtatatttttatatattatatttataatacgtgtttaatatacattttttcatatatatttttttctgttaaaacatctttctcttaattaactaatgatgatcattgatgtgaattggttttttccaaaagtctttacttggcaaaataacaagctggcagtcctaaattgttgccatcagcacatcccctttcttaaattggactggcctgggggaagtgtgactgagatggtgctctccctggaattaaaggagaaggatgaccctaaacagggtttccagaggctcacagtaaagtggagggtcatttgaaaggcagatcttggttttgaccatgagtttggtgttttcagtggacttgaagctgctgagaaacatccatgaagtgttcttgtcggtggagtccgcagtggagattgcagttcgctgagtcattgattgcagctccctccgggctctggttcccagatgcggcggtgcacgtctccagtccccttggtgtgattgtttctgcctccagtcattccacattggttactgtagctaaggcttgaccagtaagtgcatgcctgccatgtgaactactcagctgtaggtcacataacccttagcagcctgggcaaggccctagactttacataccttgtagcgttgtcaggatagtcttggctcccctctgccccatccctgtagacagatggaaggctaggaagggttgatgttatcaggtctccccagcaccagatgagcgatttcattacaatggtgttttccgagtgttctgatggactgcctctaagtgaggcacgagagtagaacgatacagacttggggagagagcagtggcaagtggttctctggcaagaactcaacattaacattccaggagccaggtgctgagtaccacaggcaaagcatggtggctttgaggtcccgtccatggtctcttcctcggcccccttgatcaggctgggagataatgtctctgatatccctgtgagcgtccctggagaagtggtgtgccatgagcaggaaggcatcatgtacccccatcaacccaccaaagcatgaaaaagaacacgttgctcttagtggcagtgttagcaaagaataatgcgttcttccctgctccctcattccaagcctaagggacatcatgtgccctttcctcttgcccaggtgaacttctattagattagtgccacaattcagtgtcgtcttttcgttctgctacttcgccgttggacattaatctcccagctctcattcctgaaatcatttcaccctgcaagcttaccttccctactgtattaggttctgcagagaaacagaaccaacaagagtaggggtagggaagagaagggagagagattattttattataggaattggctcacgcaattatggaggccaggaagtcccaccatctgcaagccggagacccaggaaagccagtggtctcattcagtccaagtctgaaggcctgagaactgggggtggggtggggtgtggagtggggtgggtgggtgggtggtcatagtgtaagtcccagagtctgaaggcctgagaaccaggagctttggtgtctgagggcagaaggtggatgtcccagctcaagaagacagacagaattcacccttcctccacccttttgctctattcagtccctcaatgaattggatggtgcccacccacattggtgagggtggatcttctttgctcagtccactgattcaaatgcttatctcttccagaaattccttcccagacacactcagagataatgtttgtaccagctatctgggcaagctttagcccaggcaagttgacacacaaagtaaaccatcatgtatatcctctgcagaacctcctgtgctttgccacttctgaacagtggaggattttatgccttaggcattttggacgtctttccttgcacatatatatttgagattatttttaagatgtgggaaattgtcaaaaatgccgaattctggacaatgagggatttcatatatatatatacattcagattttttttctttcctttttttttttttttttttgaagacagggtctcgctctgtcacccaggctggagtgctggagtgctggagtgctggagtacagtggcgtgatcttgactcactacaacctctgcctcctgggtttaagcgattcttgtgtctcagcctcctgagtagctgggattacaggcacgtgccaccatgcctggctaatttttgtatttttagtagagacggggtttcaccatgttggccaaggctggtctcgaactcctgacctcaagtgatccacccacctcagccttccaaagtactgggattacaggtgtgagccaccccactcagctggatttcatatatattcagatttaaaggaagtttgtggaagtggaactcataattctgagtggtgatgtgatttctagagaattctctggccaaacgaccactatcatgatgactagttttgtgtttttaactgtgggtcctgtgaagcgtaccaaaaggactgcttgcaccttgcctcaggagcgcctcttcggattcccaaggcagacctaatgataggaatattcacactattgattttaaaatttcagaaattttaaaagtgaagttgaaagagcaagtcttcttgaagcaatcccgatgacgcagatggctccttatttttaacttaagggcgcttgttccagaactgtgcacaaactgtagctgttaccatagaaacactctcagtccagataggaacaaaacattcggtccatccagtttctctgcctcttagtttttgttgccaggatcagtcctgctgttcatcagttgtcgaggatcagtgtagtgttatgattccagttgaatttgatcaatcacttggattttttcatttctcaaatgacttcctatctgggttttaggggtggggcacagttgtgagaaataaggaaaagcatctttgccactgtggctctgtcttccctattctggtcaacacggagaagcctgtagactcactgctttttatttgatgaagttgctctctgaagatctgtctgttgcaaagggagaagatgtcagggctgggaagctgaggacggggtgagatattggtgtattagtagacctttcttatcccacatattctagattcagacttctcaaacttctgacataaagagttgagtagaatggacgctggtttagttcaatcagctgaagtgatttcattgtccatctgacttacatctcagctgttttctttaacctttgctttttatttaaatgggtatttacaacaagaaaactaagagaaaatgtaaggagtatcgaacctgtagccgtaattgcaatctgaaggtatgaggctctaagctgaccccgcgtcctggaatgtgccattgggatccctcacgactcatcaccatgggataggaccgtgggctgtccagagttctgcttgctattccagaaagcagcaggattttaggaccatgagaaatgatattgtagactgcagatttttggtataaattcaaataattagggattattcttgatatgcctcagaactttttattattgaaagtgcattgttttcctataaaaatgcaaatcgtatttaagattttcatgtgaattgtgagagtctaaatagtttctgcggcataaatgcatggtttaatggtgcctgggttgtaacagaaaagtgtttgagcaaaaatcataagggaaaaatgattcatattttatgtctgtctacattagacctgctcagggaatagaatttgggaaacacataataaataagaaacctgcatgcttgattgaacatttgctttcttcactatcaggacacgggggcatatattttaaggcttttaaaggcatttgggagagattttatataggccataaaatgcattacccctcaaaaataaaaatcactgaagaatatagttggctcacagaaaaaaaaaaaaatcctctctaattttaagctgctattagttctctttacaaaaaactcgggaaagttattttgttttgcaaactttaaccatgaccttgctttacttccatgtatttaatttcactgaaatgatatttcaaagaaaagcctttctggaaattgtttttcctttaatacccaaaattggaacaacagcactcacaggagcgaggctccaaccagtggatcagctgtttggcgtggatgtagaagaaggtgcattgaaactcagtacatctgtgtttagccttaggcaggaagtctgtttcttcaagtaaacctaacgtactaaagatactccctgcagatggctcgtttccggcccacggcaaggtagacaagtcatacggttttaaaggcaaagccgtcttgtctgtctcatggggacataagaacaatcgattgttgaaggaatcctagtgcttttggcttccagtacagacagacagacagatgtgcctctctcgaccttgctgaagcaggccccaaatgttcacacctagaacatggggacaaagaaagaaattgaacttttcaatatgttccagtttcttctagattcatatatagctctgaaatgaagatgagattgtttgcattgttgcattgttttgaaattttattattaaaccccacaattggaaggcacagaaatgtttgcctagcattcagcacagcccaaacatttccagatgggttgcagattttgtttctgctggagaggtcgtcccttgccgtttgtccttgcatatttttcctgccagctgtgggaagtgacaggacatggtttaatttgggctgctgttctgtttctttatgcctgcagcagacaggtcttttgaaactcaccctttgcctctcctccctcctataattcatttttttcctcattctttttttcctgacagtgcatattacttgagattttcctggaaaggttgtgattatctggaattggatcttccgccaccttcaacagcttgaatccttgtaggctagcagctaacctagagctggcagactcaaatggaatcttgatctcttcatatttaaggctcagaaaactcaaaaggagtgttctgtaaaatacttctgtttatattatatgtatggtaattagtatgagtataaaatggtcgggcaaaatttagctgggctcagactttcctgtggatcagataaatggaaatgaaaaaaagtatgaggacacagatttgctgattgttcttcatcttttatatttatttcttaacttgtcttggtctactgtagaatgttccagaaatgtcattgggtataatgtctgatttagcactgacttatttgtgggtttgcttggagtgtattttccttgggctttggatatatgactgccataaattttaattacactaattagacgtaggtggatgcttaagcccagttggagtcctagccctgttcagctgcctctgtcattagtttttctggtgacatggtttggcaccatcttccaacacgttttccagacattagttttaagttagaaaataacttgtctaataaagctactgacattcaactagtgtctttaccttgttgaagtggacttgagtaaaatgcatacatttaaactgtaacttgtgtacccgtttctttccttaactgtgggctttcagattcgtttggtggctagagagggagtcatgcccgatcctcatgagtccatgtgctcgtgtctagtttaggtggagcctgacttggcacaaggctgggtggcaggttttaacatgtgtggcaatgctagtcaattggggatatccacatggctcatagtgtagagaaggcttctgaggtctagacccagcaggtgggaagccagccttggttagtgccgtggaccgcgggcacaggaggaggcagtctcaggagcacctctgccctgcatctccctcggaggatatagggccacgtgtgcctgccacttccctgttctcacagctctttgtgatctcagagaagcctctggattttgtttttgggcgagtatgccaactatgtcctccacagcatggggttcaggttgagtttgccattcctagtttctccctagaaacatatccctgatctttaaccctacttaaagggcttaaaacattctactcttacttttaaaggatgctttaaaaatacaggccacatctgtttcacttaatctgcattcaacagcacctcatgacacaaaaagtaatgcagtctgtttgccaagcaagcacttggaaatttcgaggcatggaaactgataggagcctctgtttttccaccttgaggattgttgcgctttgcatccacccagatcatctctcaccagcatccatgctcacagggctgcctctcttcctctcacatatttgcaggcgtgtttgttcactgttcaatgcactcagcttttgtcgagtgcccacttgctctccgcaaggtgttttgaattcatgtatggccaggggctctggtgcaggaaggagcacacagaaccagaagacgcggagcatggggcttcgaaggtctttccttcaggacgccagatgatgagtgcatttctcctttgttattttgctaaagcggctgacagtggttagacacagctgaggaggcgggaggccggcagcacttctgggggtccagcatgctgtttagctactgatgagggtgggcagaagaaacaagcagactccctcctgctctgggacagtttcatgtaggaaaccaggagtctgagccgccgagtatgggcatgttgagggctgctggcctttttgtcagttcttcggaacaggcacgatggggttattttcatctcgaatctcaggctaagggagcttcaggaaaagacttctgcaccattttttaggacattgtttccatatccttttaagtgtaagggtcacttggtgtaatcatttcactacttatttggcaaaaggagtttatagaatcagtgtgagacgtggagaaggtgtgaagacggcgttttcagtccgccgatgtccttttttcctccccgtctctcttgcagagtcgccaacatccagcagcagctggcccggcttgacaatgagtcctggccaagcacggccgaggctgacagggaccggctgcagctcatcaaggagaaggaggccctgctgcaggagcttcagctcatcattgcacagcgccgctctgcgggagatgtggcccggctggaggaggagcgggagcgcctagaggaggagctgcggcgtgcacgggccacctccgcacagggcgccacggagaggtgggtcagcggggacacgacctccagcggaaagcctgctggaaaaactccacggggtggcttgtgtgtggctggagggtgttcctgatgatcactcagagcctctcctgcctggatgttccctggcctaggaggggcatgcggtggggggcactgccttctgctccctgggtctctggagcctctgctccgaagcaggaggtgattgacaagggggaaggagtgagggaagatgggtgacctccatctccgcccacgccccacccttcctgaagttggtgcttggtgcttccacctgcctttgtgggacagtgccctgagcaggctgtggtcccgctccggcccgggcagctctgttgcatgggggaagaattccctgttcctgacgtggtgagcatggtgggtatccacctactgctttcctctccaactttgatttctagccaggagagcctgctcttctctggcattgggaagctggccacctgtcgtgcgtctgtcctgaggctccttcaccacgcaggacatgcaaagccagcatagtggctttggtattcggtggcactgagtcgttcagcctttcctcgtgtgccgtgtgtcctggtttccatttgctgtgtgagactgcagattgtgtcaaaggctgggcctgccttccacacttaacagcagtttctctgtggctatcagctgggcttttggagagcagcccctcccccacgtgttaaagtcttgcccccttgagctcacatgagcagctctacagagactctaatagatgcttggatgattcgatctgttcagatgctcttactcctactgtttcacgatggttgtattgttgggcgtcctttatgcttgatgttcatgggtcatcttcataggagacaagtctgtggcttggcacgaggggctcacggcagcctcagggaagcggtggtgtttggagagttgagctcagagtcctaggcaggtgaatttcattttgcctgagatggtggcatgccctgtcacctcacccggaatcaaccgcgaggagaatctgaatgtgaaagagctcttgcacggctgcgtttgttttcagctaaacatttccttctgttccacccctggtattcttgtatgtgtgttctgcgtaggagggcctgggagttcctgttgcttctctgtgaaggggggaggacttggccccacaaatgtcgcctgcatctcagggccccacacccacgctcctttgactgtggctgctgtcaccatgtggaaatccagcacacacgagtgctgtggcccctgagtacaagtctgcagccctccatggagccagtgttagccccgatgcctgggttcaagggtggggacagcaaagccggaccagctttgactcccatgggggtctctcgtgagaccagcccaggtgctgagtcctgggactcagagccctcgaccaggacctaatcgccccaagcgtgtttcctgaatctgctgctaaatgaccttggccggaaaagcacatccacatgtgctaagcacttgcacgcacatcgcatgggggtggggctcttgtagctctgggctttctgtgccggtacacgcagggcccatttctccactccacctcccttcattggaggggtgtttgcagtttgcaagtatgaggccacatggtaggaggcttcccccagcacaggctggcagcattaggagacccggcgtgggccaggtgcagagagagagtgaggttggtgccttaaggctgagccgtgccagctgtagagctgggcccagtctgcctgtctcacctgcagtgtcatcagcagcaaatgggaggcgtttgccgggctgggggtgtcatccgggggagaaagagagagatgcgcacctccttcaggcctcccgccccggcagatgatacgtgcggcggcctcccagctgctcagagccagcatctctggagggagctggtgcacgtctcctgggctgagggagcaggcttgaggtgaaggacacataccctagataatctctcggatggctcgtgtcaacgcttgcaacatcctttgctattttagcttgctcatgttagtgtgtggcaggcatttatacaagatgctgatgttcaacagagaaccccacggctctattacaagatgcctgccatcctgagaaattctctttccaaggatgactgcttttattataggggtgattataaaatgaaagatctatcaaaaagcaaaaattttgttctgctgaacctgaagtcatgttttcctttgtcataatttaatgacatctttacaataaagtactttatgtaaagtaaataaagacagtaaattagactttatattttcttaatctgttagcttacttttctactccttttcatagcagtggtaaatattctttgaagttcgtttcatttgaattggagacacaaggctatgtgctttaggagttgggccctggccagttttctgccaggaaactgtatccccttttctttttgttgaaaaaataagtacagaagtcaggcaaatgtctaagactcttattttagcagtttatgttccagccagttttttagatgtctcagttattgccagcgtggcccctgtttggtaaggaagttacatttttagtcatctgcaactttcagaataaccagcataaaattagactgcaaatgtgggcagtcatgggcacttgtgtgtgatcttgtatccagatgcgctgtctcttgtgcgctccgaaatgcacctgtttgtataatgacaaatgtgttgtattggatagaaggggggaatttgatctaaaacttttttcactacagataaaacaatctgaaaataagtcatgactaaagacagtctaaaaccgagccgtacatatgaatgtatctatatgtcatatgtgtgaaaacagagctggaatgcgctgacggatttagcgatgggttggaaattctaccctggtcactcaagagtggagccagttttcagtaggaactcaatttagattctattaatttgggatttgagctaatagaattcaggttgggttagaatttctgaaaagcattaagaaaaaagttagtagccttggaccgggcttgggtaaattccctacaacaaatggcttcttggagctggtcactgtttgccactggatacgctctgctggtgtcgtctctgcccctggagtcctctgtgacttaatagtgtcccggtgcttgtgagagtgggttccaagttacagctccaaagctcaatgaaggatgtattttgaactcacttttaaactccctttgaaaactctcggctctccatcttctgaaaaagatggggtttttgaggatatcgcccttgataagcgtcagataggatgtgagtatcacagaaaattggggaaatgtttttcagtagtaaaggaaatgcctgtttgttggtagtgtgccttggctttagggtcaatccagcctgaccgaactttgagcttgcgtagcagacgcaagctactttatatgagtttcttcatctgtaaagcaggaatagaatccaaagaccagtaaggaatgaggcagtgcatagaaagcagtgtgcctttctataagcccctcagtggaactttttttttttgagatggagtctcgctctgtcgcccaggctggagtgcagtggcacgatcttggctcactgcaagctccgactcccgactcccgggttcacgccattctcctgcctcagcctcccgagtagctgggactacaggtgcccgccaccacgcccggctaattttttgtatttttagtagagacggggtttcaccgtgttaaccaggatggtctcgatctcctgacctcgtgatccgcccgcctcggcctcccaaagtgctgggattacaggcgtgagccaccgcgcccggccccagaattgctttttaaacgttactttcatttgtacaagctatcaaaacattttccttaaaaattaaaatatcataggtaagtggaatcttagaacattctactcaagagtttattacagctgttctcaaacattttggtctcagaacctccttccgatgttaaaatgctgaggatcccaaagagcttttgtttgtgttggtttttttaaagttcttttttctaactgttttgttttgtttttcatttttccccacccagggacctatcagtgtttatgtggatttttatctgtcagtatttgctaatttagaagttagcgctgggaaatttttaaaatatttatttattaaagataacaataggccgggcacagtggctcatgcctgtaatcccagcactttgggaggccaaggcaggaggattactttagttcaggagttagagaccagcctaggcaacatgacaaaacctcatctttacaaaaaatacaaaagttagctgggtatggtggcacatgcctgtggtcccagctacttgggagcctgaggtgggaggatggcttgagcccgggaggtggaggtggcagtgagctctgatcgcaccactgcactccagcctgcacaacagagcaaggccccatctcaataaataaaaaaagacaatacaaaccctattatgtgttaatattagtaacatttttatgactgataacttttttgaaacaaaaaactatagtgagaagagtggtattatttgcccttgctatccatctctttagcgtctggcttgctagaaggcagctgctttggccattggtgcattcggcctgttgagatagggtcattttgagtgaacacgtgaagaccatctagctgcttaccgatatgccattgggaaggaggggacctcataggacccctgaaggagttttggggatccgccaggggtctttggatcatgctttggaaaccattggtttcaatatatgatattgaacttgaaagtgggttgtgtcgtggctccatttaggacgatgcttgttactctcttgccagctgacctctgcatggcaccatttggaattttgtttgcatcaagagaaacaaaggctcatcagaatttatggcatgtggttgaaacttgtaaacaaactcagactggtttgtcttccttatcctaagttggtggcgcatctgtttcctttatgggtgatagcagctctttgtcaatcacgtgtcatctgccgtacattattttatctatgcagcatcagttccctgagctggagattgtggactccatttttacaggtaatgaaactaagggctcagagagggtgagacatttgcctaaggccacacagcttgtgagtgactggccaggtgggattctctgaatcccaggctgctgtcagacactgtgtctggtttcctctcactcccacctagccaagctctttaaaccccttcggcatgtccccttccctgttggtggaaagaggaaggtattaaaggggcctactgtggccacacgtcacagtgtcatttccatttgtaaaccaggagtgtttccttctagaggcaaacatatttattcatggagttgtccaacaactgtgtattgagtgcctatccacaataggctcgattctaggcggtgggcctactgcagtaggaataaattttattctacaaaattactaagtagaaaaaagtagaaggaaggaaaacaaaaatacctccaaccccatggcctggagatggcaacggctgctgttttgtttcatttgcttctaatgttttaactgtatagatcttagaattatatttgttcttctctagaaggtggcctagtatgagggaatctgatttgttccaaggaatttcaacagatgactgcgtgctctgcgtttgagctcatctgctagttatctgtccttctgctcacttaccactcctcccatccatccaagcagccatccccagccacccacccagccagccatctagccacccacccagccacccacccagccacccatccagccacccatccagccacctacccagccagccatccaccaacccagccacccatccagccacccacccagccacccagccacccatccagccacccacccacccatccagccacccacccatccagccacccacccacacattgacccatccctgtgcccactcctcttctcacgcatcccctcccccgtgcactgtgcctggcgcttccacagagtagcaggcactgctcagggtgccagggatgtatttttcaaacgggacaaaagcagtctctgtgatcttggcccttgtgacctgggtgcttttagaatgggtggtgattgcaacctaattcagctggagggaattgatagtggactgtcttgttatgaaaatattctccctgtctttgaaatgtactaatcgactgtcttcttacctacaggattctgcttcaggaaaaaaggaattgtctacttatgcagctggaagaagccacccgcttaacatcctacctccagtcccagttaaaaaggtaggttactttcaaagagaaaactgtacttgttcatcatgttccaatgactggtacatgaactcgtttcttgtagcttgacctgaaatgttgttaacacagaatggatacattatatttttaacatgctactactgtatgactcaaggaatatggagagaaccacatttggcttcagggtaaataagaggcctgaagtcagatgtattcaaggattttgtaacctaattaacagtttcagaagtgtacatctatacacgtgcgcatttttgttttgggttttttttaaaagcatacgaactttttaagctagtaagatttggctgctcaagaatggccaatgtcaagggcctcagatgtgtcattttctcagatattcctcctaacaatgccccaggtgggaactgttctcaccccagccccagtgggagcccagagggggtgaatggcttgaccaagtgtacctggctagtatgtgttccagccaggactgggactgggacttgggcacgggtctctgctgttgcccactgctctctgccaccctttccgtgctcacagggtgagcaggggtggctgccctgccatctcagatggccatgctgtctcatttcagcctgtgtgccagcaccctgacggtgtcctcggggagcagccgcgggtccctagcctccagccgtgggtctctggcctccagccggggctccctgagctcggtcagcttcacggacatctacggcctcccgcagtacgagaagcccgacgctgagggcagccagcttctacgcttcgacctcattcccttcgactctctggggcgagatgctcccttttcagagcccccaggcccctcgggcttccacaagcagaggcggtccctggacacgccccagtccctggcatcgctgtcctcccgctcctcgctgtcctcgctgtcgcccccaagctcgcccctggacacgcccttcctccctgcctcacgggactcgccgctggcgcagctggcggacagctgtgaggggccaggcctgggcgccctagacagactgcgggcacacgcctcggctatgggggacgaagacttaccaggcatggcggcccttcagccacacggggtccccggggatggggaagggccgcacgagcgaggacccccaccagccagcgctcccgtgggtggaagtaagtgcggatgtggcctcctgcggggcgagggttacctgcagggcggaaactgtggggtccagagtgaggatggctggctttccaggtccatggtgagctttacgtttaggaatattgatgtgatcgggaagagcacacacctgctctttctgatctgtgttggggaaagatcattgaaattgacaaagttgtctttcctaggtatttggcttgttttcaaaaaatacttaattgttgaaaactagggtaagaactacacaggcttccacattcagaggctgctggagatggattagggccttcatgacctttgcagcgtgcgtgccgagatggaaccgtcagtgtgtgcccgcctgagaccattatgccaacaggtgtctggttgtagctagtggaaatcttgacttcttttgttgctttgacatctctttatcttttatagttttcatagtttccaagaacataggtctatcaaatgtggaagtgaaaataattgtgtaatttcaaaagacatgcctgtaagtatcggtcatttctactgatttggtttctctggtgattcttcaaatggaaaaacacggagctccgtggagcctcatccattcagttggtgttggttcagctcctcctcggagctggggtctttcagcttgtagcctgcttggaagaccaaactgctattgaagggaatattgaccccatgtgcttttctcagccacccatggcaactttatcttcctttggttttaaagaggatcaagaacaaggtctcccgttcctgaagttcagcccatttaattgacttttatttgcacggcaaaaatgttttaaatgttccatttaggcaaacactagataatttgtgcagcatagtggatctcagccaggggtgtttttgcgtcctgcccctggggaacacttggcaatgtctggaaacatttttggttgtcacaactaggggatgggagatgctcctggcatgcacagggcagcaccccctccccctcgagaatggtccagccccaaatgtcaagagggctgaggctgagaaaccctagtcacgtactatggagtatttatgcggcaaggggtagaaataaaactagagagcagaaccagtgtggtgtagtggaaacagcttcaaactagcagctgggagaccaggcttttgttccctgccctgtccacttctagctgtgtgaccttgaacacatacctggactgagtctcaccttttccacccttgaatgcagtgatctttgtgaccccttccatttgccaccattctgttacccaagagatagatggattggtagatcaatagataggttgatcactctataaaatagtagtctgttggcacttacgtgcgtaaccagaggccatcatgttctgagactgccccagggctttttggcatctctattttggtgtctgcccctgtgtttgcaaacacactttggtatccccagatacattgtttctgaagtccatatatgcaggtatccttcattagctttgttcctctttataaccacaggttgattgctccatgtttattccgttcagtcagaaaagaaatatccaattaggacttctttcttagtctccctcctctctcccaccaccttctccttaagggattgagattccagaatgtcagtctagttaggcataaaatctgcacaaggcccaagggccactttgggtcagaggagagacagagtgggagggagaagcgctgacttaatttcacatcctggtttctttattttttcctttgctttccgtggcagatgctataatggttgaaacttcttggactgggaagtatttgcttacgtgtgtagacactgccatctcgtggtggagccatatgtcattcgtgattatttcttgtattacactgccatcttgtggcggattcgtatatgacattggtgatgaattcttgtatggcactgccatctggtggcggattcttatatgacaccgccaataaattcctgagtgacactgccatctggtggtagattcttatatgacatcggtggtggattcttgcgtgacactgccgcctagcggtagctttttatgatactgccatctggtgatggttttatatgttacatatattacattgtttcaaggacacatatgtattatgttgttctaaggacacgtttatttgtatccttagaaacttgaaatagttgaccctgctgggtgtccccagagggccgggttgggtagccagcttcaggcatggacacagggggggctcctcgcctcccctgccccatcatgtatcagctgtgctgggaacactgcagtctaagtttggcccccagcaagtcttagtaagacaaaatttttgtaagataaaaatcaaagttgtccaaacttgcaaaccagcctctgaatgattttttccttgtgttttcaatcaatcggaggaaacagaaggcaggtcagaggagtggggcaatacactgtgatttttcatactatttacgtttttgttacagttttgtcttccctggattttaaaagtcaaatgtgttatgattatgaaatacttagctattttcatctacccattagtatttgctaatcaaaacctgtaaaaatcttgactttgctcatattgatgtttttatgatattgatattctgtttaatgttgttggcttaaattctgcagtgttttcactttgtgcttttttttttttttatctcctcatgcggctcgacagaagtgctcactgtaagtggccttgggagtccccttgctcagcgttgttgctcaggccccaggcatacgtttgtgctgtggatggatgtgttcaggatggctggggtgtggccaacgacggttatcttatagctgtgcttcaacacaagttggcaattggccttattgttatctcattgttaatattcaagctgtttaagaactttcctagaagctttcactgttcattccctgtatgtgtttgtttctggaatgtaatggcgttcgttgctgtcatatgccacctggcagctctgctatgctgtggttttgactgtattttcttcctttttaccaagcactgttcacatccttggctcttagtgtctgtctgtcttgaatgatgaaaagggagtaaagagattttcacatgaacatggggaagatttgacccttgtctccctggcactgctcctgagggtccacctctgtgccttgaagccccagggcaggtgtccggggtgtggagcgtggagtctgtgctttttctcagccggggcagttgccgacaggacttcctcctggcagttcctacttccacccaccctgtgggtccagtgactcagcctgggcttcgaggattagctccttcatttctttcctctctgtattgacttctatggcaatgatgagagagaaacgtggccagacttgcgccttgggctgggttggttgcaggtgcttaggctcattacctggtgctgtttccctgcaggcatctacagctgagtctggggaccacgcgtgtcaaggctgggaatgcaaatggtagtggtggtttcctttgctgggggttgatgcagtggttgggggggcttccatttgcagttgagggccaggtgtttgggtccttccatgtggcagggataaagaggagagctggcatctggagtcatgatctgtctgagaggcagtgcctccggccaccgtaggatggaggccagcttccagccctggctgatgggggagaagcagcgaattctccagatgtggtatggcagacctttggaagattcactcggcctccacttaaccttgtgagaccaaaggccacagccccatgtgttctgcgtgctgttgaacatgtttgtatttcattggcgtggatgataatttggttgaaaggagagatggtcaccagtggactcagtttaggaaggcacaaaggtcaaccctttccgtttctagaacttagccaaagaaaagtgcggagatggaagcgggagctggctttgagtgacggtggagtgcccagctggggcttccaatttgattccgtgttccagccgagtgtgcccctccacaaaacagactcctgggctcacagttgcatttagcgcgggaagatgatatacatgtttgtattggttttgttaaaaggaacttattgctatgaggaaatgggtagaaacggctgatgaaatgttaaaaggaaacatttcaatggctatttttggctcttgaataaaatagatgtgaaagataaaaataagcatagcaggaatagcagcgtgctaacccagaagggcggctggaaggctcctgcctgcggtcactgagacagccacgcttgagccccagcttcctcccccggggccgcaggcctcccaggtggtgttttcagagaatgagtgtgggttcaactgtgtcctctgctttgaaggttgctaatttttctagggtttatttggataattaaaatgtttttttcctgagtataaaagcagtatttgttgtataaaacatgggaaatacccgacagcataaagaaggcagtgaaaaccatgacctcttggcgagcgccgctgctgttcccatcgggctaatgctgctttcctgtctcgtttgtgtgcgcggctttcagaaagtgccatttgaggggcttctcatcgtcatcttatgttctgtgtgttcattaagggggtggaaatagatttatgaatccaagaggtagcagaagttcatttcttcaattttcccatatgaaaaacaactagagcacagcatgtctccgtgtgtgtgtgtcccagcgagtctctggaacactcattgacgaagtgtgtgctccagcgtcaaggaccccggtccccggtgctgttatttcctgaccctgtgtgtgtcccttacttacagcagtgactcttcgagaagacagtgccaagaggttggagaggagggcacgccgcatctccgcatgtctgtcggattattcgctagccagcgacagtggggtgtttgaacctctaaccaaaaggtctgaagctagtcttactatttccttctccctacgcagaatcacctgtgttactggcaatcacaaaaagattccgtactgaaactttcatacattgacactttgtttatttttccaggggtaggatatttttctagcttctttcacctttgggtgattgggttttagaaagaagtctttctccctggccctgggggcctaaggcttgagtctgatggagctcaaaaaggagaatcaatgtatgggagagccctgcttttctggaaaggacattcattcattagaaatgaatttcttccctccctcccttccttgttttcgtagctataggaatggtttcacaatgacacagcgccttttggaattccatgctttattttgatcgggcatctttgatgtcattatttctttgtacaatttaagtctccggtatctagaagacagttcacttaaagttaatttttgaacatttcctcaagtattacatgtggttttgaaaggcgtgcaaggttactttcttcttttatttatttattttttgtttgtttgtttgagacaggctctcgctgtcgcccaggctggagtgcagtggtgcaatcatagctcactgcagcctcaaactcctgggcttaagcagttctcccacctcagccccacagatatctgggattatagcacacaccaccgtgcctggctaatttttgtatttttagtagagatggggtttcatcatgttgcccaggctggtcttgaactcctgggcttaagcgatcggcccgcctctgcctcccaaagtgttgggattatagatctactccaccatacttggctaattttgtttgtatttttaatagagatggggtttcaccatgttggccagactggtctcaaactcctggcttcaagtgatccacccacctcagcctcccaaagtgctgggattacaggcatgagccatcgtgcccagccacaaagtctattttcctaaaacaggaacaacataagaaataggctgggcgcggcggctcacgcctgtaatcccagcactttgggaggctgaggtgggctgatcacctgaggtcaggagtttgagaccagcctggccaacatggtgaaaccctgtctctactaaaagtacaaacattagctgggcgttgtggtgggtgcctgtaatcccagctactggggaagctgaggcaggagaatcgcttgagcccaggaggtggaggttgcagtgagccgaggttgcaccagtgcactccagcctgggcaacagagccagactctatctcagaaacaaaacaaaataaaacaacaaaaatacccagcagtttgtaggcaggtacccagtaagatgcctcatggattctgggggcccgccctgttccttcagacacatgatgacctcattgacttaacgtcacaacttaacaaagccctctctcagcacgagggagctcctgcagaatctgtagcgaccggttccctcaggaatgaagttggttgcatttacccctctgttcaggaacgaagatgccgaggagcctgcctacggagacacggccagtaacggagatccccagatccacgtgggactcctgtgagtacagaccctaccctgtttcccctggggctgggctggagactgggcccaacccgtggctcccacctgcacacacagggctggagggacccttgttacccgaggtctgaggtgaggggacagaggtggcaggaaggagtgacagggaaaagtggctccactgttgtcttccaacatggagattcacagctgagagccgccacttcctggagctgggggctccggcaggcaaagtgtggctctcggggacagttgcgcccgtgtctgccaggagttggttctgctcactgcagcacaggtagcggactccctccctcaccgtcaaggaagtaatccgctggttggcaggacaacaatttttggtttctaattacagtgtcaataagggcagtgactgtgaggtgcccctgaggaaaacagggtgtttgggtcccagccatttcctttgctcactctcgtcacttcagtccagggctcctccacctggcatggttggcatttggtcattctttgttacggggactgtgctgtacctgggctttacccactaggtgcagatgtctcctgcagatagggtggggcagaatcccaggcagtggatggccactgctgcagttgagtcagaaggatggttttacttggggggcacctgccgtccatgactcgtgtctggtttcctaggcgcgacagtggcagcgagtgtctcctcgtgcacgtgctgcagctgaagaacccggcggggctggcggtgaaggaagactgcaaagtgtaagccaggccccagggcagtggccagccagccacatggctgaggagggaaaagacagtttgggagcctgaatttccaggaaagcaccagggagtgtgtgtctgaagtgtaaagtcttcaaaagagtctagtgaatgatttgaggctggtgaaggtgccggtgctggtggcaagctagtgtgtgccgtgttggcgtggaggaagcacttgcctgtgccgtacaggactgcatcctcctggcccggggatggggttgctgatgtcgtcgtgctctgctctgtgatcttgagagacctctggctgggaccagggcatccttgactgagcggggaggaggaaataggcattgggagcagctggtgactttggcctcgatcgtgggagcgctgcctctctgagctccgtggccccagatgggggcctgatggagggtcccacttacccaagcaggtgaccatgcctgtaatggtctgttcaagtcgcagggtggggcccctttggtgagtcttctaaaggcctcaggatccctgagtgtgagcagctgggggctcggctggggttcggccaccccaatgacctctgcagtgctcacagatggctcagcccctcccatgtgccagacttggggcagggagggtgggaaatacgggctaccccatgggtgatgggcagagaaagcagtgggggagccatgcagaaaaaccagaggggcgattcccaaaaaggtggggagcagcagggcctggaagcatccgctgcttcagtcctggcttggaagtcatcctccttgtgagtgacttcccccatccctggggtacatcgttctatgcttagttgagaaaggaactttttgcaaaggactctgagactgtagccacagctgcccaaagggggctgcacgtggggggtctgtgcgcattgtgtaggtcgcgcctgctctgggactgcgccatctgtgagcgccgcctgcacgcgctcttccctcccccgttctgtttgcagccacatccgagtctatttgcccccactggactcgggcacgcccaacacttactgctccaaggctctggagttccaagtgccgctggtgtttaacgaagtgttcagaatccccgtgcattccagcgcgttgacactgaagtcacttcagttatacgtgtgttcagtgactccgcagctgcaggaagaactgctggtatggcgccaggctccgcccgccccgtcctccttccttccttcgtgtttcagtcagccggtcttttttttgtgtgtatctttctttcccttctttctcttgtactcttttgtgatgctttcttaggtttcgtatgtctttgccttttggcctccctctctctcttctgcctccatctctagttccctccctcctttcccctctgccatcctccctttctcccgtggtgggttgcttggaagttgtgatcttcttcagtgtttctgtggctggaaatacaaacagggatgatccaaccagtgatgttgtcaagcaccttgtcctctaaatgtgtcctctcaactagtactcacgaccctgtgggatgcctttgcgtcagccccatcttcagtccagggaacaaagtagggttgacagatttagcaaatagaaatacaagacagtcagctaaattcgaatttcaaataaattatggatgctctttaaagtgtaagtatttcccatgcggtgtttaagactcacagggaaaccctgtgttgtttatttgaagtgcagattcacctgggcgccctgcacgttacctggcaaccccggggcgaggcctcaggagaatccgcagtttgtcctcagtatcccagccatccaaggcccatgccagggttggaagccagggtggattccttccatggccagagtgttctgtcttggttctgtcccctcagcggcacaattagggcatgtagagttcagcagtcgtttcttatttcagaaattcctgagcgaatctgcctcatcactgcagtagagctgtgagcctggcccagcactccaggttgcccattcttttgccctttctgatcccttcccagcactttctgattgggcggaacaggcgaccagggagccacccattagactcctctgcagttgctttcattgtgctgcagtcctttaagtaggaatgaaatcttttatgtcttgtttggttaagattgaagggtagcctgggcacagtggctcatgcctgtaatcccagcactttgggaggccaaggcgggtggatcacctgagctcaggagtttgagaccagcctggccaacatagcgaaaccccatctctactaaaaatacaaaaattagccgggtgtggtggcgcacacttgtaatcccagctactcgggaggctgaggcgagggaatctctcgaactagggagggaggtggaggttgcagtgagctgagatcgcaccactgcactccagcctgggcaacggagcaacactccatcacacacacacgcacacacgcacacacacacgcacacacacaaagattgaagggtgaactggatttttttgagacagggtctcactctgttgcccaggctggaatgcagtggtatgattttggctcaccacagccttctgagtagctgggaccacagttgtacatcatcatgcccggctgatttttaacttttttgtagaggcagagtcttgctctgttgcccaggctggtctcgaactcctgggctcaagcaatcctcccacctcggcctcccaaaatcctgggattacaggcatgagccacctgccctgcctgaactggatattttaaaggactctagtcatcacggcgaaatcattcagtgcctgttctggcatttctttaatacccctgcagggcattgctcagattaacctggctgactatgacagtttgagtgagatgcagctgcgctggcattccgtgcaggtgttcaccagctctgaaccatcaaggacgcgggaggctgggtgtgcaggagagagctccgcccgggaccctgcacacaccatctccatctccggcaagacggtacttggccctgctctaaggagctgatcactgctgccttcgtgaccctgagactggctttgtcttggggaagtcatttcttagaagtgtctttgtagacgtaagtcagtatagtggggtaaaggagtagagtttccatatggccattgcatgcgaatgtttttttaatgcaaatgtgttcatggtcatgggtggtacactggctagttttaaatatgagccctcagagctgcaggagaaggccacatgaatgcctccaccacagacctaggtagggtgagtttcttctcacggaagggcagcagagtggcctcctacctgtgccatgtggacacctgccgtgtgcgcagggtctgctggcctgagctgtcctcacgcaccccctcttcctgcaggatgcggtgacggtgctcctggccagaaccacggcacagctgcaggcggtggagagggaactggccgaggagcgggccaagctggagtacacggaggaggaggtcctggagatggagcgcaaggaggagcaggccgaggccatatccgagcggtaagggctagctcagcgggcaggctccggctcatgccctccctggaaaggagcatgggtgccctgtggtcagaaggctcgtgaaaactgtcaggggggagcacattttctctggggagacagccagtgtgccaggcagcatggctgtctctgaggtgcacttgctttcctcagccatgcctccatagaaggtgctgggcaatccttaggcaccactgcccagaagtcgattctggtggaaattgagtgctggtgtggacgagggcagctccccgaagtctctctcctgactctcacgtgtgcttttcaccttttccttctgtctgtcctggagtttcttgtcgagagtgggactgttgaagcactgccctctcccaggattggatacagtaaggtcccttgaagttgttggatttttttcttttttaacacctgtattgagatataatgtacctcccatgcagttcacccgtttaaagtgcacagttaggtggtttttaggactgaatgggcacagtcaattttacagcattttattttcatcacacactctctgcctgtccctagccaaatgcgctcccaggttctcctctgattccctgcaactacaaatctgccctctgtgtctatggacttgccggtctggacacttcctacaaatggggtcatgcggcgtccctttctgcttcacgtgaagcagcctattggtgaatccttggccccgtggagacctgcatgcgatagatgaatgattccggtgaatgggtgcccctggtgccctggtttgcgttcatcgtctctggaggtgctgtacatattgctgtacttccgcatttttccataaagtgcgccatctttccagggcttcctgctgcttcccagtggctttccctgagtttagtttacagaggaatttattttggggagcgatagtgcatgcagaggggaaggtgttgtgttcagggatggacaggagttgggaggggtttggggctgagtggtgcagttttctgggatcttcagtggctgccattggtgacagagaaagcccctcttaagtacagtccttcaagagccatcttccctggaaaacagaagcgcccttttactttatgagagatgcaacagtcttcaatcattggaaagaaataggttgtattgcattacctctactactgtgctctaagagtagcatgaaatacatcccgtttggtgaccatttgggcttctgcaatgtccgccttcaggagttggcaagcggactcggtggatagcggctgtagcaactgcacccagaccagccctccgtacccagagccctgttgcatgggtatcgactccatcctgggccacccatttgctgctcaggcagggccttacagccccgagaaatttcagccctcgcctcttaaggtaagtagaaaacataggagattgtccggagcccctcaccccaaatattttgccatacgtaccaggtatactgccctggaaggagaggctgtgtgcccccaaattcttcgtgagaagtgtgaggggatgggggaagatgcaccaaaggcaagcagagccgaggctcccagggaggagagccacgtggctgacctgcacacacacacgcagtggcccgggtgttgtggtgtaaaatgggcactgctgttggatttgggggccacagctaaggctgggtttactgtgagccgaggaaaagaagtgaatggcctgagatgtgtaaagggcttgaataggcaccgctgatccattcccaccttcagggacaaagaggctctggagggtttgtgagtcccataggttttggacatttgtagttcctcttccccttttgtgaaatgtagaatagtgctgtccttttgccccttctgctcatctgctcctagctgtactgtcaccctgtctttaggggagaagtctcatgtttatagtgcctgtgaggtcagggaaggcactgtcaatgctgttttgaaactttgtttccccactgttcagctcacaaaagtattttatcaccctcacgcccctgccctcacccagaagcacaaagtgaaatctgcccccagcagcttcccaagctgtgacccacagcaggttcctagttgttgttttggaccaggctgctggtcatggcccttgtccaactttctgagatctcaaaaagcagcagcccaagccagggcgagtggccgtgggagggttttttggtgtttccccttccctcaacttttagttttgaaaaagtgaaatctgcagtaaagttgctagaataatgcaacaaatacctgtacacctcacctggatcccacagttgttagttcttcagcacatttgcattctccctttctgtgtgggcatcacagatacaacaaagttagtatagcgggtgagtaggaaaaaaaaaaaaaaaagaacacaaactcccaccctcgagagggaggcgccaaaggagacgttgctatcatacgttcatgtcacagagagcaaggcggcttctggagaatgcaatggcagggaagcgggcaaacacttgtagagaggtttgcagttttagaaagggttcacatttagaaatgtaaatttatatttacattttacaaacatcaggatgataaaagggtgcaactgctacggaaaacattatggtggttcttcaaagcattaaaaatagaaccaccacaggatcccgcagtcccgcttctgggtatatctgggtgtatatccagaagggttgaaaggatcttgaagaaatatgtgcacacccatgttcatagcagcagcattattcacagtagccaaaaggtggaagcaactaaagtgtccatcatggatgagtggataaagaaaacgtggcctatccatgcaatagaatattattcaaccttaaaatggaaggaaattctgtcacgctgcaacatggatgagctttgaggactcatgctgagtgaataagccagtgtgaatatttatttggtcttcaactctttgagttgcatgttacctggcatgcaactcctaaaatccttagaatctgaaaatctgtcgcccaggctggagtgcagtggcgcgatctcggctcactgcaagctccgcctcccgggttcatgccattctcctgcctcagcctgaaaaaaatctttttatatgctaatgagttactggtggctggctaagagaatagaaaagcacaaaaagacaaataccgtcgtgaggttcctggagtagtcgaattcacaggggcagaaaatagaatggtggctgccaggagcttggatggggtgcggggatgtgttacagaacggaactggggtccattcgcccggtgcagtaaaaccaggtgtctgcacgaaggtgttttgcactggtggaaagagggcatttatttgcaggtgccaagcaaggagatttgggcagctcacatttaagactcagcctccccatgccttgcagggaagggtttttaaaggcagaggtaaatttcaggaaagcggcagtcacaggcaaaatcctaaaccaatccatggaggttacacgttgcttttggcctagaaggataggatatcttaatgtgggggcttacaggacgtagatggattcaaagattttctgattgcagttggttcaggaggcaaagctttgtctaaaaatttggggtcagcagaaaagatagttagctctgacttgtaggtgtgactccctccagacccctcaggaagagattcagaataaagagcaagggtcagagtgcagtcctcagctcccccttatctgagatctgtgccagcgggtccctttggtgggggtctgggtttctgaaagacagtcggggacatatgttaagatgtctttggtttctttttttcttttctttttttttttgagatggagtctcgctctgtcacccaggccgcagtgcagtggcgtgatctcagctcactgcaacctctgcctcttgggttcaagcaattctcatggctcagcctcccaagtagctgggattacaggcgcccaccaccatgcccagatgaatttttttttttttttttaagtagagacggggtttcatcacgttggccaggctggtctccaactcctggcctcaaatgatccacctgccttggcctcccaaagtgctgggattacgggcgtgagccaccgcacctgaccaagatgtctttagtttctctaggcaaccaaacatctccagactctaacttccttggctattgttttaggctactattaccttcttgcttatcaggttacttacttacatctcagggatagcgaggtacctggaatttcccttgaaagaaattgattttcctttatttccatgctcgggaggtctgcaggcccctaaaatggggtctctgctctatctcaggagtgggaatggggagttgtttagtggagaggacagagtctcagatttacaaggtaaagaagttctggagatctgttgcccatcagtgtgaatggacgccactgaactgtgcctgtacaaatggttaatatggtaacttttgttgcgtgtttttttcccacaatattttaaaaaacagggccctgaagggcctcactgagaaggcagtgtttgagtagagatcgtcaaggaagggagctcagagctttgtgcagaagcatgggcaggtgtgggagcagccagtgtgtgttgtggggcggtgctgaggacgaagggagtgtgttgtggggcccactcaggacccttccttttctctgagggcatgagaagctggtgggttttgagcccagtggcaacatgatctgaccgtagcttttttgttagtgctttctaaaatttattgagttgaagttcacataaagggaagcattttaaagtgtatgcatcagtggcatttggtccacagtgttgctcacccgccacctctatctagtttcatgacgtttcaatcaccccagagtaaaacccgtccccattgagcagtcactcccattcccctccccctagccacctgcagccaccaaaatctttctagctgtgtggatttacctcttccggatgtttccagaagtggaatcatatactatgtggcctttgccgcatggcttctttcactcagcacgatattttcaaggtttatttacattttagcgtgtataaacactccgttggtttttatggctgaatgctattcccttgtgtggataagaccacatcttgttgatccattgatctgtcaatggacatttggggtgtttccacatttggccagttttcctgggatgtccctggttgctgtgttgagaatagatcgaagggcagagaggtgtggaattgggaagactggtgaggcacctactgcactcatccaggcatgagataatggcgactcaggtgaaaggttgctgacaagtgctcaaaacccccttgatcttgaacacagagccagcagggatcgctcttggaccagatatggggtgtgcaaaagagatcggaagtccgggatggccctaacgttctttgcatgaacaaatggaaagttgagatccctgtgagaggaggggccagggtggggttggggagatatcagcttttccattgtggacgtgccacatgtgaaacgccagctaaaccccaagtggagaagtgaaagacatggttgttcccataagtttattgctcacattatgaaagaagccatagtcatgagtgaaccactccctaggttgataaggaaaccaacacggaagatctctttctggaagaagcagccagcctcgtgaaggagcggcccagccgccgggcccgagggtcgccttttgttcggagtggcacgattgtccgttcccagacattctcgcctggagcacgaagccagtatgtttgcagagtaagttggaatccctttgtcacctgtctggaatgttttgtcttccatcccctttgtgattttttttttctgctgttcatactgaaaggcatatgtatttgcaccaataataccaatccatgaactatgaactttataggtatgcggtgatgacattggtgttgtgatctccccgcatgtcctaccatgcttatctgattctggatttgttcaggattcaaattcatcccttcccccagttttcagtgttgtgtatgtattgacctgtggggcaggaagcagggcgaatcatttctacctcagcctaaggaacaagtggaagcaggggccctcttgaatgggttgagctggaggagccgggaacctgagtggcttggagccctgtggggcagccaggtttctgggccagagggtggatggtcctggcaaaggggcagtgggttctcactcacccacatgtaacttcccaacctgtggatgagtgggaggcgctcagcggttctcagccatggctgtgccttgcagtcaaatcatgtcgggggattcaacagatcctggtacccacatagcaccccagagatttgccattggtcacaggtaaggcctgggcgtcagaacttccggaagcacccagatggttctagcatgtcacacaaggctgagaaccccaaggtgggtagagggaagatgcgagccagtgtggtcaatgaaggtaggacagagtgatagtgccagcatggacttgtacagaaagggcttttaaggatgatggctcatgacacagtgacctggaggggccatttggttgagaaccatgacccttcctgcacctctgaattggggctgttgaagaaggcatctgccctggaggtgctcgctccatgagggcagagccaaggcagatcttcggagagggaagggcctcagaccctcaaaggagatgtggcaaacactgtgggagggggcctaggtggccaaaacagcctctcagccatgttggtgagacccgctgctgttgtcccattggtctgaagtgtccctgctggcagctgccccaggtggcgccgcgtccggtacaggccctcccacccgtcacacttcagccccgtggaggctgatgctcaagcgcttggctggacgctctagatggaaggccacgttcaccgccctccttgttccaggctcctgccgagccaccaacgtgtcggctggcggggctgcttattgaggcggggagggtgcaagcaggtagtgttttgcttactcagaggaaatgctctgtgtgcctgcgtaacagctgcacttactggcgatgcttctggatgcttcgctgttctgtatgtttgtatgaacgccgtgcaggtatgctgccaggccgctgcacttcctgaataggtttactggcgtggaaaataaggccacgaaggcagggatgttggatttcacacagattgacactgatcctgaggtgagaccctgccaccaaaatgaaggctgtaatgacttggctcccataaagatgacattctttacttcctgtttaaaagcacgccctgtcctttgatgggcacagctgcagttggcaatgttggcttgtcctactaccagaagtgagtctcttttttggaagtcactttccccagctattgccaaagccacaaatacagcacatgagaaagactgaggaaaagtgaaccgtgctgagggcagcgctagccttcatgggggctgtacagggcacaaaatggcattggtatcgatcacacagagattttgttggctcagttagcctggaaactgggggagggtttcgtttgctttgtttttgttttgttttgttttgtttttttcattttagcagaaactcttctttaaattgaaacccaaagacctgctacaagcaccaataatcataagtgcactcgagggcctgtgaagaggatgaaaagaatccattctgagactctgactacacacacacaatgaactgtgcattgctgagaaattgtttctgaacatcattcttttttgtgcagctttatcgtagtgacagcgacagttcaacgctgccccggaagtccccctttgtccgaaatactttggaaagacgaacccttcgctataagcaggtatgtgccctgtaaacaaatatggaatctgtgcttgccctgcgagtgattttacaagccttaaaaaggtaacatttaaggtcatgtaaatgaaaaggtagtatttctatttcttgtttacttaacagatgtaatgtcgtaatgttgctaatatttcttaagatagtatcatgatttcagataatctgtgatctttacattcttcagtataataaataaccatttttatataataggctgttttctctttttttgacaggagagtatatatagtttagaaaagttgagtttttcaacatgttgcttttctgggcagggatcgtttgaataatatatatatatatatatatatatatatatatatatatatatatatatatatatagtgtgtgtgtgtgtgtgtgtgtgtgtagagaggaagagagacagacacacaaaaaacccccaatttccacgtggcagttgtgctccaccacatacaagagtggctgctgactgggaagaataagaaagtttataatttgggccgggtgcagtggctcacgcctataatcccaacactttgggaggctgaggcgggcggatcacctgaggtcaggagttcgagaccagcctgtccaaaatggtgaaaccccgtctctactaaaattatgaaaattagccagacatggcagcacgtgcctgtaatctcagctactcagaaggctgaggcaggagaattgcatgaacccgggaggcagaggttgcagtgagcttacgtcatgccactgcactccagcctgggagacagagcaagactccgtctcaaaaaaaaaaaaaaaaagtgcataatttggcttcagaagtgtctctcagcagcaccactgctggcatttcagacaggctcattctttgctgtgggggctgccccgtgcactttaggatgttgagcagtgtccctgggctccacccaccagatgccagtaacaccccatcacatacacagcagttgtgacactcaaaatgtccacagacattgccagctgtcctcccgggggccagattctcctggttgagaaccatgaagctctgctgagaattcagcagtgcttttaaagaatttatatttgttaagttacaacccatatttgcatttaaattctgtgtatgtgcaaaatagcgttgtgtgtgtaaaaagcataccgtgactcaggccactgacccatggtgattggcgaatggatttgtggttttgctgcggtgactgctgtctcagggttctgtttcccattggatgggaagtactgctctcagttccgcagacaagagtcttttccctgtcagggctttcctgagcctaggtatgtttgcttacttgaggcttatatggggagggaagctttggacagcttgcatgtgtgtgtctgcgtgtttgcgtgggagtgtgtatactattttttaaacaacaagcactcatggtttataacgtactttctttccccttgtacagtggatcattaagatttttccatgtccatatatttttttcaacttgttacaatggctacattttatactggccttgtaatttatttaacgtttcctgctgttatagacttacttttttttttctgtcataaaccttaattggaccacttttgcatgtcagcagttatgcctttcagatgcaagtttgctgtagacatatatatattctcaaatggcccttcagaaagattgttccatttttgatcctgccagccccatataagagcatctgttgctgcacatttctgccaatacataggtcatcattaaagaaaaacaatttgctgttactaaccttgatactgaactagagatttacattcctcttgcccacatctgtgttttttaaccttgggcgtgcttagagaaatacgtgtgcctgacctgtctcctattaattgtggaagaaccttctagaaggcctgagtgagggctcacagctggcgtctcttgcagtcatgcaggtcttccctggctgagctcatggcccgcacctccctggacttggagctggatctccaggcgtcgagaacacggcagaggcagctgaatgaggagctctgcgccctccgtgagctgcggcagcggttggaggacgcccagctccgtggccagactgacctcccaccctgggtgcttcgggacgagcggctccgtggcctgctgcgggaggccgagcggcaggtgggggtcccctgtggccagctcccgcctgcacctcactgctccctgctccaggctctgaagggagcctcccagacacagaggtggtccctgaaataccccaccactgggctcttggagtcccttctccctctgtgggctgcgagggtggcgtctgtgtggcttctgcgtgcatctggaggctgcgggtgctggaggaggggtcacgggccctccccaccttgttgggggaacattctgggtccccagtcgctaggcctgactccagccaccccctggcctctgtctcctgggaggaattccttggggggagtgtgggtgaggtgggccttactccctcctgtcaccactcgctgactgtggttggttcttctgggctccagggttggcagtgaacttactcattcttccttaaaaaaaaaaaaaaaaaaaaaaatcaataaaatcgtcttgttggtccaacgttgctgttccagacaagacagaccaaacttgactaccgtcatgagcaggcggctgagaagatgctgaagaaggcctccaaggagatctaccagctgcgtgggcagagccacaaagagcccatccaagtgcagacctttaggtatggcggaggcgtggcaaggccggcccctcggccctgcttcctccttactgtcgtgcctttggcatggtaaaaaagtacagtgagtctgtttttgtttttcttctgagacagagtctcactctgtcacccaggctggagtgcagtggtgcgatcttgtctcactgcaccctctgccccctgggctcaagcaagtctcatgcctcaacctcccgagtagctgggattacagatgcgcactactatacccggctaatttttaaatgttagtagactgggttttgccatgttgcccaggctgatctcaaactcctgacctcaaatgatccacctgcctcagcctcccaaagtgctgagattacaggcgtgagcccctgcgtctggccgtgtgagtctgtaaaacccctgggaagttgagaacaaaacaggaatccactgcagccagtagtgtattttcatgtttttatcctgatctttttttcctacagtttttttttcatgccacttctaatcataatgcgggttcagtttggcatttagcattttttaaattaaaatattccatattgctatataatgtgctatcttgtttgactgtaatgtctcatctaatagtttactcaaccactatattttataacatgctgctcgtcttcaaatgtttgctattgtaaataacagtgatatacatacacatacatatatgtccccccacccccagacagggtctcactctgtcagccaggctggagtgtggtggctcagtcatggctcattacagccttgacctcccagggtcaagtgatcctcccacctcaccctcccaggtagctgggactgtaggcacatgccaccatgccctgctcatttttgtagagatggggtctcactgtgttgcccaggctgatctcgaactcctgagctcaagcgatccacctgcctcagctgcccaaagttctgggattacaggcatgagtcgctgcacccgaccacctttgctttttcagttaacttttgattaaggcaaaatgtatctgcaggaaagctgcgtatcatacacacatggtccagtgaattgttacaaactcgtcctaagaatcggtcattatcagtgcccccagatcccacactagagtaaccaccaccttgaattctaatagtatagattggttttgtctgtttttgtttttgctgaggggatttttacagatgcatcagtattcttttgtgtctgtaaaaaaaattaagttgaaattcacataacataaaatgacccattttaaagtgaacagttcagcctttggcgcattcacaatgttgcacaaccacccctctgtctagttccagaacatttttaccaccccaaaagtaaaccctatgcccattaagcagtcactccccgttctccctcccctagctctgtctctagggatatgcctttctgcctgtttcataggaatgggatcatatcttacgtggacttttgcatctggcttctttcctgcagctgagggttttcgaggttcatccatgtagcctatgtgccagtgtgtccttccttgttaagggcgaataaaatgtgtcttttagccctaatttttgtatacatttaatattcacatagttttcactttttcattcatttgttaatacgacaggtatttcctgagcacctaatatacaccaggcactgttctaggtactggagatgaagaaacccctgctcttacggttcttcataattaacatttggagactctatacaagcacatgtgttgttggggacttaaattcagtttgttgtatgaataagaaaagccatgattgatatgagagccaccagctttccgtgtcttcatatcagcttctgacctgtaattgtctccggtcccagggagaagatagcattcttcacaaggccaaggatcaacatacctcctctcccagccgacgacgtctgatggagtgcattgtgcacatgaagtatttatccacctgttttattttcatgaagttcttagactagctgaatttgtctttaaaatatttgtgcaaagctattaatatacacattttgt

SEQ ID NO: 2982 - DNA, 128916 bp, human
cggggcccgcgccgtcatgccttggctgagcggcggccggcggcgacggcggggacagccgcgcgaggccccgcgggagccgccgccttctgcgcagccccagcgggaaccgcgccgccggcgccccccgccgcggtccccacgcccccagctccttccgcgccgccgccgcgggcccgggagagcgccgagctgccgctgcccgccggctgggaggaggcgcgagactacgacggtcgcgtcttttacattgaccacaacacgcgccagacgtcgtggatcgacccccgcgaccggtaagcgggccggctgggggcgccagacccggcgcgggcgctacgacccgggccgccggccggcgccaccgcggatgcgctggggacacgccccgcccagcgcggggccgccgccgagagcccccgggcccgggcagagctcggagcgcctccatccccggaaccaggggactccctggagtgctccggtccaggctacgatcgaggcgcccccatcccttgggcccagggagaggatcggagacaccaggaggccctcggggctgggtgaagatctttggttccgggggtccgggagaggatccaccctcccaataccccgactcccagggctctgaccaagaatggaggtgccccttctccaggcctcgagccctctgagcgccgaggccggccgcctacaggtcccccgccgctgggcggaccctctcattcggttccctcacgtcacccgctgtccggcgcctgggaactgggctcctggaatttcctctcctggggctgacagatggccctcttttcctttctctgcggcagcctcgcccatcccggtcccgggcgtctgcggcccactgccccggccctggttctgcaggtgtccccagccccgcggtggcgagatgagctgtcaccttggatcacaaacgtgcgccccagctttggggtgcgggttccctgtctggcgggttcaggctggtttccatccaaaacctgatgtcagacgggcccttgagggattcccaacccttttggagttggagaagtctgttcccaaactctagttgctctttagcgccttaaaactcgtgagttaaaactgtttgaaatagccttctgtactgcagccagaatgcaatatgattagtcccatatgcttttggaataaacgaaaaacaagaattgtattttaagtttcctttttgtgaaagatatgcatggggtacaaagctgtcttattcacgtataaaaacccaatcaagtaaaaactgattcttgtaaaagcactatcagatttcatttaattaattccatgtaacgaagctcttccttaactttttgctcgattgtctacgggtttcgattgttcaactgcttttacagagatgtattttgtgtggaattgggatttctgtggacatcaagtgtttccacaggttatctgatgtcttgtcctctctagagcaactctccttccagggcctgagtgccaaaaaggaaacaccacaggcttcccagtgatttgaagacttgcaaaggcccagtgtggtgacattgtgcctgcttcctcctacctgcacagggaaggcggcctgcatggcactggcgtctgaaaataaacttttgaggagagaagctgctgaattgtttgaagatttctctgagttcaagcaggggaaaacaaaagaaagcaaaacaaaaagatcgtgattccctaacattctcgctgaacattgcaaacctctgggctcagaaacctatatcaatcctagtacaattttatgggttaaaaagatgcctagttattttgaaaatcaggtgagatcatgttataattttaaccaaaggctagagccccagctgtttgatcaacccttggatggttctggaattggtagaactgcttggaatgcagtgcccttttataccatatgtatgttaaaaacccaaacaactggaaaatgaaccaattaaaatagtgttttgcttagaaaaggctaaggctcactttccaagggtaatataaaacagttgtggttatattggagtggagattcatgctgaaagatatcaatgtgaggattttctttttaatggtgtaacctgtgacaaacgtgaatggaccatacagaaatcagcttggagaatcttgttttccatgtatttcagacacatttcctatattccttttttccagaaatcgatttgttacttttcagacaatcacttaaaggtttttaaaaagtctccgttctgatgctaaaattgtcaattgagtcaacaaaagtggatattttaccttttttttgtaaagtaaaaacgtgtgtacttttatgagacgttgtttttatagtgagtgaaaattcagcaggggacagcttgaacttcagctcccataataccttgcccgaaatatgtatggaatgttcagcaagccacaaacatttaagtggagtcggctgaaggctgtaatagtcattcttcttcctctttcaaaacagaacctggccgagttttataggtggcgggttaccctttaaagttgtaattaacttttattatatgggaagaactgcatgtcagagggcagtgttttctccatgcgcatctgacagttaaaaccctttttgagttgcttttgagtcacacaggaaaatggtattcaagaaatacgaggactttcaccaaacagcttccacatagagacctgacaggagaaaggcaaatacataatagctttttttttctctttaagaaaatgaaattgtggtggaataaatgaatgtagtaggttaagtgaaaattgttgttgactttaaacataatttcatataaactttagtaaaaactgtatagcataaaatatggtccaaggattgtaaacaaaatctcttcttgagttttatagtaattccattcagtgttgtgtttaacatttgatagtgccggctcagagcctgttggtgaaattattgtaactgctttttaaagttacaacaaagaagatacaaggagacgtctttacggatgtggctacagatgtatacacaatctcaatattttaaaaacaattttttagtttgattataagcctacctttggttggctgggcgtggttgctcatgcctgtaatcccagcactttgggaggctgaggtgggtggatcacttgaggtcagttcaagaccagcctggccaacgtggtgaaaccctgtctctactaaaaacacaaaaattagccggacgtagtggtgtgcgcctgtagtcttagctacttgggaggctgaggcagcagaatcacttgaaccctggaggtggaggttgcagtgagccgagatcgcgccactgcacttcagcctgggtgacagagagagactctgtctcaaaaaacaaacgaaaaaacctaccttcactttaaattcactatttctatagattgatactgtacatataattttcatagttagtttactgggaatcatacccaagaacttggttaaaaactacaaagttaggccaggcgtggtggttcatgcctgtaatcccagcactttgggaggcccagggggcaagattgcttgagtccaggagttcgagacgaacctgggcaacatagggagactctgtctctacaaacaaataaaataattacgtgggcggggtagcgtgcgcctatagtcccagctactcaggaggctgaaatgggaggattgcttgagctggggagatccaggctgcagtgagccgtggtcatgccactgcactccagcctgggtgacagagtgagaccttgtctcaaaaaacgaaacaaaaccccacaccaaaaaaaaaaagaaacgaaaaaacaaactacaaagttaacttatttctatggctggtagtttccttacatgagtcttgtgtggtttacattagtggcacactaatatcttaactgaatatattaactcagaataacttgaccaccttatgaaaaggtatttaccattgggcagaaaatatgggaagaacatttttgccccctttgtaaagattcactgtctttgacagttgtgtttacgtgtgtgtcttgcagggttatttgggtattatcctatagatggactgagtgtttgaaacctcatgttccatttcctgtagctcaggtggagttgtacggtactggaaatgccagctctgggcagcttaagtatggtggacgataccatatttgagatcaaagtataaataatcatgcggatggcggaagagcaagatcatgtcatggcataagcttttggggacccatttgttcaccagatgggatttgacctgtgcttcatggaggaattctgtggtatcttaaaagtcttctgaagatgcttttgctttaagaggaaaacaatccatagctctggaatttgctaggttggatccccatttaacagccaaataacatcattgctaccttcttggaacctttatttagttattcagtattaactaataggaggtttactatattcatcccacagagtctatttttggactatataaactgtcctggttgagctttctgataaacaggtaatgatttctccctttttctttttttaaggttatagatagtgtttgtatgaacatgggggagcatcttgtttttaaggctgtaaggggtcagtccctggaagaagcggctcttgcttccatttagatcatcaatcctcattttttggtctaacattttttggtcttttcctttccttccatttatttgtttatttatttattcatttatttattttttaaagaaaagtgaaaggaaaagtaattcatttccaaaaatagctcctggatgtttggaaatctccaagtttccttctccttcctttcactctgatttgggaagtggaaataacacgtatcaccatctctagttaggttctacttcaggagcccatgggtcaggaacatgttcatggtcatctggtgagcctacggtaggcttcttgacttccattccagatccttttgctaatggtgtctatctttcccataaattcaataaaacaaatctgatggaataaaagcaaagttaaattctactgagttcagttatccctgtttaataaagtgaagaaatatttgtggagagtcttggccttctgtgtgcagggacagtatgtggaaaccaagctggtctgggaggtggcacacagacacataaaatgaagataacaatagttgcaaggcatcccaggattgattcagtttctcggataatgatcacttcagagaaaaggtgggctcacttgagcctggggttgtctttttccttgcccatccttctgggtgaggggttctagtgcttttccagcagtagaaaagcaagatcatctataggatgatccactcagtccatctatagggtaatacccacacaaccctggaagacgcacacgtaaacataactgttaaagacagtgaatctttacaaaagaggcaaaagtgttcttcccatattttctgcccaatggtaaataccttttcttttcttttctttttttttttaaatggagtctcactcttgcccaggctggagtacagtggtgcgatctcggcttactgcaacctccccttcttgggttcaggcaattctcctgcctcagccttccaagtagctgggattacaggcgtgtaccaccacacctggctagtttttgtatttttagtagaaacagggtttcgccatgttggccaggctggttttgaactcctgacctcaggtgatccgcctgaggtgaggcccgcctcagcctcccaaagtgctgggattacaggcgtgagccaccgcgtccagccagtaaataccttttcataaagtggtcaaggtactctgagttaatatattcagttaatgtattagtgtgacactaatgtaaaccacacaagactcatgcagggaaactaccagccatagaaatgataagttaactttgtagtttggtttttgtttttttggtgtgggatttttctttcttctttggaaaaaaaagcaagatctgggcaagataaggggaacaggagaaaagtgctggccttgaggaagtgctgggtgtgttcggaataaatgagggaatgagtcaactcgagtgacccagagctgtcatgtaagggaggtaagactcaggccagagcatgtagctcagggtcccacagctttggggctggaagagctaggatcatcttgttcaaattcctttttctacttgacagccacagccaatgggtatgttctgccggctgctagaagggcaagggacttgagctgggtcttctgacccccgtttgggtgctctttccagaatgccacccagctgcccaatccacacaatttttaagcatcctgcctctgttcattcatttattcattcattcaacaactgtttgttgcacaatttctgagtctaaggcactcttccagggtttgggactccagtgttgagcaacaccagacaggctgccgtggggcttaccttgtgctcgtgtccttttccacgaggcctcaccatgctgttcctgcctgctggtttctccctgcggggatcccttggctctgtgattgtgacagatacatgcggaatgcactaggcttttgcatggatgttttctttcttttttcctgtatcagctttttcaggttgaattgcatgaatgttttcatcgaaagcccatgatggctgcatgaggtgtaggcgatcatgtgataaaactgaggccaggggagattgacttagtagcctcacttcctataggcagtgaggtcaacatctgttcgacttcggagttgagccaggtcccctgcctgttcttgactgtgccttggctaggtaactgtggctaggtaactgtgcgtgccccttgcactttgctatactcattagttattttgatcttgcattcattattgtttgatatttaatccttcctgtggtatagtggcccctcaaagatgtccacgttgtagtccctgaagcctgttaataagtaaccttccatggcaaaagagactttgcagatgtgattaagttaaggatcttgagataaggagatgatcctggattatgtgggtgggcccgatgtcatcataggcatccttactagagggagggaggagggtgaggtcagagtcagagatggagatgtaacaacggaagcagaggttggagtcaagtggccatgagccaaggaatgcaggcggtctctagaagctggaaaagacaaggaaatggactgttccctagagcctgcagatggaacgcagacctgctgacaccttgatttttgccaagagaaactgattctggacttctgacctccagaactgtaagataataaatttgtgttgttttaagccactcggtttgtggcaatttgttacagcatcggtttgtggcaatttgttacagcatcggtaggaaactaacacccccacatgcattgttatctcagtgagaatggaagcatctggtcagcttggtgtctgcataacaaacacagcagcggctgacatttattacatgcttaggcaggtactgtgcgaagcattttacatcttttttctctccctggcttctcacaatacccccagagggtcctcgtttcttgtgcaagcatggagagtcactcacattgggactcgcatcagatgtgctgtaccaaaaacatatttgatgagctagctaaatgtgggggtggggagaggtaggctttctgagagaagaggccagttggaaactagtggaggttttctcaggtgatcacaggcctgagctagagcgatcaggggcactcgggctagaaaaggcagggattgtgtcagagacattgtgaaggaaacatggtgtagaggacttagctaatgcttgaatgaaggcaggtgaaatcaggagggctgctgaggaatcttactggcacctaaggaggagccgggactcactggggccaaccgaaaatccttctattaaccccactcagaagctttcattggtggtggtggttttgtgtgttcagtaactccgttacatagagaaacatgttaagctgttcaagttactgtattgctgatgggcagtgtcctaaaaggtgtccaaaccaagaaagtgttatttttgttttattttatttttggagacagggtcttgctccgttgcccaggctgtgtagtgcagtggcatgattatagctcactacagcctccagctcctgggctcaagcaatcctgaacgtgttactttagaccagggtttctcaactctggtctaaagtaaccctggcggtggggtaattccttgttgttagggctgtcatatgtagcatatgacgtttagtagcgtccctggtctgttaccactagattgagatattagtagcaaactccccaccctcagatgtctcgaaaatgtctccagacattaccaaatggcccccggggcgggcagtatcccttggctgagaactgtctgagctacctccatccacctggttacaatgcttcatctttagctgctgaatttgtttcaagcctgttgtcagttcctgagatactatgcaacagagacctgatttctgtgtttccatgaacaaatttcaaacatatttatgtgaaaaaccctgaaccagtatatgaaactgggaacatatattactatgagtgtattcttcaattcttagaatactctcaattgataggcatttactgactgtcaagagtatacatatatgcagtgaaacagaagaaaatgcatctgttcacactggtgttctgcagcaacctggagagctggcctggccttttgaatgtgtgtgtgtgtatgtgtgtgcgcgtttgtgtgtggagggagagatcaggctgcctaagatgctccgagccattcagtgccccgagccattcggttctccctttggttcggaggaaggaggggtgagaggagtggagtgcttctgcctttgctcagaaattctacaaatacagagcaaggacatctcgaaaggccgcttatggagctgtgggatctccagcatttttcatctggagggttctcttttcatttctttaaaactgaagggactgagagagagcatggggaggagggagggatgttgatgttgagaatgaacgggggagatggctgcaccaagcctgggatcaccagccccacagtggcagtgggtggatctttgaggcaggcggaggtgccccaagtagctcctctgcccgaggctccgtgctccaggaaagagggcatctaccagcttgggtatggtgtttccaggcggcccggagctcggccaggagaccacatagtcactgcaggagacttgttctttctgccacttagagctctgtcctgtggacgggtgcctgtccccagcatgggggaggccttggagtatggggtcaactagatttaccttaaacattatttccatttttaaaaaattgagatactataaaatttaccttgggcacggtggctcatgcctgtaatcctagcactttgggaggctgaggcgggcggatcacttgaggtcaggagtttgcaaccagcctggccaacgtggtgaaaccctgtccctactaaaaaaacaagaaaaattagctgggcatggtggtgggcacctgtaaccccagctattcggaaggctgaggcaggagaatcacttgaacccgggaggtggaggctgcagtgagctgagatcgcaccactgcactccagcctgggcgacagagtgaaactccatctcaaaaaaatgaaaaataaataaaaataaataaaagtgtacaatttagtgggttttgttatattcactagattgtgcaaccgtcacccctatgtagttctgaatactccataaagaaacgctgtgttcattagcagtcagcccccatacccccagcccctggcaaccgctaatctgcttttcatccctatagatttgcctattcgggacatttcacagggacctccctgtatatttctttgcaacttcctatgaatctgtaattattccaaaataaaaagtgaaaaagagattgagaatgaaggaaccaagcagagatctagttatttataattgaaaaataaatttaaataatctcatttagattttattgtgttttgtctatatagtacttagcatatagtaggccctcaataaatgtttgctgaatgaaattatgcatgtagagacaggttttattgatttataatgatcattctgtattgctgtatttcactgacttttcctcatgtacactattctgatgttctcaagagcagtccctccttgtaagctgtcagagcacccattttattggggtggccacaccttctctcggctctggagttacgaccttgtctgtacttcctggtgatgtcctgattgccctaagccagtgggtctcaactgaggattccctcttccttctccctacacccagagcattcggaaacatttggagagatttttgattgttaacacctgggggtaggttctgctggcatccagtgggtagaggtcaaggatggtgctgaacatcctacaatgcacaggatcgaccccaccacagcaatgaatgatccagcccctaatatcaatagtgcctgagattgctctaagccaatcatacagcatccgggcctgcaattggctgaggcaggagcacatgactcagacctggtcaatgagctgtgaggggaggtatgagacaggcatggttggggagaaggctccttgtccccatagacctacgtggaaggaacttctcctaattgatgctctgtctccatggaaacctggaggtgggcagccacactgatgcccccaaaactaggagggagctggctgagaagctgagggtggtggagtggaaagtctgtctttgatgaggtgggtggatggatgaattaagctttggtagctgtctgccttcagtaccttttcttacgctaaacgtggtaacagcatcatcttatcctttagagccagtcgaattagaatttctgttatttgcagccagctaaggcattctcactcgtgtgttttctgttccttgccgccccatagttttcatgattggcataagatgagaggtttagactgccactgagctgctgtcccctcacttattaaatattcctgtctttttcactctgatatttatgattatataagtactaaaattataatggtccctatgtgcagttattttctctgtagttttgtttttcatgtttgtcttaggagatagttctaggcatggaatgaataaaacccaatttttttgttaatttgtttgttttaatatatttttattttggaatattttagagttacagaaaagttgcaaagattagatggtttccctgttgttaacatctaatatcaccgtagtatattctgtggtgatgtttctttgtcaaacctaagaagccagccttgataacattactattaaccaaactctagacatttgaattttaccattttttccagtaatgttctttttcagttccagtggttttttagaactattaaactcttgatatttgtatggttcaacctaatatttctaagtttgtccttcatctttgtttggtgagtattcttttgtgcagttgacagccttgttagatttgctccaaggcttcatggtagagtgcagggattctaaaggattttggaatcatggaccctgggaaatctgacacaaggtagggattctgcgttcagaaaaaggtaccagcacacagaagcttgcatatgctttcaggaggattagagctctctggaaacccagctgtggttcccagaataatggaggcttggtttgaaatgagcagacacccccagagatgtctgccatgcactcactctgtattgttgaatgaatgcacgctcacatattcaccatcactagcgtaggtgtatcataaaggattaattcaacagtgattcagggagaaccttccgtgctttctccacttcttcccctccctcatatccaacccagctttagactgtggtgtgcagccactggatacacaagtactagataggtttcacatgaaaaggggagctgtggatgaacctcaaaaatgtgacactaagtgaaggaagcagatgtggacacaacataattatatgatttgatttttgcagagtgtccagagaaggcaaatccatggagatcgaaagtggattagtggttgcctggggctgggggtgaagagtgtggtgactgcagttgggcacaagggatgtctttggggtaatggaaacgtactgaaattggtttgtgtgttgcataagtcagtaaatttataaaaaacattgaatcttacatgtaaaatgggagagtttatgatatgcagattatacctcaataaagttgtttacaaacattgttttgtttgtttgcttgtttttagacggagtctcactctgtcacccaggctggagtgcagtggcatggtcttggctcactgcagcttctgccttccgggttcaagcgattcttctgtctcagcctcccgagtagctggaactacaggcgcatgccaccatgcctgactaatttttgtagttttagtagagacggagtttcaccatgttgggcaggctggtctggaactcctgacctcaaatgatctgcctgcctcagcctcccaaagtgctgggattacagacatgagccattgcacctgggcgtttacaaacaatttttaaagcaaatctgtttttaaattcaggtggttaccttgatttggtagttggagaaaccagactatgtagattagacttggcagcctctaaccacgcaaaaagctttttcgggcttctcgaaatgtccatacaatttccagggaaacttgccaagaagccacatgttaacattgcccaggagtcttgccaactgtaaggggaggataccaccatgtaataacccgctaatcattactaaattaaaaatatagtgggtttttcactaaggcaactaactttttcattgaggcatttatctaatagggtgactcattagtaccactatttgttttataaagttgagtgatatctggttacctggcagtatttggagtcaagtgaattttgtgaataaatgaccaattgatacttggcctttaaatattaacattttttctttcacatgtttatttcaatgtttaatattagaagtgtttaggagtctttatttagaagtttggtgatgtttttgtgaccagaaataggctgtaggaatttaactctagttaataccaattagcctgtggtcaaattggtttccttatgtgttgtttcacttaaagttatagtttccatggaactattgaaaacgttagtgaggacttactacttactgtaccactaactgcagggactacctaggtgtgggtagccctgatttcagacatggacagctttgagtctgactcgggactgctatttgctgtgtctcctaaggcaggttatttgggctctctgagcttcagtttcttcttccataaaatgggggcaaagcatttgccctctgggttgttttgaaggctctaagattaggtaaggatcttaggtgagtgtctgctgcagaacaggcactcacatgttctttgtccttgtggtcatattacatactccttcagctttgggatacctcagcatatttagtcttctgcttatcaaaattccctcccttagctgggtgcagtggctcatgcctgtaatcccagcactttgggaggctgaggcgggtggatcacttgagcccaggagtttgagaccagcctgggcaacatggcaaaaccctgtctctacaaaaaatacaaacaatagctgagcatgtccctgaagacccagctacttgggaggctgaggtgagaggattgcttgagtttgggaagtagtggctccagtgagccaagatcgtgccactgcactccagcctgggcaatagagtgacaccctgtctcgaaaaaataaataaatcaataaaataaaaaaaaaatccctctctccatgattccacttctgcttctgagttgcctccttattttccttgtagttgggtagcactggaggctcagcagtgtaaagacaagggctcagagtttatgataactgtttttcctcactaagcaactgttctttgcattctcatgattttgtggctggggaagcgaagttgctggaagtgaaatgttactaaagagagataacagattagaggagagccattgagatttttctgtcaagggccagatagtaaatatctcaggctttgaaagccataggattctctctctttctattattttttttttttttaaacccgtaggacttgtgaatgaaggccatggagattctgttgcaactgcccgaccctgctgctgtagtgcagaagcagccatagacaatacagaaacaaacaggcctggctgtgttccaataaaactttatttacaaagacaggaggcaggctggaattgacccatgtgcagtttaccaccccatgattgatgtcatttgtcattcttttttttttttttttttgagactgagtctcaccctgtcgcccaggctggagtgcagtggtgcgatcttggctcattgcaacctctgcctcccgggttcaagcgattctcctgcctcagcctcccaagtagctgggattacaggcgcacgccaccacgccaggctaattttttgtatctttagtagagacggggtttcaccatgttggccaggctggtctcgaactcctgacctcatgatttgcccacctcggcctcccaaagtgctggaattacaggcgtgagccactgtgcctggccgatgtcattctcgtttactaatacagtcttgcaccgaaatgatggactgcatatacactggtcgtcccttaacattgtgatgccatatttttactgtaccttttttatgtttagctatgtttagacacacaaatactattgtgttactgtattgcctatagtattcagtacagatttgtatcctaggagcactagactctactgcatagcctaggtgtgtagtaggctgtgccagctaggtttgtgtaagcccgctgtgtgatgtttgtacagtgacagcattggctgacaatgcgtttctcagaacatatcctcatcatcaagcagtgcatgactgtacagccaatgcttttgtgtcacacactttcattatcgttgcattagcttggccacaaatctgaaaatactctgagtgtgtatagaattatactgatttctaggtgtgatgtcatagtattctggaacttggaaattgtagcactcagtgatgctagagacttaaaaaaattcacattatatgattagactttgtttcatagctagcagtcacttaatactggacagatgttaagaatagaagttggctgggtgtcgtggctcatgcctgtaatcccagcactttgggaggctgaggcgggaggattgcttgagcccaggaatttgagaccagcctgggctacacagggagaccctatctctacaaaatattaaaaactatctgggcgtggtggcacatgcctgtagtcccagctactcgggaggattgcttgatccaggagtttgaggctgtggtgagctatgatcgccattgtactccagcctgggtgacagagcaataccttgtctcaaaaaaaaaaaaaaaagaattggacaagttgattcaagatcaagatcttcagccacgtctcagcaccctcgtacaaaacctgggaggcagttgtcatatgtgtaccgacagcttttggatgtatatttaaatgtgcgggtgaacttacttttggaacaaaatgaagtttgcccaaatttctgtgctgtttgggtctcggatggaaactctcagagctcagagtcaagggtggcatgggcagcttgtccatgtggatgcctgggaaagtccttgcttttgtggggtcacggaccagtggtgggagatgggaaagtgggtgaagctagttagaaagaggcagcagaagacagtgaacagttcatacagagttggcttcagtgtattgctggcagcatgtgcccaaggctgtaaaagatcttcccatccttaggttcacaaatgccactaaaatagtggtaactctcaggcaggtgtgactgtgccccttgggacatttgcactgtctggagacattttttgctgtccccacttgggggggatggggtgcgtcctgctggcacctagcgggtggagcccaggggtgtcgtccacacctgccgtgcagtgtggcccccccatagagagtgagctgccctgagtcagcagagctggggctctggctcacacctgctccaggcctccagcagcgagctgttctcgttggcccttgcccttgtgggtcttccgctgcagtggtggcaaatagcaatcactgagcgtgtcaccacattacaaggtgcaaactggcagggtgaggttggtgggactgtgtggctgggtgggtgaccgttttgtggagagcggctggagaggccttatttttcaggtgcctgcaggaggggaggagggaacctgaggtgtctagggtcagaggctttcagggagaaggagctacaggtgctaagatgagagcaatgggccaggaggaggatgatggggtcaggcggtggtggcagcacctcatgagccactgcagggactccaggtgtgactcagcaattctgttgggagctattctgttgggagacttaacatttcattgaggtcgctctgactgctgtgggggactaggagggcaggagctgaagcaaggagactggtttaggagatggcagctgcccccagggctgagcagtggtggctcaggccaaggaggaggcagtggggtggcttcctgaggacctggaccctgcgatttggtcctctctctgcttcaccccagctcctgagaccctccctcagaatccttgctggcttgaggagtaaagggttctgccaaagtggatatcaaggctgtcatgggtggatcagcagaggagctggggttttttcccagactgcttctcagttttgctgctggggctataaggaattccgtggaacaggaagtgtgcagggcatgcatgatgtgcctgttattttagcagtggggctgtgtcctaaaagacagcgtctttggccgggcgcggtggctcatgcctgtaatcccagcacttttggaggctgaggcaggcagatcacctgagatcaggagttcgagaccagactggccaacatggtgaaaccccatctctactaacaatacaaaaattagctggatatggtggtgcacacctgtaatcccagctactcgggaggctgaggcaggagaatcgcttgaacccgggaggcagaggttgcagtgagccaagatcatgccactgcactccagcctggatgacagagtgagactccgtctcaaagaatattcatatgtgcttttggaatgcctgtgtaatgctttaatcagtttagaaactgatattttattattatttaaaaaaaagaagtggtgatcgtttgctttctaacggctgggatggtgtggatctaaaatggtagggcttgaagtccacggtggccaactctacagcgcttttaacacttttcccccaggggaacattgtacgttttcttcaggagcactgtgacactgtttggtttgccgtagataatacggattcaaaaggcattccagatacatcattctgtgattgacctggccgggttaacccaagattgtcaccttgttattctcaatagtaaaagccaaggctctgaaaaccaccccactgaacgcatatcataaacctccaaaatgtcaccatggacgtggcatattgacaaaaatgtcaaggattaccaagaatagcttcttgcattcacatgtagttacaggcgaaggacagagtagctcttgcatttaaaatgcgactgcaatggccagaaccaataattcctgtttgaacaactcccggccctcagctttacctcaaggctttagatagacttactttcaatttttgaaaaggaacacatgtccttattatgctttagaattactaatagagataattctctttgttgtgctatttgctactcagctccttttaaaagatagatgacactgaagttttacgtaaacacatgactgataaaatacttgtttttcctgagtcattgtcagtgtctcagctctaaacctagtgccagctcagtaaatatttgatggaatccaaagtctgcattttcttaaggtgggccagtttttctcttgttatataaagtagagaaacataccaccttcttcccatttatttaggagtggttagtagcccttctctcatctgttggggtggtcatcccttttctgcatcagtgaaaataacaccctatcatttcacttcaagcacaaatgctacttttgtctcatttttggagttataaaaccatgtggattaatcccaaccaggtggtggggagccaaagctaagctgtttctttcacctctgacccgcgcgattagtttgtggaagaacgctctccaaacccataggaagttcacagacagcttggattcctcagagggtcttcggtatcgattgtgtagcagaaaaagcaagcatgcctctgggtctttcctctcttctccatagtcttttttatgtctaactggtgttgggttgctttacctctccacccatagttaaagaaagtgagtatcttggcatgttccaaactactgaaataaatgaaaatcaggaaattttccatgaagcaaaccaatgacataatggtacctcaagcacaggagttactggaattggttttgtgaagtggttggccggtaatgtttgcaaagctgggaggtgtaagaagtggttgggttttttttctcaccaaaaagacagccctacattaaagttatagttctcatattaatgaatgggttttaaagaaactgatgttcttcagttctttttttcctcccatgacttgctatgaaagtaaagatgaaacaaaagtatgactgttaggccatgaatctgttactaattaggtcttatgcttactgggatcaaaagatgggatcaaagtaagaactctccagaagcaagaaaaagaaggtgctgggaaaaggcgtcaattgcagcatagtttgtttataaatgagcaaatgaattgtatgtacagcgatccttcatagtaactacctctactccagcggaggtgtttaataaaacaatgtcttaccatctctgaccactgttactcacacctgatttctggaatgcctataagaactctcgacaatgaaaagaatcggaacatgataggcttgaagccacaggcatcatttctattttgaggtcggtcttactccttagatttcccacacgaataaaaaacattggcccatctgcagtcatgtggccgagtccttcctgctgaataacatctctaaccacagatggtagccagctccaggttagattgttctttcttttgttgagctgcccatggctccaactgaagtttacctgcccatctggtcttgttggtactcctaagagcccattcatatttgaccttatttggtgttcttaatgagcacacagtggtctgctgatttgtgaccaccactctgtggtttgtttgaagactatgcggactaaactgtgtccatcattctgggggcatgattatgaatccactcactgttctggttatgttgctcctgagtgcctcatatctgtgatgtagccattaccttcattttctgaatgtcgcacatctacttacattgttttaaaatgcacattttcttttctaggaagagggagcaggcaggaatgttatacactttatccatgatgagtgtagcagcaggtgaaaccctgaggtgttggccacagaagtgcttatatatatatatctcatatatatatgagatatatatatttgagacagagtctggctgtgtcacccaggctggagtgcagtggcacgatcttggctcactgcaacctccgctcccaggtcccagtgattctcatgccccagcctcctgagtacttgggattacaggcatgcgtgaccacgcccagctaattttttgtatttttagtagagatggggtttcgctatgttgcccaggctggtcttgaactcctggcctcaaatgatctgcctacctcagcctcccaaagtgctgggattacaggcatgagccactccacccggcccccacttttatattgaaggttgtgtatacatgtatacagtatcctaacctggtgcttttcaatcctagctgcattttagattaacctgggagctatatatttgtgtttgtgccatcctaggaggttctgatcagcagggcccaggaagccccctgacgtccgtctttcctccattaaaaaaatcaaggtaaaattaacatgacataaaattaaacatggtgaaaccccatctctactaaacacaaaaattagccgggcttggtggcatgtgcctgtagtcccagctactcaggaggctgaggtgggagaatcacttgaacctgggaggcagaggttgtagtgagccacgatctcaccactgcactccagcctgggtgacagagtcagacaccctgtctccaaaaaaaaaaaaaaaaaggaatatgaaattaaacattaaacactaactattttaaagtgtacaattcagtggcatttggtattgtcacagtgttgtgcaaccactacctttatctagttccaagacattttcatcaccccaaaagaagactgtgtacccattaagccgtcgctgcccatttctccttatccccagcctcagctgcccatttctccttatccccagcctcaggcagttactcactattctaccttctgtctttatggatttgcctattcatgcaggaaatctgaggagcgagatcgatctcaagatagaaatgatacctgtggcttcaagcctatgatgttccagttctgtttattgtagagagttctgttcttacaggtatttcagaaatcaggcattaataatagtgatcagaggtggcgagacattgttttattaaacaattcatgttaatagaattatagaatatatgcccttctgtggcttctttcacttagcgcaatgttttcaagattcatccatgttatattgtaacgtgtcaaatatttcattacttttttttttttttcttgagacagagtctcactctgttacccaggctggagtgcagtggtgtaaatcacagctcactgcagccttgacctcccaggctcaagcaatcttctcgcctcagcctcctgagtagctgagactacagttccatgccaccactgttggctaaacttcattccattttatggccaagtaatatttcattgtatggctaggctacgtttacattttgtttatccgttcatcatttggtggacatttaggttgtttccctccttttggctattgttaagtgctactatgaaatacaggtagaagtatttgtgtccctgttttcaggtttttagggtatatacctaggtgttggattgctgggtcatatggtaattctatgtgtaagtttctgaggaactgccaggctgttttctagagtggctgcaccttttcttgtttttgttttttgttttttgttttttttttgagatggagtctcgctctgttgcccaggctggagtgcagtggtgtgatctcggctcactgcaagctctgcctcccgggttcacgccattttcctgcctcagcctctcgagtagctgggactacaggcgcctgccaccacgcccggctaattttttgtatttttagtagagacggggtttcactgtgttagccaggatggtctcgatctcctgacctcgtaatctgcccacctcggcctcccaaagagatgggcttacaggtgtgagccactgcgcccggctgtggctgcactgttttactttcccactggcaaaagtataggagggttccagcttttccatgtccttgccaacactagttattttgcatgttttttttttttttggctttttaaaaaatggctaacctcgtaggtgtgaagtggcatatcactgtggttttttaatgtgcatttcccaatgactgatgaagttgggcatctgttcatgtgctgttggccatttgtatatctttttattttgaaaaatatctattcaagtcccatgcccatttgaaaattagtttatctttttgtttctgagttttaagagttctttatatattcagactagaatatataaatgttataaatgtgacgagaacatgactagatacctatcacataaatgaatttctttctttttttttttttttttttgagacggagtctcactctgtcgcccaggctggagtgcagtggcacgatctgggctcactgcaagctccgcctcccgggttcacgccattctcctgcctcagcctcccgagtagctgggcctacaggtgcccgccaccacgcctggctaattttttgtatttttagtagagacggggtttcaccatgttagccaggatggtctcgatctcctgaccttgtgatccgcccgcctcagcctcccaaagtgctgggattacaggcgtgagccaccgcgcccagcacataaatgaatttcaagtggcatccttttttgaaaagtgctcccagtgggttccattagcaaccaggctcaagaatgggaccagcgattcattccttggggcttcttacaacacacctgggaagctttcttaaacatagcccctgtccctcaagccactcaggtgattctgataatacatccccaccccaaagggagcaaacgtaaaactaatacatggcaaagcagttgttaaggtaaccggtgacctgactgaacaggtgacatcaaaaagagaatcctatgttcaaagggaaattttgaaaaaagaaaaaaaaaagagaatccagtggctctgtagagaatcagctgccatcagcttcctgctccctgttcccggaatgcccttgcagagcatttgtgaaatgtgcagtaggctgccctttgtcctgatggttcatgtgacagggtggcccagcccctcgaggtgccatcaagacttgtcatgttgtcagacctctcaggaggtgacactttgtccacctgaagggcaccctggcattcatgcgtaagcccttgaacggtgcaatgcttagttctgtggggactcgtctggtcgggagagcactctcagtacttgtttgaaatgtccctttaatcatggcaatgtggcatattgaggttttctaccatgaagaacagtatctttagcctgctttgcccccacccaaagtacccttaattccaaaggatggctgagggctgggctcaaaactgagaaagtgggatggttccggggctgttggtggagctttctaatgaaagaagttctccatctgataggaagctgagcatgggggcaggagagagagggtccccagggttttctgccccacaggaatctcttatgaggaaaccccatccatggatctgggatccaccctggtggttcccttgttgcttctgggtccataggggcgggagagcctaccgtattccacgtgagtcgctcttccttcctgtcaccttctgcaccagtccacaacctggaccctctttccccacccttgtctcctgctggtctaaaatgagttacttatgtacaaacgttgggaagaacatagggattactgagaccagatattgatatgtgggaaaagagaagaaaaaatagtgcttcaaagggcttcagttccatataaatgcatgtgttttcttaaattccatgtcagggcaaaagcttttttatttttatttatttatttattttttttttagcaaaacatttttttgctgtgcattttctataggattatcttatgtacatcatattcagtgttacagagaagaaggcaaaggaaaatctgtttcagtctcttcgtcagccatacatgtcacacattagcacatgctctgtataccagttttaaagattgattactatttcaaaaccatcgcctccctccaaaaaaggagaggctgggtctggtgtaattgttgcattttactgtttactccatgcagaagcacatcacggtgaaatgtacttagtttatgtatttggctggcatttttcttttctctcttctctgccagactttatcgtgtcaggggttgccctcagttatcctgtttctcagagcttttcctgcacttggcaaatggcagtgcccagtcttccacagctgggtggatgagtaattatttgatgacagttctgaagacactttcatcattcaaggtggaattcctagtttgaaaaacagatgctggtgaaaattactcatcatgtgccctccatatatggttcctgtttacagtataggaaaaaacaaacaataaaggcttcaccccaagtcaaccagatatgtgggcattttcctcacacaccaagcaattctccagtggataccaactggcatcctctaattcaactcacttctgataccgtctacctagagttagagtcagatcccacaggttaagttccacaagactgccacccacttcaaatgccagtcacaagtagtagactgtcacccctacttctgactgaccagctatgaatcaggatctccacaaccccctccttggttttgattaatttgtgaggactgcttacaaagctcagggagacacgttccccagtttattgcgtgagtaaaaagtatgataaaggatacagacgaacagccagatgaagaaacacacagaggcctggaaggctcctgagcacaggagcttctgtccctatggagttgggatgcacacggatgcgtctgccaacccgggagctctctgaacccggcactttaaagggatttttgtggaggtttcatcacgtaggcatgattgattattaactcagtctccgcctttctccctctctccaagcctccaatcatggcttggtctttctggtgcccagcccccatccaggagcccaccaagaatcacctaattaaaaaagacctcccatcactcaggaaatcccaagggattaggagctctgtgtcaggattccagggtcaaagacgaaatatcagaacaaaagatgtacctagcacccctattgctcaggaaattccaagggttttaggagctgtgtgccaggaccctggagcagaagcaaatatatttcttcatttgccacaatatcacacttctgaccctgctcacctggaatcttccttgtccatttagatgccaggcacgtgggggacagatgaatatttacctgtgagcatcagtcatacaagtggttctaaacctgggcttccagttcgaatgtagcatttcagaaatactgctgcctgtgttccaccacagaccagttaagtccccatcgaaatggcccctggccagggtggagattcactggctatgggactccatcttgctcacaataaccagtgaatgtttgttgatcatttcaaccccttaatgaccttggaaactagaaatggggtttgtaaaggggaaagaggtggaatagctataaatgccacggtattatttttatggaatgggagtgggagtggggcgtgggtagtgaggctggggctaaggtttgatgttctgctgaccataaaataatttgtatttgtgtcgagtagctttctcctctcagctcccatggctgtgtccctgcctttgagtgaatctgttgtgtagtggtaatttgttatgtatttggtcccccggtgagctgaattccttgaggttaactcctggcactgagcatctcaaatagctttcctgcagtgaatatttaaacaaatgaatagcactttgcagttttttcacagtgcttttcctagggtgcggtccccaagccctctcatccttagccaagattacatgcccgaggcttgtgagcatcatttagaccaagcttcatgcatgccttgcctagcaggagctctctgtacataccatctgtttgccaggaagactgcccacctctgtgccttggcatggtcattacagacaaatgcccactggggttgggcctacaaccagatggcaagctgtcagaggggtaacagggagtggtggggactgtggtgaactagcgagcagccccttctaaagggatggctctagtcagctttagccagttaccgtctttgggcactgtaatccctatgtgccaacccttctgattttctttttttaatttaaaacaatttaaggaagatggggtctccctatgttgcccagactggtctcgaactcctgggctcaagtgatcctcctgccttggcgtcccacagtgctggagggagccactgtacctgtccgcttctgattttcaagggagttagacattctgggttttgaaatgaaatctgagttttaatgttggcagcccgttgaggttttggtagagcaccctagggccaacacagcaaaccaggcagaacacttctgcagtgcaggtggccctgggcagccttggagtcatgtggttccagctctcgccacctggcttgcccctctctaaggcagagaggagcagaactcaaaaaaattcagtgatggctgcacttgtccttagggatcatgggaagaggaggctatgttagattctgggtaaaagcttccttttaaaaaatggcttttagttttgtacacacaccacaattccacccacttccctactgacaattacagctgtattggggtgtcttctctagtcttttttctttttgtaaagaaagaaaccaaaatgtgattatatatcaagtaatttttttttttttttttttgagaccgagtcttactctgtcacccagtctggagtacagtagcgcaatttcagctcactgcaaccttcgcctcccaggctgaaagtgatcctcccatcttagcctcctgagtagctgggatcacagatgtacgccaccatgcctggctaatttttgtagagatgaagtttcgccatgtcgcccaggctggtcttgaatgcctgagctcaagcaatctgcctgcctcgacctcccaaagtgttgggattacaggcatgagccaccgtgcccggacttcaaataattttatagccaccctttctcctaacgatttagccaaagtactcccaggttattacagtgtcttatttagcatattttgaaaattatcccaggtagacctcaccaacacaggagttctggttttgtgttttttttttctccatccacagcacctaacgagagcctcacatgtagccaggtattcaaggactaactctcgatgattgttgctatgcagtagtttgttggatcacatcctgagcattggacattggcttgtctccttttttttctgctattataagtagcactgtgatgtacctgtttatatgtgaagctcctcacgtattttagagaatgatcaaaggtgatactattagcacttggggctgggtaattgtttttgtaggggccgccctgagcattggaggatattgagcagcatccctggccaccacccacccgatgccaggaactcttctcttctgtagttagttataacaaacaaaagtatctccagacattgtcaagtatcccccggaggcaaaatggtagttgagaatccctgcgctagtgtaattagtggactgtgaagggtgccaaagtcttaaaagattttagaccttaaagtatgtgctgcttggggaaaatactctagtgaacggttgtccactgcctctgcctgctcctttgtttccgccacactccttcccctgagggcaccgggttctcccactgttcttgacactggagccgggctgtctgtctgtgtgtggttgggctgccgtaagagtaccacaggctgggggcttcagcgacatgcatttgttttcttgtggttctggaggctggaagtcccagatccagttccatcttggttggttggtttctggtgtggactctttctggcttgcagatggccacctgctcactgtgttctctcaaaagtggatgggggccggggaggggggcggcgccgagagagagagagagggggaagagagagagagagcgagcgagtgcacttgggtgtctccgctttctataagtgcaccagccctatgggattagggccctccactcatatgacctcatttaacctttatcatcccttaacaggccttatctacaaatgctttggggttcaggtttcaacatgaattttgagggtacccagttcagtccatagcattccacccctggccccgcaaaactcacatccttctcacatacaaaatatattcattccatcccaacagccccaaaagtcttaactcattccagcgtcaactctaaagtccaaagcctcatccagatctcgtctaaatcaggtatgggtgagacttgaggtatgattcatcctggggcaaaatttctttccagccatgaacctgtaaaaccagacgtgtgcttccaaaatacaatggtggggcagctataggacagacattcctgttccaaaggggagaagtaggaaagaaagcaggtcccaagccagtacaaaacctagcaagacaaattccatgagatcttaaggctccagaataatcccctggctagatgccccgctttccaggcccactggggtggcagcatcaccctcacagctctgttaggtgcccttctttgactgtgtgaggcccccaccctctgaaactgaggacgaaacggccttgtcccctagccctgtgtgggagtggcagcccggatggtctttgaattgccttcagggtgattctttgattttcttgaagaatagtctgtgttctcatctgaatatatctatggtcgcatcctatagaatccaagaaatccaacagccttgtttcattcacttccagtttctctgtccttgtagttcaaactggcagtgtctctgctggtgtaagcccatctttcttcctggcttctgctaagatggctgattaacatcacgggtaacctctctatggagtgactgtccagccacacccttggcgttttctccagaacaagctccctcatttttgcatccatctgcccatccctccctccctccgtccccccatccctttgtccagtcagccatccctgcctccattcatccctgcttccattcatcctttagtccatccttccatccctccctccatcctttctctctctatccccccactcatctattcatctgagcatagcgcgctccaggatcccagctaggtcctgggagacaggacctctatgatccttgactttgtggtgtgcagagtctggtgggggcgtctggagacacttgcccttcagtgaaaattcagagctaagcagcatcttgggatcagggttgcctgggcttgtggtgaggctgcctctccagggaaaggggactgtggatgcctggagtgagaagactgagttaaggtcatttctgagtgtagagcactggactagtttttgcaagatgcaaaaacaaagggcctttgcccttgcagccttgttctctgagattgggtttctagaccatcatgtgtgaaagccaggtgagcatggccctttggcctcccttggtttctggacttggcagtcaccccttccttctgacatgccccctctgccatcacaaagccgacctcgggcacgcgaagtttgcgtcagcaaaaggaactcactgtggagtcctgataagcaatgttccagcgatatgggtggccaggcagttctgaacataattaagcaggcctgatttacctgacagttctcttggatgacagtgctgaaccctcagctgctggctcagttttggggatgtgcatggacaagtttgagagagcaaatgtagttcagaaaaatggcaacttacttgttctcagtgttgctttcagtcttggagacatctgggtgttgtgcttttgttttgactggccagctgtcctgcccagccgaagctcagctctgcctagccagggctcgaggtggggcttctattcctgcctcatggtcacgtgcatcggctaagagaaggagctcagggcacagccacaggcctccgagtttgtgtggctgaaggttggttctgcaggcttcctagtggtggtgtaaagattggaggaacctttgcagacggcccagtgtgtgtcctccgaggggctcactcttgcccagcacacacagtcagcctcaggtggacttggcccagcgtgtgtgagccaggccgagaatgcaccgcttccctgaggccgcaggcacatttcagtggtggtactggagaggctcagtgtggatggtaatagcctttcggatgctcaaggatccagaaatttctgccacagtggcaggggcatatggtgacatacactggcttggttccatgtagtatagagtttggaataattgtttttatgtggagtatttcctgtgctcctgcaggtgaagaactttacttcttttctcttctaaaggagaatttggggctccctactaagctgcctcaggtggttgctgataggtctggcctctgcgtgttttggatcaagtgttgttgcccacagtcctgctctgaggattctgttgttgttgttgttaatgattcttgtgagccaatattgagcaaaatgacagagtcctccatcagtgcctgttcttttattttatatttatatatttatttgtttttttgagacggagttttgctcttgtcacccaggctgcagtgcaatggtgcgatctcggctcactgcaacctctgcctcgcaagttcaagtgatcctcctgcgtcagcctcctgagtagctgggattacagacactcgacaccacacccagttaatttttatatttttagtagagacagggtttcaccatgttggccaggctggtctcgaactcgtgacctcaggtgatccacctgcctcagcctcccaaagtgctgggattacaggcgtgagccactgtgcctggccagtgcctgttattttagagggggcttcctatatcctcaggacgtctcgagtccagctcaggaacacctggacttccctacctgttcatttgacatacctgtgtgtcaggcccctgctaggagtctgtgataaaggcgacagggaccccagtcctgccttcttgaaggggagcctagcatggtagaaatcttcacactcatcataagttaccactttaatgggcatgcgttaatgcagagacactgcagaagacgtcacactccatgttttcctgatgccgcttaacagggaaaccatcaaggtcacggaaacgggcagaaatggttacaaagtgagctctggcattgccgtccctcttgcgatggtatggagcggagatgatggccaagctcccagtcagtggcctccttgtggagtcaagaaggactgtcctggcccagtgcttgctcaggcccccttgttcctgccttgctcagacagcgggctcccttctgcccacacctcagcctccctccccgctgttccctgcagcctctttcgacaaagcagatctgctgatgacaggccctgcttcacttcccagtggcgtcctgccatctgcagaacccatctccttatcagggtggcccaggctttcttcaggaggcttcctttcaccacacccaccctcacccaacctagggcaggtcccagtccatctgggacttgcccatcatggctccagcgtcccccattcctcccctccccaggcaggttagaagcggccttgctgctcctgttgggccttgaacccagtgcttctaaaacccacccatccccacgagctgcgcttgtttgcctgggtggctcttcccctgtgcctggagctttgggaacagggttcctgaaactggagttcccagactggtagcattttgtgtatctttgaggcagcatcttgggtgtacatgtagacacatctttccaggcaggacatcgatggcttgtctcagattcccaaagagatccaagacttaaaaagaaccactgcctggggcggctgctctcctctgcatcctttcctggcacacaattaatatgcgcaggctggatgactggaggtcacagatgcttggcatttccccccgtgcttttgttcatggattcagttggtgatatatgcagcgatgcatctataaatagtggaattctcatgccccaaagaaaacgagttaagtgactgctgaaagttgttgttgttgttgttgtttttttccttcggggtgtggggtgttaattaatgccaaaaaaggcaggtgataaaatccttttgttcttactcttagaatcctggtgcaggactttctgcagctgggctccaatacaaaccagagtggggaggggacttgatcttggcagtattggaaaagctttaattgatactatagagcccgaaggactgacatctttacccctgtgtgccgcttgtcgtctgaacggatggccgagacgcatcctgggtcgccttccctgtgatgccatttctaaagaatgttattgttcagccccttcgctctccttggccagtgtagttttccttgcccaattcggttgaatttacttcttccgtccattgttactatttgtttctttatttcccaaatccttccttaaaacttctcctttttaattttaaaatatctcttcctgttgtattcagtagtaaattaaggaccaaaatattataatactgtattttattttgaaaggactgtgttaagactcccatctaaaattttggcaatattaaaagtaaaaggctgatcgtttgcttctctaactatactctcaccagagtaatcatcgttagaaatttgtcaagagggtaaaggagataagaaagtatttaaaagtggaatacggttcacattacacttattcctataaagagctcttggaacccttgaagtttgcttggaatcggttctctgagttccgtgtggaagtgcagggagctggctgcctctggcgtggcttccaagtccttgactgcccttgcccacatcctggtctcaccacttctcaggtgtgtgtccctgagctcagcttcctcctaggtaacatgggatggtgatagtgggcccacctcctcacgctatcgtgatgattaagtgtttggttgagcacagtgctgggctttgctgtgtggctgcagtgttagtttgcacacctggcaccgtcccgtgcagtggccctgcacattcagtgctccagtatttacatgatgtatctatgtatacatatgtcctgcagctttgcctgtccaagtactgtggacggttaccaaaaataaggagcctattttaattacatacacaaccagaagaaaaattaatgacatgtacatactgtactgcccctaggaagtatgatgtgctttaatattttctttttaaaataaaatactgccagggacctactcactcaatttcactgctcactgataggttgtgactatagtgtgagagccctgatatagagagtaatgggatgaatgaacacaaaggattggaagtaattagtttcgggaatgtttcaacatgtgtccagatggaagatattctggaacatccaccagccatgacttggaatttacacataaaaatctccagatgcatctaacagcttcaagtgagtgagatgacagcgaagctagtgatagcatccaagtcttgtgtttttttcttctcccaagtatttcatgtgacttggaatccttaaattcttttttccccactgtaaatgaagtattcaataagaacgtcagtgtgtgtgtgtgtattttaaaaacagctttagtgaggtgtaatttccatatcataaaatgcacccattttagtacagtcctatgaattttagtcaattatacagctgtgtgactgtcatcacaattaggttgtagaacacgcccattgtcccctgctgtccccagtcccacttgcctgactaccactgcctggtttctcttagggaaaggcatgtttcagaagtcagactcctggatggtatcatttctctgccctccttgacgagggaactgcagtggcctggggttcttcctggtttctgggccatcatgcctgaaagcctggtctggagccagtgaggaggacccatttgggtccatgggagggggctgggtactgagggctggtctgtgcgtgcgtggggtgggtctagggatttgtaagcagctgtagaatgaaggctcagagctgacttgggagtcccctaatgaggtcctctagcctgcattggctccccctgttagtgctttgcagccatgatgccattcttaatgcgacaagcccgagtttccgatcactctggtaaacagctcccgagcacctgttctgcccagtccctgaagaggaagccatgcatctgtcacactgcagcccattctccctctgatccagtctctccagcttccaatctgcacacctactcatgagcatttcctgtccagaccagtaccatctacaatcagctctagagctgccacagacaacctgttttgggtggcagactccattcagcattgatcaagtaattccgactcatcctgtatatgcagtggagcacctcctgggcaagtcctggagccctgtgggggtcaggtcagcattggaggggatgccagccttgccctgaaggaactagtactcggggagatgcaatgtttattaatgaccgcattctacttagagttttaagaactgccacagaagagatcaagtgctgaggctggccaaagaaaggccagcttgcttctggctgggctgggctgggctgggtctggacctgaggaatctgggccacatcttagaagaagcattagcatttgaacaggaaaggggcggggtgaggggaaacttggcaaagggaaagaacaatccaggtttggggatagcagttcccatgggttactgggaatgcggatggatatgagggggttggagggaagccaggagttccctgtatgcggttttgtggtcttagaagtgtggttccttcaaaatccccactagtggcttgtggaggatggcaactcaggccaggtctttcttaagtgatgcacctgtgcacctgtgatcatttgcagactcaaattactgtagaatttagatgagagtgtgacgttgtgatatccagtgcagtagccacagccacacgcaaatgagcacttgaatcgggtcagtcctaaaatgaaatgggcttaacctgtaaaacacaccgggtttcaaagactccattgaaataaagaatgaaaagcattccatttgtaatttttgtagtcattacgtgtaaaaatgatagtatttgcagtatagtgggttaaataaaacatgttttaaaattcatttcgcctgtttctttttactcgtttaagaagttttgcattaatatgtgggctctcattctgattccattggacagtgctgccccagagaattctttgtaccagctgggctaaagtctgtctctattttatttactgtaaattgtatccctagaacttatatatggaggtgaacaaagtgttttcacatcagctcaggagtgtgctcttgataggcttgttgagaaattccttttctctgttattctgtctcagagggacccttgctggggggcactcagatgatggctgcggttgggcgcccctctgggtttggtttcctttgggtggtagactcgaattttggcctcaggtcagcttgcttttagattatgttcctttcatacagtattatgctgctaaatcaaaataatagcgacattcttccagtctttagaggaaaaaaataaaatggaaggaaaacaggcattactggagaatgtaatacattccagaaaccttgataatagtctcaggccttctgcctcatcaccttatagtaaaacggagaaaatggaggcacagtgagactgagtcatttgcctatgctcaacctctaggaagtacttaaagtatagtttcctcagtttgaagtttttctcccttaaagttttaaataattgttcccatctatgtctgtgattcaataaaatatgtaccgagggaccttagatgtattcagtcattactgggtggcatttttcaggtgtttggacttccattgcaccaatgcctgaacatgcctgagaaccggtaggatcactggggctgcagagccccaggggtttgctggttttcttgaatacctcctggactgattttcctagaacagtttattctttgctggaggatagaacatcttgctaagatcttgtctctttatcttctctggacactccctttctggtgggcagacccacattcaggaaaccagattgtagatcagaaggtggcatggtcagtgcaaactcagaacaaaagacctaggggaggtactcagggatgttgcatcaagctctggtagctgatgaaagtcaccttccttccaaggatagatctgtctaaaaaaagagctgtccgagtgaggaatgaccctgtagtgctctggcctcccgagtcctgcatttcttataatctaggccttgtgatctcagtcaagttaaaatgcccttctgtccccttccagttctttcttaagtgttaattggctccaaactggtttttctatggtatcagttcctgaaattggccggattaatttatcatgcactttaatgaaggactcttgtgtttgagggctctggcttagaaaggtgaatcctttcttccaaggaactcacagactgttaggggaggtagcctgtcaaatgatgactatgctataaagcaagaagcactgtccgtaatggaaatgtgggcagtggtctttcttacccctgccccgcaggactccatagtggggaagtacaaaccagttctctccaaaacatgtctatacttggataacttttttgtgaatcactaaagatgctcatgtcatcaaatgagatgaaatattcagacttttcacaaattctgattatttccttcctttgtccagatctccaagtgggttagccagctaactatactaacagctccaaagtcttattgcttagcagaatagaagtttctcactcatgtaagtttagtattggttggggcgtggagggtggacccaggctgcttctgtggtgtggcttgcccattttttgaggctttgctgtcctccagtgggttctttgctttgggcccacaggcaagggaagagagaaggcatggggaatcctgccagaagcttctgggacaagccttggaaggggtgtacattgcttctgcccacattccattgtctagagcccagtcacatggtgccacccagctgcaagggagagagactgtgaagtgtgatctctctgtgggcccaagaggaagaggaagcaggggtttggtggatatgtagcactgttgctgctccattgctttgggtaacaaataccgactcataggaggcagcctttaagtattggcttcactgatggggtagtaccgtttcattgtgacaattaaaagatgcatctggcatatttctcactggggttttatgacctgagtgatatccctgctgggatatcagtaacactgaccttcaaactcaggcgagttggctgtgaacaggctcccccagctctctcaggctggctggcccattgcttcactgtgaaaagctatgccctggagaacatgctggaacctggcttttcaggtggacgttcaggaaggtgtaggtgccaatgaggggaattgtgtcctgggaggctcatggcaaggtagaaaagtctcagtgagatggacatggttgagggctagaggacagtgctacaccttgtcaccactgaagcagtgagacagatcttggtggtgtgctcttcgtgtttcagattgaagactctgaggctggcggtcttctgtcaatgcagctttgcactcctcaggcacaggggtttacctgcatctgattctctgtggtcattccccacctcccccgcaaaaaaacacctacaggcatccatggtcaagtgtcttacggatttactgccattcataaagcctctaaacatcccttttttccttgaaatacatttgaggagctgtttgctttttatattagtctgggaatttgtccattaattatgatagttttgtgttagagacaataaaaagactgacaatgtataatttttttttttttgattcttaagaggacttcacatttccacaaggaaattacaaatgttatttaagaatgattagttccgaggctctatcactaacagtcgggacactcacactatattaatacatggttgcaacgtttagattgagttctaggtgtaattactcattgccctacattctagacttatagaattggacttgaagacaagagccagttcaattcctatgcatattctaaataaataccttgggcaaaaacacagattttaaatgattattccaaatggcttttcaggattagtgtgacaggtttgtggcacattcactactattttaaactttgacagaggaacgaggagtctctctaaaagaacttctgagcttcgtttttttggggtgatcaacatccctgggaatctgatgaatgccatgtactgtgcttatcaatttttctttctaatttcagggagctcagggacccgttctctgctacgggagagccgtggctctgagtgtaaatgcttgccaccaaaagcttggagaagcaactagcacagcaaacagggtcaaattcaccacctaagtaaccacaagcgggctggtgtccaagttccggcgggctttgaaactcactgtgagccaggtagcttagaaaaggtggaggaagtcattaggatttcctgaggattgggttggaactgaagccgagattaatagtgtcctctctgaagagcattttaacaaacgtgaattggaaatataaagatcttcttgttccctgagactggaaggtgtagcacaagtgccagagcattgccctggcctccttttgatggagagaatgtgtgagggatcagcagcgctcatcccttctcactgttccaccttctgctacccacctgtagtttcctacagtttggtccagggaaggtgtgggcttcggggcatgggtctgccaccgactgccttgctcgctctctctggccctgcagtctccccagctgctgtcttgtggtcagcagaacaatggcttccaagatgtgcatgtcgctaagccctggaacctgtgaatatgttgacatgcgtggcaaaagggactttgtagctgtgatgactttaaggatcctgcccagggaagatggtcccggatgatctgggcaggcccagtgtcatcacaagggtccttatgagtggaagaaggagacagaatagagagaaccagaaagatggcatcctgagaaagactcatctggccatgctgcctttgagaatggaggaaggaaggggctactagccaaggactacaggaggcctgtaggaggtggaaagggtacaggaacagattctccccagaacctccagaaggaatgcaggcccctggacccattttagacttctaatgttgagaactgtaagggaatccatttgtgttgtttaaagctacatggcccaggtgccatctctcaagggacccagcaggatacagtaggcgaaaagggaacaaaagctgggccgtgccttctttcttctctcccctctctggccctggaatgaccagcagtgtgtattcgtgtgctctgctgaaccaagaaatgtggtttgtgaagggcacgatctgcatctggcagctctctgggtggtggctgagggcagagaaagtgagtgactctggggttgatgctgttgcgggggtgggatgaagagacagtggcagctggcccaggaagtcccccaccttccaaaagcgctgtcaaacctccgctgtctccctaccagcttgttccctgaaggtcagcccgcttaggccatgtggattcatctggagcctggggctgaatgcattaaacttatccccagaaggtggtgaaaaagaccacttctttctttgcaggtgagcatgtgaggcgatgggagagcgctttggcaacatctctcaaatatttactgtcagctcctctctcttacttacagtaaagagcagaaagctgggacgtacctaagtggatgacccagggtgcctggtaaataagtgacgccgacagagctaaaagacgtgaggcaatacccaactgaaatgcaataagtttatgacattatatctagtatgatatgagctatggaaaaaatgtaggacaaagaagagagaaaaagaagctaaaatgtgaatccaaggcttctggatcttgagtggttatattccatgtagacattatgatctgaatttttgcatcaaatttaagatataggggtaaaacttcatatcctttgaccttgaaatttaattctgagaattttttcaaagaataattataagtacggcttatgagctttatagacacagatattccttctatcattaatataaaattgagatatatttcacatgtgccataatagtcaccatttcaaagtgtacagcagtggtttttagtatattcccaaggttgtacagccatcaccctatctaattccagaacattttcttcccactaaaaggaaaccctgtgctcgttaacagtcactcccattccctctttcccccagcccctggtcaccactgatccactttctgtctctctgggtttgcctattctggatatttcctttagatggaacctcacaatgtgtggcctctgtgtccggcctctttcacccagcacattgacttcagggttcatctgtgttgtagcatgtatcaatacagttgacccttaaacaacatgggtttgaactgcatgggtccacttattctcctgcctctgtcacccccgaatcggcaagaccaaccattccacgtccatgccggcctactcagtatgaagactaagatgaagacctttatgatgatctacttccacttaatgaatagtaaatatattttctcttccttgtgattttcttaataaattttctttatcttattttattgtaagaatatggtgtataatgtcaaaatatgtgttaatcaactgtttatgtaatcagtaagatttctggtcagtagtaggctgttagtaattaagtttttggagagtgaaaagttatacatggattttgaaagttcgtgggggtcagtgccccaacaattgcgtctattcctgcattcctttttatgtctgaatactattccatcgtatggctagaccatgttttatttatccattcagcagttgatggctgttagctgtttccaccttttggctattatgaatagtgctgctatgaacattcatgtgcaagtttttgtgtgaacgtatgttttcatttatcttgtgtatatacttagaagtagaattgccgcatcatatggttataactctatgtttaagtgtttgggaaattgctgaactatttcccaagcatgagtggctctcatgcatatttatattagtgaaaatttggaaataatgtagatgtcaatagtaggagagtgcttaggtaaattccattaatccctttagtgaaggatttgtacaaatgcaagttatttattcagcaggaattattgaacaccagcttcatgccctgtcttggaccaaatcaaaggtgattgagatggggtaattgttctcaaggagcttgagctattcagctattccatgtgatgtttacaaataatttatgacaagggggacagaattcttacgctataggggtaggctagctcaagtaagttttggagagcctcaaggtacgaattaagtaaacatgttacaaagttaagtggaaaaggtaggatagataattgcacatactgtgtgatcatgagtacgtcagaaaataccagataaaaacaactcatcaaaaaaaggtggagaaaaacatactaatataggaatagtggttgcctttgtgtggtggtgtcaatggacatttctctcccatttaagtgtctcctaaattttttgtgatggaaacaaaaattcccccagtctgtctgtggagactgggaaggattgggtgggggagaatctagcatcaagtttttggggagatgagaactccagaacctgagatggcatccctgtgggtgaagacagaacctcagaggaaatactagtgtgtgcgcgctgctatcctgcaccccatcttcctctctttctcagccacctctctccttttgatatcccctgcccatctgtggccctacttggacaccagtaataccccactgggtagttaataaggacgctttttacgattctcagaaaaaaaaattggtctttaaagttattaaaaggcttagtgatgtttttaagaagacacaattgaattgctaatctatttgctcaaattctattatctaatattatttccatgtattaaaaaggattctaaggtcagaaatgagaagctgccctagccagctgatctactggccctgactatttcagaatactctactttgggactgctgtcaatgttgggaaccccatcacagttgaaactgactagaactggggatgggggagtaccatactcagagaaacagggatcttagaacaaagtgctttttctttttagctctacctttattttcaattgtcttctcagcattttaactagtaaaatcaaatatgatgaaaatcagttggggcgtggtggctcatgcctgtaatcccagcagtttgggaggtcaaggtgggaggatcacttgagcccaggagtgtgagactagcctgagcagcatagtgagactctgtctctaccaaaaaaaaaaaaaaaaaaaaaaaaaaaaaaaaaaaaaaaagaaagaaaaatagctgggtgtggtggcacttgcttgtggtcccagctactcaggaggctgaggtgggaggatcacttgagcctgggaggttgaggctgcagtgatctgtgattgtgccactgcactccagcctgggcgacagagtgagaccctgtctctggggaaaacaaaatgacatttacaaaaatagaaaatattccccctggtgacactttaaccacaagattagaagccctacatctttggtaggtgtgaaaatagcttggagaattaaaattaggcataaataaattcctgatgtctttgagagtttaagtcattggatgatgctgtaatagaggagaatctgggagatgttgaggcgtcaggttctttttcatttgaagctaaatggcctcagttgggtggtttgagctctcctgttttgtttgtagatttcctgtctccttccacttggtaatagaccactgatttctctatgctcctccttgtgatagtgtgccgctttccacttttaatttttctcttctgttttattgtgaggggagtaaactgcggtattgccattcccctgctttcgcatacatgtgaatgagcatgggaaagctgaaagactttagtgcatttggggaaggggatagcccagggctcctttcctgaagaaccgaaaatatttgaacatctccaattctgctttatattttacacatagtccttgacatatttctgactctttttcgcctgcattaaatttctttttggattcaacttagtcctgtggctaagggtttagcctttccacatacccagcaatttctactttcctcttaactgtatacagttcatacagcgcctatgccagcactagcattttcattttttctatccttttattttgatgaaatagtacaaacaaaatgcattaaaccagatgtaagcctggctgctttgaggcccacaaagctggttcctccgtctctggcccaccttggctctaccgtgagataattctgtgtctctatcaatgactgtaaaccgtgcaataaaatgtaaaaattgcccatgtgatgtggacagacgtgaagatgctctgcgaactgaactttttcccatgcgaaggtctggattctggattccttgggaaatactgagaagtgtgaatctggcattgagggtcagtttaagggtgtgttggaaattgcaggtacggatatgtggagtcaccatggccttggcttctgagagaggacatgaaggactctcttaggagtaaagccgatgtgctttaggatcattctcagcttcaaaagcttcttttccctccaagatccctgctggagtgtggttgagtgaggagactaaacagctaaccttcatttatgtggaggatgtgtacaaatgtcagaaacatgacgagcggtgttttgtgtccagtgactgagaatggatgtggctcccaggcagtggagaccgtgggtgtttggcggtgatgatttgtatagggtcaagctggcctttgcagggctgatgggattggggtacgagaggggaagaggaagcctctccacaggtccaggaaagaccgagaacagattgcttagactggaatgagtgtgatgttttggaaggcgggtaaacaaactcatttgcctggacaagagattgtgtgtgtgttggggagggggtggggggtgcagaggggcggtggtagggagttgaagcagaaagagccagaagctttgtatgggcttggcttggggaggacttttcacaccagcccaggaggtttgctctggcaaactcagtgctgtgaatttcttctttttttctttttttgaggatggagtcttgctctgtcacccaggctggagtgcagtggcacaacctctcctcactgcaacctttgcctcccgggttcaagcgattcttatgtctcagcctctcgagtagctgggactgcaggtgcacgccaccacacccagctaatttttgtatttttagtagagactgggttttgccatgttggccaggctggtcttcaactcctgacctcaggtgatctgcccgccttggcctcccgaagtgctgggtttacaggtgtgagccaccacgcccagctcaatgctgtgcatttctgcatggagagccactgtgcttggggaagactctttggacatcagtgtctccacccaagtgggaggatgatcattggcaggatgagggatcatgggattgtccaggatgaagccgaccacctggctgagggtgctgattgtccccagatgaggctgagatcgctcctgggtggcctcggcctcatcctgacatgcaggaaccatgctttttagccagcaagagccagaaaacactccttgctgaaaagttaccaccaaaaaacgccagttttccacacctccagatacttcccctctgacgatgaaagaggagccaagatttattcgtctctcctttggctgatctaagtgcagtggtgtttacaactaattgatcacaaccaattacagatttctttgtttcttctcctctcccactgcttcacttgaccagccttttttaaaaaagatgtgatcaaatagattctggaactgaataactcctctgaagtgatttatttatgactgaagtaatgttactcaccaataactttcttgggagaaaagcatcatttgatattggtaaagtttagagtattcatgatagataggatatgctatacaagagaaaactatgaaatccctggcccataaatattttggaatgataattaggaaaatacatctagacattctcaatgctgttattgaaaatcgtgccagaatttggctctgcagtgctataaggatgggtttctcaactatatttgtttactttgtctatttttggaaataggatcttgtcttgtcacctaggctagagtgcaagtggtgcagtcatggctcgctgcagcctcgaacttctgggctcaagcaatcctcccacctcagcctcccgagtatctgggactaaggcatgggcctagctaatttttttttatttttggtagagatggagtctcactgtgttactcaggctggtcttgaactcctgggctcaagcagtcctcccaccttggcctcccaagtgctgggattacaggtgtgagccactgcacctggccagtatttgttgattaaatgagatcgtgtatgtaaatgtgcttagaatgtacctgtgcatgggcatttttctctagaggcttatttgtgaatatcattacgttagactagcagcaatttgctcagaactcagtttgtgttaaagtaggattttcttttttgctgtggttgggtcccattcaggatgcaaatcatgcacaacagtctgctgttacctgcttgactgggaccctcgatacggcattacgttcctgactggtaaaggcattgtgctgcagacatcagttccaggatgggacaaactacatacagtaggctcatcttgtgatgtgattttttgagtgagtcgtgtttgggaggatatatatggcatatttcaccttctgtatatttctgtttttatattgtttctaacttcttaaaaccatgtgtttagaatgaagattaaaactagtgttgttctgatggtgtttatcaatttctgaatgcccctggggagagacagccttgttgtcaaaccagtttggggaaattacgtgttcaaaattcatactggtctcatggggcttggctgtggttgtgtcactttctcaggtctagggacagaagaagtgggaggattgacttagtgaaatgtaggtgatcggattcccatgcatagcagtcagtgtgcatttatagagacagcccaagagatagctgcccagactcagacaattataggtgtgtctcgttttatatgacagctgcagtcctaacactgtcttgtcaatcaatgtgatcatgggggatcggggaggggggaggtctacttttaaaaatccatctgaaaattctttactttatctctcttgtcaagcccaaatttcctcaatcagattttcttcagggagagatgcctgtagacaaagtgcttttattgtttttctccagaaaaataaaaaaggactctgaaatttctgattcctactgtataagaaatacaggaagcatttagtaggggggagggcgtgggtatcattgtattgttaccttgcttggctctttgcatttggccaatggttgatgtttattaaactcatgaccagtggtagatgaaaatattgcaaatgcattttatatagatttaagccaatgttcatgtgtaatgtatggaaactgaaagttgtgaggggaacatttctcagggaatgagaacagagcataggtgctctctgatttttctggaagagctacattccattgtcgtcacctcattaaacatactgcttggaagaagatgcttgctttacctgttttgttagtaaccgaatatctctttttgctcacatttaaagttgcactttgagatagtaatgcttctgattgcaagtgtactaatgcagttatttaggcaaagctggtgaattaattttccaaccaaatatttggagcaaaagcagtcaattagataagataaagcaaacttatacaaaactgacctgactttcaaatttgttttcataattttattttgcaggataacaaagccattgacctttgccgattgtgttggggacgaacttcctttaggatgggaaaccgtatatgataaacaaattggagtttattacatggaccacataaatagtaagtagtgtgcaaaatctgtggcattatatcaaagatgccaaaaactttttgtagagtttaacaatcgttaccttccaatgcagcattaaattgggttttataaatgtaatgcgaagtttccattagctcagttcttcacaaagtgaagcagttctgtagctgtaccttgcttgtgtcttgctagggactgcatataatatgtttaatggagggttttaataactattacaaggaataaatttcccaggcagtctggaaatagagatacctctcataatgaaaaaattatttgttgcagagtggaactgacaagttattggaataagtgcccaagtgattatgttcacttcatttcgtcttatacatttaactttagctttcatacaccaaaccttttcggggggtgtgtgtgtgtgtgtgtgtgtgtgtgtgtaatggtatagagaccatagcaaaaacaatgggtctttgaccatgccagcctcctttgtagaactgtctagagcagtgcttctcatcctgggtgattttatccctcagggacacttggcattgtctggaagcattttcagtggctgtgcctgggagaggtgctgctggcattcagtgggtgtagaccagggatgctgcttaacaccctacaatgcacaggacagccccccctcaccagataatgaggcgatcccaaatgtcaatggtgccaggatataggaaccctgttctagatctgttctttgccccttaatcttggctgtctcttcgtcagctttcttcgatggggtcccagctgggaatccatttttcactctctctcattttcattctggcttccctcagtggctctgtcattgtcatttcactaccaggatatgaagcatggcttccccttggcttactttctgtcctttggttggtgaagtgcggggcggctgcagggtctgaaggtgcatggtgccccccacctgagtgattttgaggcacttttctagtccagtgccatgactcctcatgtccccactgtgcagtcaactcagattggtgtcttcagggctgattcctacattgtcagttgctggcacccaagatctgagtcccccatctcagatctcggggcagtggggtttttggtgcctggcactcgtccttgggcacgattgcagctcttatccagagattgagcagtggtgattggagacaggggatacctaccgttatggccctgctgccctcccaggcaggtccgggtggcaggaggacttctaggtggacccactgctttttggacagggaaagtacctggcagaagagaagctgagaggccccagtggctctctgccagcctggcacttcacggctgtgtgtgtttgggtaaatgtggccttttgagctaggcttcccagctgatagtctaagcggcagctggtaacacgtaagagctgctcacttcacagggccaccatgctgtggacctgggcacatgcccgtggcttcgttaacacgcttcgtccttcccagggcttggtggtacggatgccccacgcccactgaatctcatctctgagacaagagcaggactctgattttgcatttgttttggtttgtaaatctcctcctgtgagcttttatggcttggagaggctttctaggaggggctttctaggatggtgtgaaaaggggtgagcaaaggatattgacaggagagcagacagggaaggcatttccaaggagaacttacctggaaacattctagcaagcacaccgtgtgtgtgtgtgtgtgtgtgtgtgtgtgtgtgtgtgtcaaaacagacataatgtaaaatttaccattttaaccattttgaggtgtacttcacggaacgtaaaacgaaccatttttaaagtgaatagtttggtagcatttggtgcatttgcagtcttgcacagccatcacctctatcttgttccagaacattttcctcaccccaaagggaaatctcatctccattaagcagtcattccccattccccttcccctatgtcccggtgacccctagtctgctttcggtctctgtggagtctcctgttctgggtatttcatagacatggaatcagatgctatgtggccttttgtgcccggcatctttcacttagctgttttttgagtttcttccatgtcatagcgagcatcagaactttattcctttttatggaattttattcctttgtatatggtttatacaaaccactctgttgtatgcactaagtgaaaggtcctgagagtataaaggtgactgaggctgtgcccctgccatctagaggccatagtttagatgggaaacagaaaagatataaaaacactcatgtgctcagtgttaagggggaagaagggcagcccgcgtaagcaggggagagacgcatgtgcctagaggatcagagaaggcttcagaagaaaaggtgcctttgcagcgtgcctgggaagacggcaggccttcctgtgacagaagaggtctgagtcagcatggcaaaggcaccggggggccagccaagcatatttggggacttcgcagaagttcagtctgtgtagacaatgtttttggggaaaaagacggaaaatagagatgaggctgataagtgagttttgggactcctgtatcaggctaaggagattggactttgtgctttcaaagaggtttctgtgtgaaagcattgcatcccagttaggaaggtcactttggagagtgccctgaggatgggttttggtgggatgagaccagaaggcccagagagtctgactgaagtaaggagagacagagacaagggcgtgtcgccagtgatgatcatatccaggggcaggaacctccagttcttcataacccaccgaatgtttcgggaggaagaggagtgggattctttgaggatgagtcccaggttgcactcccaggctggctccgcagttagatccagatgatgcggctccccacaaggggaagacaggagattgcggaagacaggagaagcaggcgtgtgctgtgtgatgtttcgtttggttttgctcttggtggtgaaaggtggtgtggagaatgagggctgctttggatgaatggctgggaatgactttgggtccatccatgtggaggtgcatccaggaggcaggggggaatgaaagtttggagccggggagagaggctggagctggagttaggcacaggcccttggagagctggacggggaggaagcaggagtgcacatgagggaagctatggtgggaggagacaaggaagtcggtgaggaatgggaaaagactacacagtctagtctggaaaatgaaaggagaagggggctagccaggccaggggcacagaagagtttccatcatctcacacagaaggagtcaatgaggagaaggtcataaatagcaattagtgtcacagttctgagctcttgtgggttcatctcctcccatgcttatttagagtgtggtctttgttggtaaaaacattgtcttgtattgtcttccctcctccaatggactgtttcatatctgtagagtttccttctcatctgcactgtggatataaaaatggaaactgttccacattttggaaaggtttgtgatataaaatcttccataatatgcatcctggtaactaattaattttcacattgatgagtgacatcactgcatgactcttggtcaacctaaggattttacttttaagtcacttatgtttttacctttttaaatttcagaacttacccagattgaggatccaagagaacagtggaggcgagagcaagagcgcatgttgaaggaatatttaattgtagctcaggaggctctcaatgccaagaaagaaatctaccagattaagcagcagcggttcgagctggcccaggaggaataccagcagctgcacaaaatgtgtgaggatgacagccgctcgtacgccagctgtgagttgacttatctcctgttaaaagccattgtgactttaaaagccatctctctgctaggttacctgcaaacactgaaccttccctgggcaagatagcttcataaaggttctaatcgcatactgttaggtcatcagtatttggcactgaaatcaggtgggcacctggcagccactcctgtagcaaggatttatcaaatgcttactttgtgcccagacactgggttatggttggtggtgactaagaaaggaaaggtctctgcccttgagctcacattcaggtggggaaggtaaaaaataaacaagaaaacaaaatttcaggtagggatgtgtaccagctgcctgtctcatgcatgtcagttttgaagagggcttccctcagaaatctctgcagttaacactgcttgtctgggatgatctcttgggaaatccacacagtggcttcattcattctgagtgggaagactcaggagacctcagccatgtcaagccccctgtctctttgtagagttctcctcttgggctgtaggctttagtacgcagtacagggaaggaggaggaacaccatagaacccagagaatcggaggactctccttctgcccctcaggtgagatgaccatgtacagcttgctgttctctaaagggacctctctctagttttggaggctgccagagtggggggcttcatttcattagtactcagcaagtgcttggtgttgaagaaaccaggtccactctcagaacccaaagcattttgctgtggacacggtcagtcaccacatgagccagttccttcccagcagactttcaccctcaacagaccccaacagatgtgcatgactgtgactggcctgggcactcgtgagcttggaaagaatggatgaaagttggtaccactgggttgaattttataaaaacctgtctgtttgagacttggggcctttcctgtgatattagtgccatgttgccatggcagatattaaacacacagctatagctttattctgtgttgcaagtcagaatggaggtaaggctaaggggccacacgttttgtgctctgttttattgcggcaactgttgacggggcagaagccttagaagctatggccaggagtggggtattccctctgcaataggaattgaagatatttctatttccgtgtgtcttgagggaaacagggaactcagttttactgatgtgttgcttccaagccatcttatctccatctctgcagatagtggcacatacctggttggtttttttgagggctttgttttgtttttaacttcccatcagattgtgataggtcagctatgtgtggagttttagaggctggtttcttatcttcacagtcatcttttcttggaatatctttctctgattttggtatgagggtaatatactggcctcatagaatgaattgggaaatgttccttcctcttctgttttctcaaagagtttgtgtaggattggtattagtgctttcttaactatttcatagaattcaccaaaagagccacctggacctggagttctttgtggaatgtttttaactacaaatccaatacttttaatagagaggtatccagattttttgtttcttcttgaatcagttttggcatttgtgtttttcagagaattgtcttatttcatctaatctaaaagtcggcaaacttttctatgaagagtcagatagtaaacattttagactttgtcgaccatatgatctcagtgccaacgattctaccctgtagttatattgcaaaagcatccagaaacaacatgtagacagatgtgcctagctatgttccagtagaagtatcaaaacaggtagcaacctagatttggcccacagggagtttgctgcccagtgatctaagctgtcaagtctatgaagttgtttgtagaattcccttattagccttttaatgtctgtaggctttgaagtgatgtcctctctttaattgctgatattaataatttgtgtcttcttaatcagtatagctaaacttttattgatttttatctatctttacaatacactggcttttgccctgttctcccatttcttgtctgtttctatcttactggtttttcttctttattatttctttccttctacttagtttggctttaatttgttcttccttttctagcttcctaaagtggaaatttagatcactggttttagatctttcttacttcctcatatagccattaaagataaggattctcctctaagtactactttaactgcatctcataaattttgatatgctgtattttctttcagttcaaaataatttctcctttttttttggtggtttttgacccatgggttgtttagaagtaagtcagcaggactttttaaagatgtcatgttgttgttgatttctaacttagttccattgtggtcagagactatgtaacatttcagtcttttgaaatctattgagattacttttatggcctagaatactggttttttttttttttgagatggagtcttgctctgtcgcccaggctggagtgcagtggcacgatcttggctcactggctcactgcaacctccacctcccgggttcaagcgattctcctgcctaagcctcctgaggagctgggactacaggtgtccgccaccatgcccagataatttttgtatttttagtagacacgggattttgccatgttggccaggctggtgtggaactcctgacctcaggtgatccacctgcctcggcctcccaaagtgctgggattataggtgtgagccaccgtgcctggccagtctttttgatgaccagaagcccatgggcttggtgccttgatgtctccctagctgaagcattggcctataacctgttctgagattatatagttagcaattctaaacatttcagaaagctgcttggtagaagttgggttgaatggtataaaattgctgtttttgtatctagaaaagggctgaatattggctattcttataatccaacctaatagtgtgtttctttccagcagtctttgggtaccttatcttttacatgcttgcgtttggttaggtctccaaagaggctctcaaatcagtctttcaaagaatgaaatggaagaaatacatatcagaaaaacttggcaggatgtttcttgccagtgattgaaaagaaaaattgagaccaggtacagtggcttacacctgtaatcccaacactttgggaggccgaggcaggaggatcacttgagaccgggaattcaaaaccagcctgggcaacctagcaggaccctgtctctattaaaaaagaaagaaagaaaaactgagtctagagaaagtgtgtattatgtactggctaccaccagtgcagccaggatgtcagctgcagtgactgtggggaccctggactggatgccctcaatgatgcagacattagaacatcctgtctgattccacacccactctgaggggcagtgaacggggaaccccaatgcagtgccaagctgtaggttaagagtattcagtacttcagcatcctgagttgctaaggatcctgcaggatcaggttttgtatttccatgggcttttcacttctttgatgtttgggcaaatagggaattctactcaattacatttctttttgtgccctatgggattttattaatgctcgtttaaaaagatacactcaagaggctctttttgaagtggtatctgttccttcagtagaggaagctgatgactctgttgttgacttgaggttctaaggtgctcaccagattccatttcctgacctgctggatgtctctgtgtggatacgatctctccctccacttgtgtaggttgccttcgaggccaaaagtgggcctgcctgttttcgtgaaagggctggagatgccagtgggtcttcctggggcctgtcagctcatcagggaaaaagccaactctgaacggaatctaggagttgatccaagtgttttatcaacttgctgctgtccctagggctcccaccaagctctctcaatctgccatttaacccgaactaccaggtacaacaaggaaaaccctgctagagtggactcagatgaattctttctggccacaggataaagtccaatgcagtgattttgttggcttgaccatgatctaacagatggcttctacagccatgccagagggcctgggcccatgttgggagctgctggtggcagtttccatagcacacgttggctgtgtagccacacgggtctcactgcccagatctccctcagtgccagtcatctaaagcaggaggcgtctcctttttctgatactgtgaacagaataacatctggacttaattcccacttctttcttcatgggtaatgacttgaagtgaaaggaaccgatatccaatgagctggtgttttctgtgcattgttgtgatcacagtgttgtcaagcacgtgctgttttctttattgttcacatgagaaactgaatatcagggaggctaaattatttcttcaggattacatacccagcagatggtagaagttggatttaagcccagatctgtttgtgttggtggccttcagtgctctgtacggtttcctagacatggaagaggccactcagaacagctgatggtgtttgtggaacccctcccccatccaactttcaggttatctgaaaataaagactagttataaattgacaagttgtcgggaaattttgcagcaataaagggggcaagtggaaggcagagcactttctagatcttgacttttccatggcccatgtaagatcactaaactgttcatttatttttcgacagttagcacctgctgttgatatatactaaatggcgggaacatgttttttttgttgtttgtttgttttgttttgttttgtttttcgagacggagtctcgctctgtccccaagctggagtgcagtggcgcgatcttggctcactgcagcctctgtgtcccgggttaaagcaattctcctgcctcagcctcctgagcagctgggactactggcgcatgccaccatgcccagctaatttttgtatttttagtaacagggtttcaccatgttggccaggatggtccctatctcttgacctcgtgatctgcctgcctcagcctcccaaagtgctgggattacaggcgtgagccactgcgcccagccgggaacacgttttattcctaatggttgcttgttgggaaagatgaggcaataatgtgtgaacagaggaattaactggaacagccatttctaatgtgggagcagaaggtagggaggagaagtgcatctcacctatacccctcacacatttccctcgagctatggaaatcaccagaagaaaacttcatgcattggagaggaaagattttgtgtcagtattgggccatctggtatctaagaacatccgtgccttgacctgaaagcaaattcagatatttggctggatgctttgcacacttgtctgcatgagagtaggaacccaaccctgcttgatttcaatgagcttctgtgctagctgcctggtgatgcccaggcctcatttatgcttcgtagaacactggggtgaaactgctcaacaatggactcattctctctgagacacacctgctactttttctacagctccattttgtagagttttcttctactttctttattgcaacatgttcttctatttgcctgccttttaacactgaatacgttcattatctcagacacattttttcctggagttattcctttattcttcctgagaaactctagccccaggcacattcagatgaactatatatgaccatttgcaggatcttttggaagaaattcttgcatggggtaggataatagtctaaacctcaggtctgcaaactatgtcaagcctgtgggctggatcctatccactgtgggtgtttgtaaataaagttttattggaacacagccatgtccatttagtaacctatcgtctgtagcagctacagtggcagaattgagtatttgagacagattgtatggcccacaaagtcaaaaatatttagggtctggcccattagagaaaaagtttgctaattcctggtctatacccatagttctcagacctggctgcaagctagaatctttaaaaacttgctgcttggacctcaccccaagagattttgatagaactggccttgggtgggaccaggcttttttttttaagcttcccaggtgatccccagggttgaaatccactgggctagacagagtgtgaatggcccttgtagcagcaggaatatgactttgtttattatcctagttcctaggagttactcaaagtctacattgaaagtctttctgggtggctaggaaagaggcagcgttatctctggtgagaaagtgctgatccaccctgagttcttggattaggtggtggtgaagcttgaccttatcagccatcagccttgccagcattccttctgaggctccaagcctgtctcacaatgactcttccattggtgctctgtttttttttttttgtttttttgtttttttgttgttgttgttgttgagacaggatcttgctctgttgcccaggctggagtgtggtagtgtgatcttggctcactgcagcctcaacctcccgggctcaggcgattctcctacctcagcctcttgagtagctgaaactccagatgtgcgccaccatacctagctaattttggtactttttgtagagatggggttttgccatgttgcccaggctggtctcagactcctggactcaagagatctgcccgcctctacctcccaaagtgctgggattacagatatgagccaccgcacccggcctcattggggctctcgctgttgaaggatttctcatttgctgtctttggttaggaacagggctacaggcaatccattccaattcaaccttttgttttccttcacacacgcatgttggagcaggcaggagaaaaaaggatcatggagcatttttcccatgtattagtcagcaagccagattttggaggttgcagcaaagcacatgtgtttcctgagaaataatcccctagtctgtcctggagggagaattcctggttaggatttggtggcttcttgggttacttctgtagatcacccccaggtggccttacttgattgtttttggtcttttgcttatattgccttaaaaaaaacccatcctgcccgctttgttggccttgcgtatttctccatgtgcctctctggtagatagtacctgtcaacctggaacctgtcagggcttgtcggccttttgcccagagtcattcttggctcccttgagcaactcctgacagtgctgatccctggaggcctacacctggtcctaaggagcaacctgctccagaggatgtctttgaagaaggactgctggtcttttaaagcatgtcttgtctctggggtgaccttaggtacccatagctcagaagacgcctgtacataagagagacaaagacaaacagactcatggacacacacatttcccctttcagtaatctgtcaaactgaaatccagagttaagtactggggtttgcagcattttgagtcctaaatacacaggtcaagttcacctgttgggtggtgggcactggggagctggaggaccgtttcttcttctgggaaagctagcccaattaaaggatctttggcagctgacccaccggagcccagattctagacatgaagccctctatgaatgatggcataatgtattatagatcaagtcactacagactcagtcttttaatctataaaatgggcaaggacacataagtatcatttcaccttcacaaagattttatgagaatagattaaataaatgtgaaaggcaccctgtaatagcaaggtataataatttacattgctgtggtccagctaggctataaccttgttattatattatctgaggcaatgttgtatgcctgagcagactccatatgctatttaatagctctgcccacttaactcttcaagagagaagaaagcttcagaggtgaaagtctggtctttagcataaacctcgagattggagacatgtcttaatagaggaagatactccgtttataaatgttgtggaaggccgggcacggtggctcactcctgtaatcccagcactttgggaggctgaggcaggtggatcacttgaggtctggagttccagaccagtctggccaacgtggcaaaaccccatctctactaaaaatacaaaaaattagccgggtgtggtggcggcgcctgtaatcccagctacttgggaggctgaggcaggaggatcgcttgaacccaggaggtggagtttgcagtgagctgagatcacaccactgtgctctggtttgggtgacagagtgagaccctgtctccaaaagaaaagaagtgttgtgtagtacacgctattatgaggtctggagtcctgatctgttcttggactctgtaaatggttctagtagtcttattggcagatctgaggaactgagaattttatttataaatttaattacattattaaaagttatgccagtgttcacaaccatccttagtatttgaagataaaatgtattcactgtgttagttacttgagtagacttttcccttatcccagtcctggaattttataattttatagagaccatagcaaaagtaacatgaatgggatccacataattaaaaggtattctgtcacttatgatggtttcagctgcagcagagaagaataattctcatgggcctagacaataagaaaattcattgtcacatagcggagtcctctggaggtggggtgggattccccataggtggattcagtgactcagtggagtcattggtttgtcagtttccccctctaggagtggatacatgctgagtctcttggggagaggtagctacccaacacttccggggttctggtacttaggaaggagaaatgggggaaggttgccgtgtagatgtccaacagtatccaagacacctcccctgcgtatttcaagtctctttgctaattttccttatgaaactgcatagacagaggaagattggtacagatttttttttttttttttttgagacagagtcttgctctgtcgccaggctggagtgcagtggcgtgatctcggctcactgcaacctccgcctcctgggttcaagcaatcctcctgcctcagcctccttgagtagctgggattacaggcacctgccaccacacccagctaatttttgtaattttagtagagatggggtttcaccattttggccaggatggtctcgatctcttgacctcgtaatccgcctggctcggcctcccaaagtgctggaattagaggcgtgagccacggcgcctgaccggtactaatgtttagcattgcagtgaactttgttgaactttggtggtaggcttactttctacccttaatgggaaagatcccaggtgataactcttgggcttgtgttcctcccactgcaagttgacaagttgacacatgtgttgtagtgttgtaagccaggattcagcaagccctaacctcatagcctcatttgcatattatctctatcccaagtgaaagaaggcctttaagctcagatctgggaaacttaaagtcccaggagtttaatatggagatgttttctataagttatttctgccttttaaggacattgttggagatgttgctttcattactgattttaaatgaaaccaaagagtcaggcaagatggaagatgtaggatttggaaataggcagtcttgtctaagaaagaattgtttgtaaaatattttactccatgtctttgagagatcatgagtctaagtataagaaaattggagataaagttggcaaacatttagctcttccagttgtttatttccagtagattctgttgtttgaaattctgactgaatgggacttaaatagtagattttccatagaactgttattaaaataggagatccaactgctcaagtgaactttggatgtggttctaattgaggtttgaagtaattgtgctgttgaagctactcaatggtgttgagccatcctctgcagtacatagtccacaaatgattttgaattggtttctcattgttggcacctgagttatctgaatgacagccagcctttgattctcagatcaaaggcgttaaagaaaggactccgtccctgcagatgtgtcttctgagcaggtgatgttaatgacaatagctgggaggcagagggcaccagagtggggtggttcacagatgaagacagaccagcattccactagctaagcagaagaagggaagccatgcagcagtggtatagagcccatgccttcagaaacctaaagaaaggaggcagaagcatcaagaaaaagcaccgcagagcggtggatggggtggtagaaattaggaatagccactcgctgctccagcttccgtaacactggaaaaagcttgcagctctctgtgtgcacagaaatttgctgactgtgcctagcgtgtaaacagctctgtggctcttactcatccctaggtattggttactcacgataatgatgccatgtctgtaaaaagactttaaatcatatacactgcactgtttaggaaagcattgaggtatgtgatgtcttttagctaaacattcatcaaaacaaattattagagtaaaagcacgagtgcctcacttcagtttctgggacaaacaacttgggggcccatcttttttctcaagcctgccagatcctgacgtattactagaaatcttttttattttacaaatttctaatgtttttttcctttcttgtgtcaaaaattgttcatccggagaatataagtgtgaagaaaataaaaataaaatcatttttaatgcagccattgagaataactgcagttaactttttggttctatctttccagtgacgtctgtgtgtgtgtgttttaaaagaaagtaaaagtaggttcatactgcaagtactattcacgtattaagtacagtttcctatgtcataatcacacctcttccccctcaccccgtacccccgctgtgtctatatggtgtttaactgtagtagttttatagtagaactaaacagagttttgattgacctacagccatgtattttattatatgggatcctatagaaagtcctgatgcaaatatcaaacatcaggaagatttgaggatgttaaatgtcaattctttaggagccagtgaccacttgtaaatcagagatttagagtcctttaatgcagtaaatcagaagttccttgtgtgtatgtattttgaaggatccattataaaataaaatattttctttctatttagcattctctggatattcaacaaatacaaagtatgacccacaccaaattaaagcagaaatagcaagtcgtcgggatagggtgagtaaaaccgctgtttttacaaccaggtggacggaagcctggggccttatagcctaggccgctggtgttctactctggttgactcctcctggagggatcgctagcagtgttagactggaagagttctgagggttctgatgctcttccctggtgacccctgaattatctatgtgctaccatgtttcgtctcttcagacccttgtcttggttgtctgggaagggaaacacttttgttgcatttgggacaaagcacaagaaacatcttggcaatgaagcctgctcctctcttggtgtgtcattccctgaatcagggtgtatcttttagtgcagtggttctcaaattttagcacagctaagaaaaatacctgggagcttgttccaagtgcgagcttccaggcctagcccctgagttttgacgtgggcctggagcgggtcccagaatctgtttaaagaagcactccaggagccattgagtttcaggtagtcagagagctcgcttctggacacaaagtttcatgtgcggggtctgagaggagtgggtagaaggaaagatgaagaatgcgttacagaagttgccagctgtaatgtggaaaccttgaaaatgcaaatagttgctggttccccacttgcgtaagagtctgtcaacaatctgggatttttgtatctaagcacagcaggtcttctagaaaggctgcttcttatgcatgtgaatggaagtttgtagtgagaatagatgatcttatgaactgcaagctgagtagaaactcagatgacagtgctaataacaactgtagaaatcattcttcacagctggtttttgggaaaaaaaatgtgatttgtctttagctttccagattaaaacgagagctgacccagatgaagcaggaactgcagtacaaagaaaagggggtggagaccctgcaagagtgagttgcctggacacttgtcccaaagcttcatgcccttcactttcatgcctttatttatgctcatgattttccaatgctaacttcagaatctctcttttccttgaagatatttcgttgctttaaatggaaatacttgggaaacaagacctttatttttatgtttatgcacgtttactatagctgtgcaagacactcatggctagttacatttaaatttgactttttcttagttttagtcttttaaattttttgttctaaaattgacatttaaagtaaaagaaaattaaaagtttagtttcccagtctcagtagtcacatcagaagtactcagtagtgacatgtggctagtgcaggttttctccaccacttagcactagtgggatttggggctggatcattcttgtcttggggggactatcctatgcactgtagaattgtcttgtcttggccaggcctggtggctcacgcctgtaatcccaacactttgggaggccaaggcgggcagatcacctgaggtcaggagttcaagaccagcctggccaacatggtgaaaccccatctctactaaaaagacaaacattagccaggcgtggtggtgcatgcctgtaatcccagctactcgggaggctgaggcacaagaatcgcttggcgggcacctgtcatcccagctattcgggaggctgaggcagggagaatcgcttgaacctgggaggccgaagttgcagtgagccgagattgcgccattgcactccagcttgggcgacagagcgagactgtctctcaaaaacaaacaaacaaacaaaaacacaaagaatgttgtctttactctttacccgctagatgccagtagcaccttccacctgtattgtgacaaccaataatgtttctagacattgccaagtgtcccctaaagtacacatttgctcccagtggagaaccaccgtgctggtggctactgtattgaacaccataggtgacagatttccatcatcacggaaagctcctttggacattccagtctgtaggtcttcctcctgttctcatttttacaataagaacgttatccctactaagagattggggatgaattgtttacaattagtgagctgtatcgagtctgcaggtttcatgaactaaaggtggtgtttgagaaatggtgctggtgtgggtctgaaggtttgctgagccgttctctccattcactggctttccttgctgaacttgcgcatgtgccgcacgccttctgcacctacttttctcatctgcaaatggtgattgttttaggcagctcgggctgctatgacaaataccatagactgggtgacttgaatagcagatatttgtttctcacagttctggaggctggaggtccaatatttggttcctggtgagggcccgattcctgatatgcagatgaccatcttgtcgcagtttcctctcatggctaagagagcaaaaactctgttctctcttccttttcctaatcccatcatggggtcccaccctgtgacctcatctaaccctaatcacctcccaaaggccccaccttcaaatgccatcacattagagggtaaggctgcaacataagaatttggaggacacacaaacacacagtccataacagcaatcactgtgctcagttatactgaggacagcaccagcacctggtacatgcccagcccgaaacaattagtccaactctgtgtggttactgttactgacgcaggtgggcaccatgttgccgtctttcatcctgcatgcagatgcatgaggtgacacacgtgactgcagcactgctctttatggggaggtaataaaggaatgtgaggtacagatgtaattatctaccattacccagctatgtgtttgtgtgcattttggatctacagtcagagcttccttttattaaccctagttagtattagcacagcttcttctttagctttttttttttttttttttaagacagagtcttgctctcgtcgcccaggctggagtgcagtggtgtgatcttggctcactgcaacctccccctcccaggttcaagtgattctcgtgcctcagtctccccagtaactgggattacaggtgcccgccaccacgcctggctaatttttgtattttagtagagatggggttttgccacatttgccaggctggtttccaactcctgacctcaggcgatctgcccgcctcggcctcccagagtgctgggattacaggcatgagccaccgttcccggcctcttctttagttttgtcttaagcaaatcaagcttcttttccaactaaccggctgctggttttgtcattcatgcggtgcataggccagagtgctttccaaatgcaccgacgtgtgttttgtccttttagccccccactccagccagcctccagatactccaacacctcctcagatgcgactgtgtgtgctgtggcagtgtcatcctgtgtcactttggctaaggtggtggataaagaataagcagaaacaaatcatttgatttgtgacaggtcaccaaaagttattaggactacctagttggatttgaggtgaattttctaccttcattaggccacactgtagctgtctctcattgtgatacagtgtctctggacaatatgtagttgtttgtttttttttggtttttttttgagatggggagtctttgtcacccaggctggagtgcagtggtgcaatcttggctcgctgtaacctccatttcctgggttcaagcagttctcctgtcttagcctcccaagtagctgggattacaggcacacgccaccatgcccagctaatttttatatttttagtagagaccgggtttcaccatgttggtcaggctggtctcgaactcctgacctcaggtgatccgcctgcctcagcctcccaaagtgctgggattacaggcatgagccaccacgcccggcccagtaggtggttttaatgttagtcattgtgtgtgccggaggttgcagttaatgtcattctcatttgcagctctgaggaaggtgactggggttcaggaagagtctgagtttgctcaggatccctgagcatcagcagggagccacgtctggcacttccctcatggccatggtttctgtagtgggttgctgggctcagcgcccgttgctttgccttggctccatcgttctggtgaactccatttccttatttgaagacaaaggccatatagcagtgtcagctgtagatggactgatttagaaactgaaacgtactgctgactgagaaaacccccttctccttagcatggctaggatgtgaattcatcttttgtagttgcagtggtttcaagaataggaaaaggcagcctctgtttccctaggggcattagacagagaagcaggagccagaataacgagaattttaacttaacacctgcggccaaaacggagcgcaagttgtgctcctggaagagaggcgggccagtgctgtttggattgtctttctgctttcattatcaagatcccacgcttgggaacagcaattgtaaacttgccacttgccaaggggaggctcctcctgtctgcctgagctcatgagaatacccgccctccccctggaggccaaggagtggcctggggaaggctctggacctggccttggtcctgaggggcccaccccacctcatgcctgaccaggggcaagttagctttcaggagggagctgcccagagctgttgtttaatgggcacgttgccttggctctgtctgacgctgcgttgttactgtgcatgtttactttattctgggacagacacagcctcacaggaagaagagaaaacccaggcacccgtgccactcttaaaatatttttgtaagtggaagataatctggtagcctttctctgagttccacagcttatgagatgaaaacagcctcattatttttctggtattgaacattgggtgtttaggtttggattgaatcatgcaaatgtatatttttttaattgagaaattttagaaggccttttcaagcattgaaaatgtgattaccccatctctactgggaaatcctgactatacgtacagatagcaggtgagctgttatacctaaacatgaagcatctctgattttatcaccaacattgcttaaggcagtggcctgagattttcctccagaaaatttcctgctgttcttgcttcccagaatatccagtgtattcttttccagagcacctcactaggagtttggctgcttataacattttaagcttgccttgtttatcttggtgaatttcctggctagcaaggaaattcatcattacacttgggtccaagtaaggaaaaaagaaccttttgtattttactttaaatctatatatgttgttgattgttgtagagaggaattggccacagatatgttcgctgggttaatgatagaatatgtacacagatgtgtgttttatgtgtatctatgtgaagtgtacacatgtaagcttttaatgatggaaaatatcaaacacaaaagcagagagaatagtatactgaaaccttcctgtacccctcaccccatttaacctgcacaattgccaatcttgtttcggtggtgaccccaccccatctgctaagctctcacggccttattgaagcaaatgccagaatcccatttaatccataaatatgtctcctaaagttatggactccttttgaaaataactctaatccctgtaccccatttactaggcatcttgtgtccagtgagctcttgcatttcttcaggtgtttgggtccagtttgggccacagagtgcctttggttgatgtgtctcttacgtcttttcttttctactctccctcctttttttcccctgacagcttatttgttggagaaagtaatttggttgtcctatagaatttccctaatgttgggttttgctgctgaaattcacatgatgtcattgaacgtgttcctctgtctcttgttatttatgcaaatgggcgtaatagtttgagaggcttgatctgattcaagttggatttcttttctttttttagtaagaatgtttttaggtggtggtgttacttccatcaggaggcaccactctgtgcttgtttctttttgcggtgtgaagatgatcagtaggttctggccttgttagcccaatgctttgatttatattaataacatttcttgtcagctttttacctaagttatggatgtgtatcttccaggataagttcctgaaagcgggcttggtaggttaaagggtgaatgtatttgttgtattataggttgtatttcttatctgaaatgcttaggaccagaagtgttttgaatttcagtttttttttttttttttttttttttttttttttttttggtttggaatatttgcattatacttactggttcaatatccctcatccaaaaatctgaaacctgaaatgcttcactggtcattttctttgggtgtcatgtcaatgcttaaaaagtttcagattttgaagcactttggatttcagattttcagattagggatactcagcttgtattagatatggccaaattcctttgctgaggggttgcaccattttgccttcctaccactaacatatgagtgttctcgtttcctgtgactttgccaacaggatgtgttgataagcatttgcatttttgccagtctcataggtgagagatagtatctcagtgtagtttcaatttgcatttttcttgaggccttttataaaagtcttcagaaaataggagcaccatttacaatgactaattaaagtttagagaaaaattgagcttttccagtgaaaggtcccctggactctgttgccctaaagtttctgaaacgttttggaaaaattaccttactgtaacttactactagtgtccagaggcaaagggaagactcaggaccaggacacgtgcaatgtttcccaactgggtgatgtgcgtgaacggaccaagtgcaccaacagatgtgggcaaattcccctctccagctcctgcctggagctctagaatgtaccttgtgttagattttttttttttttttttttttttgagatggagtctcactctgtggcccaggctggagtgcagtggcacgatcttggctcactgcaacctctgcctcccgggttcaagcgattctcatgcctcagcctcctgagtagctaggactacaggtgcacaccaccatgcccagctaatttttatatttttttagtagagacggggtttcaccatgttgcccaggctggtctcgaacttctggactcaagccatctgcccgtctcggcctcccacagtgctgagattacaggcgtgagccactgcacccggccccttatgttagattctgagtggtcctgcagctgggaagctcatttaacattgcccttccctgagtttcctgctcgtgttattagagccttttcctgccatgatacctataatgtccctgagcactggcttgatggcagaagatgcttttgggtaacactgcctggccaccttgtccatggtgtgctgtttctacacccggcctctgatccttctcacagcttccaccaccacggctctgggccaagcactaatgtgagtctccatcctcacacagtagccatggggttcttccacagctagtgctctccttgtggtccttctgtggctctctctcacctacaacacaagccagactctacataggctggcccccggccctgcctcatttacctctagtttcacctttgaaagggatgtcctgcctttaccgtgggtacttggagctccctctgcttggaatgctctttcccccagattctcacatgcctgctcccccacttccgtgggcctttgcttagtgacatctcgagagatcctggcttaaccatccatctaaaaatgtactctgtcacactctatccccaaactgcttcatttttttttgaaaacatttgtgactgcctgacctaaggatgtacttttcattgtctgtctccttggctcgaatcgtgctgcacgaagacaaggacttggctttgttcgccgcttcatcctgaggacccagccagttctcagcacagggtggggcttgggagtgaatgcagattgcccgggtgctggggggagtggctgaggttgctgttcctgcccgctagtagccatcacagggtccacttctttctcggacactgggacactctgagtgagggcagatgtttccttggccaaaacttttgtccctgggctggaggaactcagggaggcctctagacattgtccagtcaccttcttgccaactgtcctctagcacagcattctcttctgcattttgtgtgatattgttttggcctgggttttaagaagtcctattatcactgctattcaaatcacagaaagggatgctcaccagatgttccactaactagtttccatgaggtacattcttagccactaggtgagcctctgcttcaagacttttgatttcttgattaacttcccaaatggggtgaaacccatttgtctccttaaatatgagccactacatccttctaagcatgcaataccagaatgaagcattactgcatattagaattagcattttctgtctgaagggatttagtagtttcaagaaagagtgggattgttcagtagaacaggcttaaagtaacaatctcccattagcgtagcacctaaggaacagcccacgcgaaaacctcggcaatgctcagataacaacagcgaaacgtacagaaatgggctggaaacaaaaagaggattgttcctggttgtgggacaggtctggtgttccacacaggtcttgctgttgatagaaagccgccggaagctttctgaggttcacccaaggccgtctgccagagctgctgatagaaaatgtagaagttgtaacaaacctttccattcttctgggttgtaatctgtggtattaacacagaatatctttagagggctggcagctctttccttcaagatgtggggttaagaagttatgtggttttactcttatttttcctagtgcagttctcttgacatcttaaattgaacaaccaatatggaaattttagggtggcaggaggtagaggttgacaataaacatctctaaaatgccttttccattgtactaggttcctcatctgaagctgtatcttcttcttttctctccagcccatttctttcaaaagcacaccataaagagcaccagtttactttgggatgacatttgactggttatatgggtggccttcaggtttgacacaatgggcatttagaggccttgactttgaatatattgcgaacctggtgatggagcagacaagtcctggtgtggggggccttggctgtgaacttcactttgcctgttactggctgtgtgaccctcagcaaatcacttaacgtccctgaagctgaatgcaaaatgtagagggtgcaaaagtaaagactgtgagtctgtgcactgaattttgatttcatactgcataataactcatgtccttgtttagtctccttgagcagttaccttttctatcattttatttgtgatgtatggtaaaggcactgtcttgcactcttaattaaaattaagaccagaataaggcagttctttggcagtcacagatcttatgattttttaaacgaactggaatacatcaatatttttaaaaaataccaaatcattgagcacatcatctacattggaccaaagttttttagggaagttttagagagagagagtgtgctctcaaataaatgaattttacagaagtaaaagaagacatttactgtcctttgaagtttttgttggatgaaaatggatcacaattgaaaaaatggaggtgttgtgaagctatgacagctaagaaagtataaggtagcccttccatgaatatcccagtgagttacgagcagtgagtgagaaggccagccattttgatggaagtggggctggttttgagggacaaacaaaagagttttgaaaatgtacaatgggtttatatgcctactgtcaccattcttgctattggctcccacgttttagtagccaccaactggcctgctggtactgtgctgggaactttttctattttattgccaaatctcccgaggaccctcaggtgatgtagactgttaaagtttaccaccttgatcatttggatgaactgttttgtgaaagaagggatttaatgagagcagaataaaaagaaaaaatatgcccacagctcaaactttagttcatgctcacttattttaacttttggcatggaatactctatagttaaagatacgtgtaccttttaataaagatgtataaataaagacttctgctttgtaggaacagacaaggcaatgtgtatttgagaaacctacaagtctgtaacagccattatggaagtgcctgcagggtcaggacacgttggcatttaggagtgtcattattcaccatgcacggtgtgcctctatctgctctcctcggggcagaactcaggactagtgtttataaatattttatttgtagctgatggcaatcacagcaatgctgccgagccccagagccctattcaaagggagtcaatggcttcctgcttgtgttgtttgccctcttcctaggccatggatgctgatagctcaggttgactctggtgccgagttttgcttgagttgtgacatatttggcaaggaatttgttaatgataataaaacaccagagttggcaagttatttactttttctcccatgagtaaggagattctgtgttatcctgataataacagtcaccgcaaacaccatatgccaggcctcctgccaagcaagctcttaccttgcattttctcattaaatctcatgcccatcccatgggagaaatatttttagtgtccccatttgagacaggaagaagcaggtggaaagaggggaagtgactcacccaggtcccacagccagtgagtggcagagctgggtgccactcgcacccaccagcatgccagaggttcctgtgagcggtaagcaagggagttggggctggcagttaatgatccaggttttcaggataacatggagggaaatgttagaaccagaacctgtgaactgggagactcggaacctgaaagaagccagttgctttccagagaaggaattcattccactctggaccaaaatttctcaagttccttagccttagggcttcccatgctggagcctcaggtgtaggggatgtgacaaaggacatgctccagaggccacctccctttgaaggcagaaccaagtcttgttttgttctgtgctctgcgtccagccccagacccaggcctggtgtgtacaggagctggctgggaggatggaagcttggaggaaaggtgggaggaaggggaggaaggagggagggagggacattgccattttccctggatgagtgtttggattgaaggaaagaattgaggacttggtaggagaaagagtgagtaataaattagaaccagaatgaaatcagagttataggagacagaaaaggtttccagcttttgtacaaagcaccattatcgaaagctcactacttcttgctgtgtcccatatattctccctgtacacagatctcattcatatgtttatttaacaaagattttgaccactaacctggagataaacaaaacatgtcctcttttcagagagaggaatttacagtctcgggaaattactcaagcaagcaatcttgttgcgcaatcattagcggaggacgtgggcatcctgtctcggacgtcttcacctgcccagggtgctcctgagcaaagggtgttgtatcgaccagaaggagggacgcttccgtggggtctttctttttcttagccaaaacattactttaactgtttccacctctctatgaagcttttgggttttcgtagttgtatgtttaatggaatgctaggatctcatgtgaaatgacattgatttttctgttttaactaggattgatcggaagatgtcaagtactcacaccagctacaaactggatgaggcgcaggctatcatgagtgagctccggaccatcaagaaggccatttgcacaggcgagaaggagaggcgggacctgatgcatgtaagctgcctgcctgctcatgtgttttattttaagatgtttttaatatacttatgtattacatgttatatagttattgtatatataacatatatgtgtatataatacacacacacacacacatgcatacatacatacgcaccccccactgtatttaagtacgtatatagtcatccctctgtatccttgggggattggttccaagacacacccccatccctcaggataccaaaatcattggatggtcaagtcccttatataaaatggtgtagtatttgcatataacctgcacagtcctcctgtatacttttctttttttttttggagacaggatctctgtcacctaggcttgagtacaatagcacaaaaatggctcactgtagccttgacctcccaggctcaagccatcctctcacctcagcttctagagtagctgggaccacaggtgcgcaccatcatgcctggctaatttttatatttttagtagagacagggtctcaccgtgttggccatgctggtctcaaactcctggcctcgagcgatcctcccgtctcggcctcccaaagtgctgggattacaggcatgagccactctgattgctgcctccatggtcacatgactgtctctttgtctgaatttcctgttcctgtaaggacaccagccattggataacgacccaccctaatccagtatgacctcatcttaactagattacatctgtaaagactatttccaaataaggtcacactcacaggttcctggggttaggacttgaacatatctcctgggggaacataattcaacccacagcaatgggtgatacatttatattgttcaataatcaagataattccaaaggtctatgataagaagtctcgctatcgccccatcctcctactgcccctgactgcctttattacctttttgcctacccttccagcattcatgtgggcacacaaaaagagaatacatgtttagccgccctcacgcaaagccaggactgtgatactgttccgcactagcttcctcacttaacagcaatatcccctacctttccccatatctgtacacaaagagctgcttctttccttgagatggttgcatagtattttactatgtgggtgtatttgtattatatatagctgggatcattgtagctttatactgctttatgtttttttccccttgagcttttgtagtttctgttatttttagaaaaagttgaacttttgcaaatgcaaaaagctgcctccatggtgggaaactcaagcaagacatctgagtggctggccctagtgctgcacatggtggcctcagagaggccaaggcaggggagcgctgcttgacctcatgacgtaaagtgctggaatgcattcagtgcttttggttacagcttttatttttcatctgctaccctaagtgagcacctactgcctgctggcatgtgtctagattctgtagagtataagacccacaggacagaacaagcaaagctcaaactcataggcaaaatgagacagatgcacaaaaaaactaccctgcctgggtagtgccttctaaggtcaaggccatgagggacttgcggagagtcctcatggtgcttgttaagatgcagattaccaggccccaccctagactcactgaattagaatctctggaggtagggcctaggaatctattttcagatgacctctccaggttgtgataagtaaatggttaattgttagattttttttttttttggcacacaggtagcactgagaacagctaccatttattgaggtctctgctcagctgacatcaaacaagatgccccatgtttgttacccatcgtcaataccgcaggctgaaccatgtggtgttccatggtggagacacagaggctttacgccatgaggccaagcagggctgcctgccccggcctctctgaggccaccgtgtgcagcaccagggccagccactcatttgccttgcttgaattcccaccgtggaggcaacagatagaatttctggaagaagcttcaggctcgagcaccttctttgacgtctccatagcctctcaaactctgagaagctccaggaagaggcacaggcagagtcctcttctatccaggttaaataagttgttttgcctttcttatgtgaacttaacaatattggcccctcccaagaaggccttatctcaatctcaagccagttttgtgagttctactgcacttgggcatttttggttctggtgtctgtagtaaaatttgctgaaagtgaatatattcagaagtctaaaagaaatggtcaaaaatctgatttctggctgggtgcagtggctcatgcttataatctcagcactttggggggctgaggcaggaggatagcttgagcccagaactttgagaaaagcccaggcaacatagtgagacctggtctctacaaaaacaaacaaacaaacaaaagtttagctgggtgtggtggcatacctgtagtcccaagtactcaggaagctgaggtcggaggatcacctgagccaaggaggtcgaggctacggtgagctatgattgtgccactgcactccagcctgagtgatagagtgagaccctctctcaaaaaaaaaaaaaaaaaaaaaaaaaatcagaattctgatttctgcttaaaactgccacacagagagatttcatgtgccagaatgcatactaactctaatttttggcaaaccaacatacatatgagattacttttgaccatgtagaattatgactgagaaatgaggtttataaaaatacgtaagctaaaacagcaactcaaagaactgaaaaagaaatacgtaagcattgtctgggagctgttttccccttccctgtttttcctctgtaacaatctcaaggcagcattcatctctgtcaggctcatttacattttcgatagaaatacttatttttttctttaggaaacatgaaggtttaagaaccagtaaaaatggtaccataattgtcctctattttattcacatgctgccagggggacttagttgcgatgtgatttaaatgactaagaattttattagaggtgcctgtgatgaagggcatttatgtgaaatctaacgagcatgggggtgaggtggggcaactgttcagtaataaataatgcagcagacctaaaacaaatgagagaaccacttctggagggaagagacacatcaccatctccgttcaaagagcttgtctcattgtgttccagagcctggccaagctgaccgatagcttcaagaacagctgctccgttaccgactctctagtggacttccctcaccatgtaggcgtgcctggcgatgctggtgtaccccagcagttctgcgatgccggctcccagactgatatcatcggggaggtatatgcgcgcccagggggagaaatgcaccgggagaggggagggctgcttcagtgttgccatcactggtttggtgtaattttccatgttcacttaagaaatgccttcacttttgtgccattaagtttgaagaaaaagtgttgtgtctcacatccagctgtgtgatacaattgaattgcttattactgctgcccttatgatttggactcttataaatgacatactccttgtgagagttgagtttcactgttcttttgacagacatatcactttttagagcatgagtccccacgctttttctgtgaagggccagatagtaaatatagtcactattttaggctttgcaggtagttctgctggaactgccccaccctgtcattgtagtgtacatgcagccataacagagatgccttgcaagcatgtaagactggggcctcgagctgctcaaacgttcacttacggaacagccagtgggctggatttggccccagggccatagttactgattcctgccttagaccactgatttccaaaggctttatagctgtgccaccttgggtgttactttattgctgtttcttactcttctaaaagaatgtcaggaaattgaattgaactaaaagtcatttttgtttgagacttggaagaatgtcataatgcctcctttgttaattagcgaagccttgagttagccacaaaaacaaagttgggaaaatcaccatttgaagcaggatggtggatattcaaagacgctagtattgtaatatcattgagtgaagcttgacattaatttgttaccaaatggaaaaacagtttaaagagcttctttttttttttttaaggattattaagtaaagatgaggtatcaatggaatgcacagtgccacccctcccccgaaattaaataaataaaaggaaagcaacaaaaggaggaaaaaacaattgatggaaaactctgggttttaaataattagctaattaatattttgaaatcttagcaactagtgcctcttcgagtggagtataatgtaggaaatcacggccctttatgtcttgggtgtcctggaacagtcctattttcaaatttgcctgcgttgttccaaacgtacacttggccgtttttgactaggcatcttctttggatgaaagaatatggtcgccatctgtaacacacagaggagaatctgtaattcaaaaatgtttggcatttttgcgtaaagattttggagcgagagaaggaaacaagtgtaagactcattgaattcgtgaataattcattgctgcttattgtaaggttagaattagaatttagtttgagagaaacagttaagatagaaggttctccagtgatttaggtcaacccttctaaaaatgtcaggtgaggagtggtggctggttatgctacttgagcagtcactgctcattgttgataagctcctgaagtttaccggggctgaccctaggtcagcaatctcatagctgttatctcagtttaagtagttgttcccatcctgtgtgatgtgcaggagaccgagatgccaggttacctaaggtcttgtagctgaggagaggcaggtctggttttgaaacatttctcatccctaaacccctgtactttctaagaaaccacatcatgttatagaaaaatagatcaaaaggctatgactgtattagctaaccattgctgcataacagatttccccaaaacctagcctcttacaacaacactcctttattatctcatgcttgatgtggtccaggagactgggctgggtcttctgctccagggtctctcaggaacttccctgcaatcaaggtgtcagccaggactgtggtctcatccaaaagctcacctgggggaggggccactcttaagctcatgtgattgttggcaggattcagttcctcacaggttgctggactgagggcttcagttccttgccacatgggctgctccagcacggcagcctgcttcgtcaaagtgtaccagctgagagtctgctagcaagatggaagtcacagtcttttgtaacctattcacagaaatgacttcccatcacctttgttctgttctattggttagagtcaagttatagacccagtttattctcagggggagggaatttcacacggggagaatcccaggaggtgttggtcattaggggccttcttagaagtctgcctacctcactttgtgcttgtgttgagtctgttttgtggggtggatattgctgtatgtcagatgtgctttttgagactggagatttgcagccacagggttgcacacgctgtagcgctgcataggaactctgaagcaggagtctcttggatccatttggctgtcttttcttttcactaaaatgtccatttaattctcaaagaagagtacagaaacaaagcttagagagaggtgcatacagctttgagaagaggtttgagagatgatgtttactgatcttgatgagttgattgcagggtcactaataaagaggggactgaaatggcaagtagctcatctccactgtggacagcttttggagctgtggcactgccacttaaatatatttatactgaggaagctggagaggagcattggatgaggccgtttaaacatgtataattgtggccaggcacagtggctcatgcttgtaatcctagcactttgggaggctgaggtggccagaggtggccagattgcttgagcccatgagttgaagaccagtctgggcaacatggctgggcaaccacctgggcgtggtggctcatgcctgtagtcccagctacttgggaggctgaggcaggaggatcgcttgagcccaaggggttgaggctgcagtgagctgtgattgtgccactgcactctagtctgagcaatagtgcgagaccctgtctcaaaaaaagaaaccatgaacaattgtcattctggttggagaatgctcagtcccttgtaaggcactttttcatcttgccattcaaggcaataaatttgcgaagacatttttcatcaacatagatcaaaactcgtgtcgataaattcactgctaatcattcaagttgaatattttcagatacttgttgatgggaagttatttcaaaaatgtaaagacttggtggccataatatgtgatctagtaaggtcagatcaacagatggagctgatttattgaaactggagttgtgtgaatatttgcaggaatgaggaattaaccaaaatgtactacagttacttcctgtacatgtctttttttgttttgtgtaggattttattgtcatcaatgtaactggtacaaaaatatttaagtatatctactcgtcacagagcaccgcatttaggctaactctatattggtactccccgagctctggctttttgagaccttgcttgctttccttttgcccttggttctttttttttttttttttttgagacggagtcttgctctgtcgcccaggctgaagtgcagtggctcagtctcggctcactgcaagctccgcctcctgggttcatgccattctcctgcctcagcctcccgagtagctgcgactacaggcgcctgccactacgcccgactaattttttgtatttttagtagaggcggggtttcaccgtgttagccaggatggtctcgatctcctgacctcgtaatccgcccgcctcagactcccaaagtgctgggattacaggcgtgagccaccgcgcctggcttgcccttggttctttaacacacctcgtggcatcagaaggcgtccaccagcccatccgtcacacagctagtccagcttcctcagaccgtggagcttctgagtagaacatcattattttacgtttactgaggaattagagaatgtactgcacaaaatcgggtgactggtttttgcctttgtatcaacttttactaagtaatttcctacttcttttaaaacctaatttgtggttgttgtttggaattacagaatagatagatatgctgctgctgtaaaaaaaaacaaaaaaccctaccagtttaggcaagcaagagtcttcccttccccctcccccctccccagccaggggtggccgcaaagggttattcagtgtttccttccagaccttgcacagattgaaagtgaaagagatgaagaatatttctcattgctgccgaaagtttaagtgaagttgctattttggaaatatgtttttaatatgcgtttcctttctttttttctctcttctgttccggaaagtttgtctttgatgataaaacaagacttgtagaccgagtcagacttaattggcaatatgaagaagccagaaagaggtaagaagcacttttttccaacctcgccttctgcttacttacttactttctcctgtggaaggaagcgtggcatagttcctgtgtgtgattggtcacgtctcatcggagaacagcgtttgatagaataccaagtcaaggatcttcatttacgtgtagcttaatacatacatatgacaacatttcaagtgcatttaaaatgtgaaatttgcaatattacaaacagttatacagacgtgattccataagaatagaaacttttttggctttgtcatccccggtggttcagaacctctacccctccttcccttccctccttccaatagacgagcatcagttccagagggtgtcataagtgaaaccacttgatcttttatatgtgtggcttctaactccataagctaatgggcaaagccatgtatcttggttataagacattcaataagcattaggtcaacaggtgagcagtacctaattgatttcattccatttatgttgtcctgtgtcgtaaaccattggcctcctgcaaattgcagcttgacccactttgtgcacttgtgtttctctttcctcacttccctccctcccttccagtcttcatcctctgacatgcacaaagctgagaggcttccgaaccctcgcatggcatagtattttagggcgtcacgtgtctcctcagctgtgcagggctcccgttttcaatattcttctcctctctgacttttgtattctctttttagggactttctctagtttgtgccttctggaaagagtcttaaagccaaattatttccaaataagtgcttcagaagagtatcaagcatatcttttttaaaaagttacttgagtcacaaatgaaatattgtcatggggggcggggagagcagaatagcagaatgtcgggtggggtgagggagttctttctggaagctaaacagttaggcctgctcagcacactgtaccattcatggacgtctggaaagctactttgttggctttttaaaaaatgtaaaaatagcaacaaaagcacatcatatgattcagtgctccagggccaacttaaacggacatgggccttctgttttctaggaggttttctaaccagtgcctcttggctttttaggatggactcgtggtgggctttaaatttccccacagaacagtgccaagttcatttggcaataccagttgtctgtgtggtgattcttcattatcatgcatattccttctctgtagcctgcaagagtttgtgaggagcgattgtctcttctgagtattcgtctgctcttgcctgtttctggtgaaactgcggagtgtgggtgctggaatttgctacacttaggaacatgattgttacgtgtttggttgtgacatttaccaaacatagcaagtgatttctttgttttctagagatggtgccagtatatggtgagtaaccttctaaatgttgggataatacatttgggtgaaaagtcgagtatttaagaaaattgttcaaggggcaggcatggtacttcatcagttcttttgaataaaataccatattatttcaagatggccagaaccttgttaggaaacgcaccacagctacagaggaaggtccaccttccactgacagtagcggcatgtcagaagtgcctctgtgggctgtgttggagcatttaaaaatcagagatttcttttaaactccacctgggtgggcctgcacaggtgctgcctgtccttttcccactagcatagtggggctccacacagggagcaaggccttcaccctccaggagacctccagcagtgtctgcagacatgtttaggtgtcccaactctagggcaggggccagggaggctgcttgacatcctgttgtgtacaggatggcccccgcagcaaagacttacccggctcagcatggccgcggtgccaaggtccagaaacctcgccctggggcttcttcctgtcttgctcctgaatcttcacgatgcatggacaacaaggggcctacatgagcaggtcgcctgctgactcacaggcatcagcctgctccccactcaccctgctccagccaatcggcccctcgatgttcctcagatgtacaagcacgcctgcactgagcagcccctcgggcctcccaccgggcctcagtcccaccgagccaactcctgacctagcatctgcagctggcagaatgatggtccgtcaaggtgtctgcatcctgatctccacagcctgtgaagatgtggctttccatggcaaaagggacttcgtggatgtaattaaattagggatcctgagatgatggggaaatgagcctatatgatccaggtgggctcagtgtcatcacaagagtcctcataagagagagacaggacggtcggcagtagagaaggagatgtgaggttggaatcagagatcagaatagtgtggggccaggagccaaggagcacgggcagcccctagaagctggaaggtgcaaagaaacagattttcccctggaacctccagaaagaacgcagccctgtagacccattttcgacttctgccctctagaactgtaagggaataataggtgttgctttaagccattaagcttgtggtaatttggggcagaaaagagcaaactcatacagtgcccttggcctgttctgtcttctctgtctggaatggggtggcttttctccaaattgtcacatgacctctccttttgatcaccttgttaagagaggtttccttgaccatcctgaataaaacctcaccaccctgtcctcaccccggtccccctgattggctgagcaaatgttattacctaaccagtgtttacttttcttactgcctgtctctccctgtgaaaatgtaaataaccctcatgagtgcagggattgtaggtcattgctgtaagcccagcagctacatacttggtgaatatttattgaatgagtaaatgagggtcccgtgtggttgcatttgctatttggcctttgcccctgggacggggcaagccagggcagtcccggggccaggtcagctccaggccaactgctctgctcctgggtcccttcctcaaacctccatccaggtgtgagccttggggtctctcgccttgacttgagaagggaaagggcttcaagacatgggtgcctttagggatctgaggtaggcaaggaactgtctctccctttcaaggactatgttcaaggtgtgatacgtcaacacaccgagctagactaacagttctgggccttcatggacattcaaaagggctactagcctttgaactccataattaatcctctccttgggggttggagaaaatggcattggagttgggtcctgaaggagtgctgggattccagtcgccgtccattggggatgggctttctcaggtaagagtgggggtcaggagtgggggtaaggtgtcactctgcagcagctggactggcctggaattgcagagcaaaggccagccaggctggaatggaggatgcatgagcagggaggcaggccacggcatgggggccacgatgccccgaagaggggtcagaattgctgggcatgctgggacgtttgagttggaaagattaagtgtgagccattcagatggtggtatgtggaggagggccatttgaggaacccagatggcatagagatgaagtcaccgagcagctgggctcaccttgggagatggaacacagggagaaaagaggagatgccaggactgagcctgaggaagtccaatcaaaggcctggcgaggacgagactggccagaggggtgtagtaaaaggtccgagaggggatggctggggctggaggaaacaagaagaggaagtacacctgagaagacacttatgtccacgggcccagtggctgtgaaggaacgaaaagggggtggtaccgttggccgacaggcaggcctctgcttcccaagcccagcctgaggtgtccttagtccacagtgcatgggaaaaaggagggccagcggcaggtgttcctaaagccaactcgctgctttccagtcaaagaagcctctcattctcagagatacatacatatgtacatacatacatataaatatatataattaatatatgttttatatatatttaatacatatttattgtatatttttatatattatatttataatacgtgtttaatatacattttttcatatatatttttttctgttaaaacatctttctcttaattaactaatgatgatcattgatgtgaattggttttttccaaaagtctttacttggcaaaataacaagctggcagtcctaaattgttgccatcagcacatcccctttcttaaattggactggcctgggggaagtgtgactgagatggtgctctccctggaattaaaggagaaggatgaccctaaacagggtttccagaggctcacagtaaagtggagggtcatttgaaaggcagatcttggttttgaccatgagtttggtgttttcagtggacttgaagctgctgagaaacatccatgaagtgttcttgtcggtggagtccgcagtggagattgcagttcgctgagtcattgattgcagctccctccgggctctggttcccagatgcggcggtgcacgtctccagtccccttggtgtgattgtttctgcctccagtcattccacattggttactgtagctaaggcttgaccagtaagtgcatgcctgccatgtgaactactcagctgtaggtcacataacccttagcagcctgggcaaggccctagactttacataccttgtagcgttgtcaggatagtcttggctcccctctgccccatccctgtagacagatggaaggctaggaagggttgatgttatcaggtctccccagcaccagatgagcgatttcattacaatggtgttttccgagtgttctgatggactgcctctaagtgaggcacgagagtagaacgatacagacttggggagagagcagtggcaagtggttctctggcaagaactcaacattaacattccaggagccaggtgctgagtaccacaggcaaagcatggtggctttgaggtcccgtccatggtctcttcctcggcccccttgatcaggctgggagataatgtctctgatatccctgtgagcgtccctggagaagtggtgtgccatgagcaggaaggcatcatgtacccccatcaacccaccaaagcatgaaaaagaacacgttgctcttagtggcagtgttagcaaagaataatgcgttcttccctgctccctcattccaagcctaagggacatcatgtgccctttcctcttgcccaggtgaacttctattagattagtgccacaattcagtgtcgtcttttcgttctgctacttcgccgttggacattaatctcccagctctcattcctgaaatcatttcaccctgcaagcttaccttccctactgtattaggttctgcagagaaacagaaccaacaagagtaggggtagggaagagaagggagagagattattttattataggaattggctcacgcaattatggaggccaggaagtcccaccatctgcaagccggagacccaggaaagccagtggtctcattcagtccaagtctgaaggcctgagaactgggggtggggtggggtgtggagtggggtgggtgggtgggtggtcatagtgtaagtcccagagtctgaaggcctgagaaccaggagctttggtgtctgagggcagaaggtggatgtcccagctcaagaagacagacagaattcacccttcctccacccttttgctctattcagtccctcaatgaattggatggtgcccacccacattggtgagggtggatcttctttgctcagtccactgattcaaatgcttatctcttccagaaattccttcccagacacactcagagataatgtttgtaccagctatctgggcaagctttagcccaggcaagttgacacacaaagtaaaccatcatgtatatcctctgcagaacctcctgtgctttgccacttctgaacagtggaggattttatgccttaggcattttggacgtctttccttgcacatatatatttgagattatttttaagatgtgggaaattgtcaaaaatgccgaattctggacaatgagggatttcatatatatatatacattcagattttttttctttcctttttttttttttttttttgaagacagggtctcgctctgtcacccaggctggagtgctggagtgctggagtgctggagtacagtggcgtgatcttgactcactacaacctctgcctcctgggtttaagcgattcttgtgtctcagcctcctgagtagctgggattacaggcacgtgccaccatgcctggctaatttttgtatttttagtagagacggggtttcaccatgttggccaaggctggtctcgaactcctgacctcaagtgatccacccacctcagccttccaaagtactgggattacaggtgtgagccaccccactcagctggatttcatatatattcagatttaaaggaagtttgtggaagtggaactcataattctgagtggtgatgtgatttctagagaattctctggccaaacgaccactatcatgatgactagttttgtgtttttaactgtgggtcctgtgaagcgtaccaaaaggactgcttgcaccttgcctcaggagcgcctcttcggattcccaaggcagacctaatgataggaatattcacactattgattttaaaatttcagaaattttaaaagtgaagttgaaagagcaagtcttcttgaagcaatcccgatgacgcagatggctccttatttttaacttaagggcgcttgttccagaactgtgcacaaactgtagctgttaccatagaaacactctcagtccagataggaacaaaacattcggtccatccagtttctctgcctcttagtttttgttgccaggatcagtcctgctgttcatcagttgtcgaggatcagtgtagtgttatgattccagttgaatttgatcaatcacttggattttttcatttctcaaatgacttcctatctgggttttaggggtggggcacagttgtgagaaataaggaaaagcatctttgccactgtggctctgtcttccctattctggtcaacacggagaagcctgtagactcactgctttttatttgatgaagttgctctctgaagatctgtctgttgcaaagggagaagatgtcagggctgggaagctgaggacggggtgagatattggtgtattagtagacctttcttatcccacatattctagattcagacttctcaaacttctgacataaagagttgagtagaatggacgctggtttagttcaatcagctgaagtgatttcattgtccatctgacttacatctcagctgttttctttaacctttgctttttatttaaatgggtatttacaacaagaaaactaagagaaaatgtaaggagtatcgaacctgtagccgtaattgcaatctgaaggtatgaggctctaagctgaccccgcgtcctggaatgtgccattgggatccctcacgactcatcaccatgggataggaccgtgggctgtccagagttctgcttgctattccagaaagcagcaggattttaggaccatgagaaatgatattgtagactgcagatttttggtataaattcaaataattagggattattcttgatatgcctcagaactttttattattgaaagtgcattgttttcctataaaaatgcaaatcgtatttaagattttcatgtgaattgtgagagtctaaatagtttctgcggcataaatgcatggtttaatggtgcctgggttgtaacagaaaagtgtttgagcaaaaatcataagggaaaaatgattcatattttatgtctgtctacattagacctgctcagggaatagaatttgggaaacacataataaataagaaacctgcatgcttgattgaacatttgctttcttcactatcaggacacgggggcatatattttaaggcttttaaaggcatttgggagagattttatataggccataaaatgcattacccctcaaaaataaaaatcactgaagaatatagttggctcacagaaaaaaaaaaaaatcctctctaattttaagctgctattagttctctttacaaaaaactcgggaaagttattttgttttgcaaactttaaccatgaccttgctttacttccatgtatttaatttcactgaaatgatatttcaaagaaaagcctttctggaaattgtttttcctttaatacccaaaattggaacaacagcactcacaggagcgaggctccaaccagtggatcagctgtttggcgtggatgtagaagaaggtgcattgaaactcagtacatctgtgtttagccttaggcaggaagtctgtttcttcaagtaaacctaacgtactaaagatactccctgcagatggctcgtttccggcccacggcaaggtagacaagtcatacggttttaaaggcaaagccgtcttgtctgtctcatggggacataagaacaatcgattgttgaaggaatcctagtgcttttggcttccagtacagacagacagacagatgtgcctctctcgaccttgctgaagcaggccccaaatgttcacacctagaacatggggacaaagaaagaaattgaacttttcaatatgttccagtttcttctagattcatatatagctctgaaatgaagatgagattgtttgcattgttgcattgttttgaaattttattattaaaccccacaattggaaggcacagaaatgtttgcctagcattcagcacagcccaaacatttccagatgggttgcagattttgtttctgctggagaggtcgtcccttgccgtttgtccttgcatatttttcctgccagctgtgggaagtgacaggacatggtttaatttgggctgctgttctgtttctttatgcctgcagcagacaggtcttttgaaactcaccctttgcctctcctccctcctataattcatttttttcctcattctttttttcctgacagtgcatattacttgagattttcctggaaaggttgtgattatctggaattggatcttccgccaccttcaacagcttgaatccttgtaggctagcagctaacctagagctggcagactcaaatggaatcttgatctcttcatatttaaggctcagaaaactcaaaaggagtgttctgtaaaatacttctgtttatattatatgtatggtaattagtatgagtataaaatggtcgggcaaaatttagctgggctcagactttcctgtggatcagataaatggaaatgaaaaaaagtatgaggacacagatttgctgattgttcttcatcttttatatttatttcttaacttgtcttggtctactgtagaatgttccagaaatgtcattgggtataatgtctgatttagcactgacttatttgtgggtttgcttggagtgtattttccttgggctttggatatatgactgccataaattttaattacactaattagacgtaggtggatgcttaagcccagttggagtcctagccctgttcagctgcctctgtcattagtttttctggtgacatggtttggcaccatcttccaacacgttttccagacattagttttaagttagaaaataacttgtctaataaagctactgacattcaactagtgtctttaccttgttgaagtggacttgagtaaaatgcatacatttaaactgtaacttgtgtacccgtttctttccttaactgtgggctttcagattcgtttggtggctagagagggagtcatgcccgatcctcatgagtccatgtgctcgtgtctagtttaggtggagcctgacttggcacaaggctgggtggcaggttttaacatgtgtggcaatgctagtcaattggggatatccacatggctcatagtgtagagaaggcttctgaggtctagacccagcaggtgggaagccagccttggttagtgccgtggaccgcgggcacaggaggaggcagtctcaggagcacctctgccctgcatctccctcggaggatatagggccacgtgtgcctgccacttccctgttctcacagctctttgtgatctcagagaagcctctggattttgtttttgggcgagtatgccaactatgtcctccacagcatggggttcaggttgagtttgccattcctagtttctccctagaaacatatccctgatctttaaccctacttaaagggcttaaaacattctactcttacttttaaaggatgctttaaaaatacaggccacatctgtttcacttaatctgcattcaacagcacctcatgacacaaaaagtaatgcagtctgtttgccaagcaagcacttggaaatttcgaggcatggaaactgataggagcctctgtttttccaccttgaggattgttgcgctttgcatccacccagatcatctctcaccagcatccatgctcacagggctgcctctcttcctctcacatatttgcaggcgtgtttgttcactgttcaatgcactcagcttttgtcgagtgcccacttgctctccgcaaggtgttttgaattcatgtatggccaggggctctggtgcaggaaggagcacacagaaccagaagacgcggagcatggggcttcgaaggtctttccttcaggacgccagatgatgagtgcatttctcctttgttattttgctaaagcggctgacagtggttagacacagctgaggaggcgggaggccggcagcacttctgggggtccagcatgctgtttagctactgatgagggtgggcagaagaaacaagcagactccctcctgctctgggacagtttcatgtaggaaaccaggagtctgagccgccgagtatgggcatgttgagggctgctggcctttttgtcagttcttcggaacaggcacgatggggttattttcatctcgaatctcaggctaagggagcttcaggaaaagacttctgcaccattttttaggacattgtttccatatccttttaagtgtaagggtcacttggtgtaatcatttcactacttatttggcaaaaggagtttatagaatcagtgtgagacgtggagaaggtgtgaagacggcgttttcagtccgccgatgtccttttttcctccccgtctctcttgcagagtcgccaacatccagcagcagctggcccggcttgacaatgagtcctggccaagcacggccgaggctgacagggaccggctgcagctcatcaaggagaaggaggccctgctgcaggagcttcagctcatcattgcacagcgccgctctgcgggagatgtggcccggctggaggaggagcgggagcgcctagaggaggagctgcggcgtgcacgggccacctccgcacagggcgccacggagaggtgggtcagcggggacacgacctccagcggaaagcctgctggaaaaactccacggggtggcttgtgtgtggctggagggtgttcctgatgatcactcagagcctctcctgcctggatgttccctggcctaggaggggcatgcggtggggggcactgccttctgctccctgggtctctggagcctctgctccgaagcaggaggtgattgacaagggggaaggagtgagggaagatgggtgacctccatctccgcccacgccccacccttcctgaagttggtgcttggtgcttccacctgcctttgtgggacagtgccctgagcaggctgtggtcccgctccggcccgggcagctctgttgcatgggggaagaattccctgttcctgacgtggtgagcatggtgggtatccacctactgctttcctctccaactttgatttctagccaggagagcctgctcttctctggcattgggaagctggccacctgtcgtgcgtctgtcctgaggctccttcaccacgcaggacatgcaaagccagcatagtggctttggtattcggtggcactgagtcgttcagcctttcctcgtgtgccgtgtgtcctggtttccatttgctgtgtgagactgcagattgtgtcaaaggctgggcctgccttccacacttaacagcagtttctctgtggctatcagctgggcttttggagagcagcccctcccccacgtgttaaagtcttgcccccttgagctcacatgagcagctctacagagactctaatagatgcttggatgattcgatctgttcagatgctcttactcctactgtttcacgatggttgtattgttgggcgtcctttatgcttgatgttcatgggtcatcttcataggagacaagtctgtggcttggcacgaggggctcacggcagcctcagggaagcggtggtgtttggagagttgagctcagagtcctaggcaggtgaatttcattttgcctgagatggtggcatgccctgtcacctcacccggaatcaaccgcgaggagaatctgaatgtgaaagagctcttgcacggctgcgtttgttttcagctaaacatttccttctgttccacccctggtattcttgtatgtgtgttctgcgtaggagggcctgggagttcctgttgcttctctgtgaaggggggaggacttggccccacaaatgtcgcctgcatctcagggccccacacccacgctcctttgactgtggctgctgtcaccatgtggaaatccagcacacacgagtgctgtggcccctgagtacaagtctgcagccctccatggagccagtgttagccccgatgcctgggttcaagggtggggacagcaaagccggaccagctttgactcccatgggggtctctcgtgagaccagcccaggtgctgagtcctgggactcagagccctcgaccaggacctaatcgccccaagcgtgtttcctgaatctgctgctaaatgaccttggccggaaaagcacatccacatgtgctaagcacttgcacgcacatcgcatgggggtggggctcttgtagctctgggctttctgtgccggtacacgcagggcccatttctccactccacctcccttcattggaggggtgtttgcagtttgcaagtatgaggccacatggtaggaggcttcccccagcacaggctggcagcattaggagacccggcgtgggccaggtgcagagagagagtgaggttggtgccttaaggctgagccgtgccagctgtagagctgggcccagtctgcctgtctcacctgcagtgtcatcagcagcaaatgggaggcgtttgccgggctgggggtgtcatccgggggagaaagagagagatgcgcacctccttcaggcctcccgccccggcagatgatacgtgcggcggcctcccagctgctcagagccagcatctctggagggagctggtgcacgtctcctgggctgagggagcaggcttgaggtgaaggacacataccctagataatctctcggatggctcgtgtcaacgcttgcaacatcctttgctattttagcttgctcatgttagtgtgtggcaggcatttatacaagatgctgatgttcaacagagaaccccacggctctattacaagatgcctgccatcctgagaaattctctttccaaggatgactgcttttattataggggtgattataaaatgaaagatctatcaaaaagcaaaaattttgttctgctgaacctgaagtcatgttttcctttgtcataatttaatgacatctttacaataaagtactttatgtaaagtaaataaagacagtaaattagactttatattttcttaatctgttagcttacttttctactccttttcatagcagtggtaaatattctttgaagttcgtttcatttgaattggagacacaaggctatgtgctttaggagttgggccctggccagttttctgccaggaaactgtatccccttttctttttgttgaaaaaataagtacagaagtcaggcaaatgtctaagactcttattttagcagtttatgttccagccagttttttagatgtctcagttattgccagcgtggcccctgtttggtaaggaagttacatttttagtcatctgcaactttcagaataaccagcataaaattagactgcaaatgtgggcagtcatgggcacttgtgtgtgatcttgtatccagatgcgctgtctcttgtgcgctccgaaatgcacctgtttgtataatgacaaatgtgttgtattggatagaaggggggaatttgatctaaaacttttttcactacagataaaacaatctgaaaataagtcatgactaaagacagtctaaaaccgagccgtacatatgaatgtatctatatgtcatatgtgtgaaaacagagctggaatgcgctgacggatttagcgatgggttggaaattctaccctggtcactcaagagtggagccagttttcagtaggaactcaatttagattctattaatttgggatttgagctaatagaattcaggttgggttagaatttctgaaaagcattaagaaaaaagttagtagccttggaccgggcttgggtaaattccctacaacaaatggcttcttggagctggtcactgtttgccactggatacgctctgctggtgtcgtctctgcccctggagtcctctgtgacttaatagtgtcccggtgcttgtgagagtgggttccaagttacagctccaaagctcaatgaaggatgtattttgaactcacttttaaactccctttgaaaactctcggctctccatcttctgaaaaagatggggtttttgaggatatcgcccttgataagcgtcagataggatgtgagtatcacagaaaattggggaaatgtttttcagtagtaaaggaaatgcctgtttgttggtagtgtgccttggctttagggtcaatccagcctgaccgaactttgagcttgcgtagcagacgcaagctactttatatgagtttcttcatctgtaaagcaggaatagaatccaaagaccagtaaggaatgaggcagtgcatagaaagcagtgtgcctttctataagcccctcagtggaactttttttttttgagatggagtctcgctctgtcgcccaggctggagtgcagtggcacgatcttggctcactgcaagctccgactcccgactcccgggttcacgccattctcctgcctcagcctcccgagtagctgggactacaggtgcccgccaccacgcccggctaattttttgtatttttagtagagacggggtttcaccgtgttaaccaggatggtctcgatctcctgacctcgtgatccgcccgcctcggcctcccaaagtgctgggattacaggcgtgagccaccgcgcccggccccagaattgctttttaaacgttactttcatttgtacaagctatcaaaacattttccttaaaaattaaaatatcataggtaagtggaatcttagaacattctactcaagagtttattacagctgttctcaaacattttggtctcagaacctccttccgatgttaaaatgctgaggatcccaaagagcttttgtttgtgttggtttttttaaagttcttttttctaactgttttgttttgtttttcatttttccccacccagggacctatcagtgtttatgtggatttttatctgtcagtatttgctaatttagaagttagcgctgggaaatttttaaaatatttatttattaaagataacaataggccgggcacagtggctcatgcctgtaatcccagcactttgggaggccaaggcaggaggattactttagttcaggagttagagaccagcctaggcaacatgacaaaacctcatctttacaaaaaatacaaaagttagctgggtatggtggcacatgcctgtggtcccagctacttgggagcctgaggtgggaggatggcttgagcccgggaggtggaggtggcagtgagctctgatcgcaccactgcactccagcctgcacaacagagcaaggccccatctcaataaataaaaaaagacaatacaaaccctattatgtgttaatattagtaacatttttatgactgataacttttttgaaacaaaaaactatagtgagaagagtggtattatttgcccttgctatccatctctttagcgtctggcttgctagaaggcagctgctttggccattggtgcattcggcctgttgagatagggtcattttgagtgaacacgtgaagaccatctagctgcttaccgatatgccattgggaaggaggggacctcataggacccctgaaggagttttggggatccgccaggggtctttggatcatgctttggaaaccattggtttcaatatatgatattgaacttgaaagtgggttgtgtcgtggctccatttaggacgatgcttgttactctcttgccagctgacctctgcatggcaccatttggaattttgtttgcatcaagagaaacaaaggctcatcagaatttatggcatgtggttgaaacttgtaaacaaactcagactggtttgtcttccttatcctaagttggtggcgcatctgtttcctttatgggtgatagcagctctttgtcaatcacgtgtcatctgccgtacattattttatctatgcagcatcagttccctgagctggagattgtggactccatttttacaggtaatgaaactaagggctcagagagggtgagacatttgcctaaggccacacagcttgtgagtgactggccaggtgggattctctgaatcccaggctgctgtcagacactgtgtctggtttcctctcactcccacctagccaagctctttaaaccccttcggcatgtccccttccctgttggtggaaagaggaaggtattaaaggggcctactgtggccacacgtcacagtgtcatttccatttgtaaaccaggagtgtttccttctagaggcaaacatatttattcatggagttgtccaacaactgtgtattgagtgcctatccacaataggctcgattctaggcggtgggcctactgcagtaggaataaattttattctacaaaattactaagtagaaaaaagtagaaggaaggaaaacaaaaatacctccaaccccatggcctggagatggcaacggctgctgttttgtttcatttgcttctaatgttttaactgtatagatcttagaattatatttgttcttctctagaaggtggcctagtatgagggaatctgatttgttccaaggaatttcaacagatgactgcgtgctctgcgtttgagctcatctgctagttatctgtccttctgctcacttaccactcctcccatccatccaagcagccatccccagccacccacccagccagccatctagccacccacccagccacccacccagccacccatccagccacccatccagccacctacccagccagccatccaccaacccagccacccatccagccacccacccagccacccagccacccatccagccacccacccacccatccagccacccacccatccagccacccacccacacattgacccatccctgtgcccactcctcttctcacgcatcccctcccccgtgcactgtgcctggcgcttccacagagtagcaggcactgctcagggtgccagggatgtatttttcaaacgggacaaaagcagtctctgtgatcttggcccttgtgacctgggtgcttttagaatgggtggtgattgcaacctaattcagctggagggaattgatagtggactgtcttgttatgaaaatattctccctgtctttgaaatgtactaatcgactgtcttcttacctacaggattctgcttcaggaaaaaaggaattgtctacttatgcagctggaagaagccacccgcttaacatcctacctccagtcccagttaaaaaggtaggttactttcaaagagaaaactgtacttgttcatcatgttccaatgactggtacatgaactcgtttcttgtagcttgacctgaaatgttgttaacacagaatggatacattatatttttaacatgctactactgtatgactcaaggaatatggagagaaccacatttggcttcagggtaaataagaggcctgaagtcagatgtattcaaggattttgtaacctaattaacagtttcagaagtgtacatctatacacgtgcgcatttttgttttgggttttttttaaaagcatacgaactttttaagctagtaagatttggctgctcaagaatggccaatgtcaagggcctcagatgtgtcattttctcagatattcctcctaacaatgccccaggtgggaactgttctcaccccagccccagtgggagcccagagggggtgaatggcttgaccaagtgtacctggctagtatgtgttccagccaggactgggactgggacttgggcacgggtctctgctgttgcccactgctctctgccaccctttccgtgctcacagggtgagcaggggtggctgccctgccatctcagatggccatgctgtctcatttcagcctgtgtgccagcaccctgacggtgtcctcggggagcagccgcgggtccctagcctccagccgtgggtctctggcctccagccggggctccctgagctcggtcagcttcacggacatctacggcctcccgcagtacgagaagcccgacgctgagggcagccagcttctacgcttcgacctcattcccttcgactctctggggcgagatgctcccttttcagagcccccaggcccctcgggcttccacaagcagaggcggtccctggacacgccccagtccctggcatcgctgtcctcccgctcctcgctgtcctcgctgtcgcccccaagctcgcccctggacacgcccttcctccctgcctcacgggactcgccgctggcgcagctggcggacagctgtgaggggccaggcctgggcgccctagacagactgcgggcacacgcctcggctatgggggacgaagacttaccaggcatggcggcccttcagccacacggggtccccggggatggggaagggccgcacgagcgaggacccccaccagccagcgctcccgtgggtggaagtaagtgcggatgtggcctcctgcggggcgagggttacctgcagggcggaaactgtggggtccagagtgaggatggctggctttccaggtccatggtgagctttacgtttaggaatattgatgtgatcgggaagagcacacacctgctctttctgatctgtgttggggaaagatcattgaaattgacaaagttgtctttcctaggtatttggcttgttttcaaaaaatacttaattgttgaaaactagggtaagaactacacaggcttccacattcagaggctgctggagatggattagggccttcatgacctttgcagcgtgcgtgccgagatggaaccgtcagtgtgtgcccgcctgagaccattatgccaacaggtgtctggttgtagctagtggaaatcttgacttcttttgttgctttgacatctctttatcttttatagttttcatagtttccaagaacataggtctatcaaatgtggaagtgaaaataattgtgtaatttcaaaagacatgcctgtaagtatcggtcatttctactgatttggtttctctggtgattcttcaaatggaaaaacacggagctccgtggagcctcatccattcagttggtgttggttcagctcctcctcggagctggggtctttcagcttgtagcctgcttggaagaccaaactgctattgaagggaatattgaccccatgtgcttttctcagccacccatggcaactttatcttcctttggttttaaagaggatcaagaacaaggtctcccgttcctgaagttcagcccatttaattgacttttatttgcacggcaaaaatgttttaaatgttccatttaggcaaacactagataatttgtgcagcatagtggatctcagccaggggtgtttttgcgtcctgcccctggggaacacttggcaatgtctggaaacatttttggttgtcacaactaggggatgggagatgctcctggcatgcacagggcagcaccccctccccctcgagaatggtccagccccaaatgtcaagagggctgaggctgagaaaccctagtcacgtactatggagtatttatgcggcaaggggtagaaataaaactagagagcagaaccagtgtggtgtagtggaaacagcttcaaactagcagctgggagaccaggcttttgttccctgccctgtccacttctagctgtgtgaccttgaacacatacctggactgagtctcaccttttccacccttgaatgcagtgatctttgtgaccccttccatttgccaccattctgttacccaagagatagatggattggtagatcaatagataggttgatcactctataaaatagtagtctgttggcacttacgtgcgtaaccagaggccatcatgttctgagactgccccagggctttttggcatctctattttggtgtctgcccctgtgtttgcaaacacactttggtatccccagatacattgtttctgaagtccatatatgcaggtatccttcattagctttgttcctctttataaccacaggttgattgctccatgtttattccgttcagtcagaaaagaaatatccaattaggacttctttcttagtctccctcctctctcccaccaccttctccttaagggattgagattccagaatgtcagtctagttaggcataaaatctgcacaaggcccaagggccactttgggtcagaggagagacagagtgggagggagaagcgctgacttaatttcacatcctggtttctttattttttcctttgctttccgtggcagatgctataatggttgaaacttcttggactgggaagtatttgcttacgtgtgtagacactgccatctcgtggtggagccatatgtcattcgtgattatttcttgtattacactgccatcttgtggcggattcgtatatgacattggtgatgaattcttgtatggcactgccatctggtggcggattcttatatgacaccgccaataaattcctgagtgacactgccatctggtggtagattcttatatgacatcggtggtggattcttgcgtgacactgccgcctagcggtagctttttatgatactgccatctggtgatggttttatatgttacatatattacattgtttcaaggacacatatgtattatgttgttctaaggacacgtttatttgtatccttagaaacttgaaatagttgaccctgctgggtgtccccagagggccgggttgggtagccagcttcaggcatggacacagggggggctcctcgcctcccctgccccatcatgtatcagctgtgctgggaacactgcagtctaagtttggcccccagcaagtcttagtaagacaaaatttttgtaagataaaaatcaaagttgtccaaacttgcaaaccagcctctgaatgattttttccttgtgttttcaatcaatcggaggaaacagaaggcaggtcagaggagtggggcaatacactgtgatttttcatactatttacgtttttgttacagttttgtcttccctggattttaaaagtcaaatgtgttatgattatgaaatacttagctattttcatctacccattagtatttgctaatcaaaacctgtaaaaatcttgactttgctcatattgatgtttttatgatattgatattctgtttaatgttgttggcttaaattctgcagtgttttcactttgtgcttttttttttttttatctcctcatgcggctcgacagaagtgctcactgtaagtggccttgggagtccccttgctcagcgttgttgctcaggccccaggcatacgtttgtgctgtggatggatgtgttcaggatggctggggtgtggccaacgacggttatcttatagctgtgcttcaacacaagttggcaattggccttattgttatctcattgttaatattcaagctgtttaagaactttcctagaagctttcactgttcattccctgtatgtgtttgtttctggaatgtaatggcgttcgttgctgtcatatgccacctggcagctctgctatgctgtggttttgactgtattttcttcctttttaccaagcactgttcacatccttggctcttagtgtctgtctgtcttgaatgatgaaaagggagtaaagagattttcacatgaacatggggaagatttgacccttgtctccctggcactgctcctgagggtccacctctgtgccttgaagccccagggcaggtgtccggggtgtggagcgtggagtctgtgctttttctcagccggggcagttgccgacaggacttcctcctggcagttcctacttccacccaccctgtgggtccagtgactcagcctgggcttcgaggattagctccttcatttctttcctctctgtattgacttctatggcaatgatgagagagaaacgtggccagacttgcgccttgggctgggttggttgcaggtgcttaggctcattacctggtgctgtttccctgcaggcatctacagctgagtctggggaccacgcgtgtcaaggctgggaatgcaaatggtagtggtggtttcctttgctgggggttgatgcagtggttgggggggcttccatttgcagttgagggccaggtgtttgggtccttccatgtggcagggataaagaggagagctggcatctggagtcatgatctgtctgagaggcagtgcctccggccaccgtaggatggaggccagcttccagccctggctgatgggggagaagcagcgaattctccagatgtggtatggcagacctttggaagattcactcggcctccacttaaccttgtgagaccaaaggccacagccccatgtgttctgcgtgctgttgaacatgtttgtatttcattggcgtggatgataatttggttgaaaggagagatggtcaccagtggactcagtttaggaaggcacaaaggtcaaccctttccgtttctagaacttagccaaagaaaagtgcggagatggaagcgggagctggctttgagtgacggtggagtgcccagctggggcttccaatttgattccgtgttccagccgagtgtgcccctccacaaaacagactcctgggctcacagttgcatttagcgcgggaagatgatatacatgtttgtattggttttgttaaaaggaacttattgctatgaggaaatgggtagaaacggctgatgaaatgttaaaaggaaacatttcaatggctatttttggctcttgaataaaatagatgtgaaagataaaaataagcatagcaggaatagcagcgtgctaacccagaagggcggctggaaggctcctgcctgcggtcactgagacagccacgcttgagccccagcttcctcccccggggccgcaggcctcccaggtggtgttttcagagaatgagtgtgggttcaactgtgtcctctgctttgaaggttgctaatttttctagggtttatttggataattaaaatgtttttttcctgagtataaaagcagtatttgttgtataaaacatgggaaatacccgacagcataaagaaggcagtgaaaaccatgacctcttggcgagcgccgctgctgttcccatcgggctaatgctgctttcctgtctcgtttgtgtgcgcggctttcagaaagtgccatttgaggggcttctcatcgtcatcttatgttctgtgtgttcattaagggggtggaaatagatttatgaatccaagaggtagcagaagttcatttcttcaattttcccatatgaaaaacaactagagcacagcatgtctccgtgtgtgtgtgtcccagcgagtctctggaacactcattgacgaagtgtgtgctccagcgtcaaggaccccggtccccggtgctgttatttcctgaccctgtgtgtgtcccttacttacagcagtgactcttcgagaagacagtgccaagaggttggagaggagggcacgccgcatctccgcatgtctgtcggattattcgctagccagcgacagtggggtgtttgaacctctaaccaaaaggtctgaagctagtcttactatttccttctccctacgcagaatcacctgtgttactggcaatcacaaaaagattccgtactgaaactttcatacattgacactttgtttatttttccaggggtaggatatttttctagcttctttcacctttgggtgattgggttttagaaagaagtctttctccctggccctgggggcctaaggcttgagtctgatggagctcaaaaaggagaatcaatgtatgggagagccctgcttttctggaaaggacattcattcattagaaatgaatttcttccctccctcccttccttgttttcgtagctataggaatggtttcacaatgacacagcgccttttggaattccatgctttattttgatcgggcatctttgatgtcattatttctttgtacaatttaagtctccggtatctagaagacagttcacttaaagttaatttttgaacatttcctcaagtattacatgtggttttgaaaggcgtgcaaggttactttcttcttttatttatttattttttgtttgtttgtttgagacaggctctcgctgtcgcccaggctggagtgcagtggtgcaatcatagctcactgcagcctcaaactcctgggcttaagcagttctcccacctcagccccacagatatctgggattatagcacacaccaccgtgcctggctaatttttgtatttttagtagagatggggtttcatcatgttgcccaggctggtcttgaactcctgggcttaagcgatcggcccgcctctgcctcccaaagtgttgggattatagatctactccaccatacttggctaattttgtttgtatttttaatagagatggggtttcaccatgttggccagactggtctcaaactcctggcttcaagtgatccacccacctcagcctcccaaagtgctgggattacaggcatgagccatcgtgcccagccacaaagtctattttcctaaaacaggaacaacataagaaataggctgggcgcggcggctcacgcctgtaatcccagcactttgggaggctgaggtgggctgatcacctgaggtcaggagtttgagaccagcctggccaacatggtgaaaccctgtctctactaaaagtacaaacattagctgggcgttgtggtgggtgcctgtaatcccagctactggggaagctgaggcaggagaatcgcttgagcccaggaggtggaggttgcagtgagccgaggttgcaccagtgcactccagcctgggcaacagagccagactctatctcagaaacaaaacaaaataaaacaacaaaaatacccagcagtttgtaggcaggtacccagtaagatgcctcatggattctgggggcccgccctgttccttcagacacatgatgacctcattgacttaacgtcacaacttaacaaagccctctctcagcacgagggagctcctgcagaatctgtagcgaccggttccctcaggaatgaagttggttgcatttacccctctgttcaggaacgaagatgccgaggagcctgcctacggagacacggccagtaacggagatccccagatccacgtgggactcctgtgagtacagaccctaccctgtttcccctggggctgggctggagactgggcccaacccgtggctcccacctgcacacacagggctggagggacccttgttacccgaggtctgaggtgaggggacagaggtggcaggaaggagtgacagggaaaagtggctccactgttgtcttccaacatggagattcacagctgagagccgccacttcctggagctgggggctccggcaggcaaagtgtggctctcggggacagttgcgcccgtgtctgccaggagttggttctgctcactgcagcacaggtagcggactccctccctcaccgtcaaggaagtaatccgctggttggcaggacaacaatttttggtttctaattacagtgtcaataagggcagtgactgtgaggtgcccctgaggaaaacagggtgtttgggtcccagccatttcctttgctcactctcgtcacttcagtccagggctcctccacctggcatggttggcatttggtcattctttgttacggggactgtgctgtacctgggctttacccactaggtgcagatgtctcctgcagatagggtggggcagaatcccaggcagtggatggccactgctgcagttgagtcagaaggatggttttacttggggggcacctgccgtccatgactcgtgtctggtttcctaggcgcgacagtggcagcgagtgtctcctcgtgcacgtgctgcagctgaagaacccggcggggctggcggtgaaggaagactgcaaagtgtaagccaggccccagggcagtggccagccagccacatggctgaggagggaaaagacagtttgggagcctgaatttccaggaaagcaccagggagtgtgtgtctgaagtgtaaagtcttcaaaagagtctagtgaatgatttgaggctggtgaaggtgccggtgctggtggcaagctagtgtgtgccgtgttggcgtggaggaagcacttgcctgtgccgtacaggactgcatcctcctggcccggggatggggttgctgatgtcgtcgtgctctgctctgtgatcttgagagacctctggctgggaccagggcatccttgactgagcggggaggaggaaataggcattgggagcagctggtgactttggcctcgatcgtgggagcgctgcctctctgagctccgtggccccagatgggggcctgatggagggtcccacttacccaagcaggtgaccatgcctgtaatggtctgttcaagtcgcagggtggggcccctttggtgagtcttctaaaggcctcaggatccctgagtgtgagcagctgggggctcggctggggttcggccaccccaatgacctctgcagtgctcacagatggctcagcccctcccatgtgccagacttggggcagggagggtgggaaatacgggctaccccatgggtgatgggcagagaaagcagtgggggagccatgcagaaaaaccagaggggcgattcccaaaaaggtggggagcagcagggcctggaagcatccgctgcttcagtcctggcttggaagtcatcctccttgtgagtgacttcccccatccctggggtacatcgttctatgcttagttgagaaaggaactttttgcaaaggactctgagactgtagccacagctgcccaaagggggctgcacgtggggggtctgtgcgcattgtgtaggtcgcgcctgctctgggactgcgccatctgtgagcgccgcctgcacgcgctcttccctcccccgttctgtttgcagccacatccgagtctatttgcccccactggactcgggcacgcccaacacttactgctccaaggctctggagttccaagtgccgctggtgtttaacgaagtgttcagaatccccgtgcattccagcgcgttgacactgaagtcacttcagttatacgtgtgttcagtgactccgcagctgcaggaagaactgctggtatggcgccaggctccgcccgccccgtcctccttccttccttcgtgtttcagtcagccggtcttttttttgtgtgtatctttctttcccttctttctcttgtactcttttgtgatgctttcttaggtttcgtatgtctttgccttttggcctccctctctctcttctgcctccatctctagttccctccctcctttcccctctgccatcctccctttctcccgtggtgggttgcttggaagttgtgatcttcttcagtgtttctgtggctggaaatacaaacagggatgatccaaccagtgatgttgtcaagcaccttgtcctctaaatgtgtcctctcaactagtactcacgaccctgtgggatgcctttgcgtcagccccatcttcagtccagggaacaaagtagggttgacagatttagcaaatagaaatacaagacagtcagctaaattcgaatttcaaataaattatggatgctctttaaagtgtaagtatttcccatgcggtgtttaagactcacagggaaaccctgtgttgtttatttgaagtgcagattcacctgggcgccctgcacgttacctggcaaccccggggcgaggcctcaggagaatccgcagtttgtcctcagtatcccagccatccaaggcccatgccagggttggaagccagggtggattccttccatggccagagtgttctgtcttggttctgtcccctcagcggcacaattagggcatgtagagttcagcagtcgtttcttatttcagaaattcctgagcgaatctgcctcatcactgcagtagagctgtgagcctggcccagcactccaggttgcccattcttttgccctttctgatcccttcccagcactttctgattgggcggaacaggcgaccagggagccacccattagactcctctgcagttgctttcattgtgctgcagtcctttaagtaggaatgaaatcttttatgtcttgtttggttaagattgaagggtagcctgggcacagtggctcatgcctgtaatcccagcactttgggaggccaaggcgggtggatcacctgagctcaggagtttgagaccagcctggccaacatagcgaaaccccatctctactaaaaatacaaaaattagccgggtgtggtggcgcacacttgtaatcccagctactcgggaggctgaggcgagggaatctctcgaactagggagggaggtggaggttgcagtgagctgagatcgcaccactgcactccagcctgggcaacggagcaacactccatcacacacacacgcacacacgcacacacacacgcacacacacaaagattgaagggtgaactggatttttttgagacagggtctcactctgttgcccaggctggaatgcagtggtatgattttggctcaccacagccttctgagtagctgggaccacagttgtacatcatcatgcccggctgatttttaacttttttgtagaggcagagtcttgctctgttgcccaggctggtctcgaactcctgggctcaagcaatcctcccacctcggcctcccaaaatcctgggattacaggcatgagccacctgccctgcctgaactggatattttaaaggactctagtcatcacggcgaaatcattcagtgcctgttctggcatttctttaatacccctgcagggcattgctcagattaacctggctgactatgacagtttgagtgagatgcagctgcgctggcattccgtgcaggtgttcaccagctctgaaccatcaaggacgcgggaggctgggtgtgcaggagagagctccgcccgggaccctgcacacaccatctccatctccggcaagacggtacttggccctgctctaaggagctgatcactgctgccttcgtgaccctgagactggctttgtcttggggaagtcatttcttagaagtgtctttgtagacgtaagtcagtatagtggggtaaaggagtagagtttccatatggccattgcatgcgaatgtttttttaatgcaaatgtgttcatggtcatgggtggtacactggctagttttaaatatgagccctcagagctgcaggagaaggccacatgaatgcctccaccacagacctaggtagggtgagtttcttctcacggaagggcagcagagtggcctcctacctgtgccatgtggacacctgccgtgtgcgcagggtctgctggcctgagctgtcctcacgcaccccctcttcctgcaggatgcggtgacggtgctcctggccagaaccacggcacagctgcaggcggtggagagggaactggccgaggagcgggccaagctggagtacacggaggaggaggtcctggagatggagcgcaaggaggagcaggccgaggccatatccgagcggtaagggctagctcagcgggcaggctccggctcatgccctccctggaaaggagcatgggtgccctgtggtcagaaggctcgtgaaaactgtcaggggggagcacattttctctggggagacagccagtgtgccaggcagcatggctgtctctgaggtgcacttgctttcctcagccatgcctccatagaaggtgctgggcaatccttaggcaccactgcccagaagtcgattctggtggaaattgagtgctggtgtggacgagggcagctccccgaagtctctctcctgactctcacgtgtgcttttcaccttttccttctgtctgtcctggagtttcttgtcgagagtgggactgttgaagcactgccctctcccaggattggatacagtaaggtcccttgaagttgttggatttttttcttttttaacacctgtattgagatataatgtacctcccatgcagttcacccgtttaaagtgcacagttaggtggtttttaggactgaatgggcacagtcaattttacagcattttattttcatcacacactctctgcctgtccctagccaaatgcgctcccaggttctcctctgattccctgcaactacaaatctgccctctgtgtctatggacttgccggtctggacacttcctacaaatggggtcatgcggcgtccctttctgcttcacgtgaagcagcctattggtgaatccttggccccgtggagacctgcatgcgatagatgaatgattccggtgaatgggtgcccctggtgccctggtttgcgttcatcgtctctggaggtgctgtacatattgctgtacttccgcatttttccataaagtgcgccatctttccagggcttcctgctgcttcccagtggctttccctgagtttagtttacagaggaatttattttggggagcgatagtgcatgcagaggggaaggtgttgtgttcagggatggacaggagttgggaggggtttggggctgagtggtgcagttttctgggatcttcagtggctgccattggtgacagagaaagcccctcttaagtacagtccttcaagagccatcttccctggaaaacagaagcgcccttttactttatgagagatgcaacagtcttcaatcattggaaagaaataggttgtattgcattacctctactactgtgctctaagagtagcatgaaatacatcccgtttggtgaccatttgggcttctgcaatgtccgccttcaggagttggcaagcggactcggtggatagcggctgtagcaactgcacccagaccagccctccgtacccagagccctgttgcatgggtatcgactccatcctgggccacccatttgctgctcaggcagggccttacagccccgagaaatttcagccctcgcctcttaaggtaagtagaaaacataggagattgtccggagcccctcaccccaaatattttgccatacgtaccaggtatactgccctggaaggagaggctgtgtgcccccaaattcttcgtgagaagtgtgaggggatgggggaagatgcaccaaaggcaagcagagccgaggctcccagggaggagagccacgtggctgacctgcacacacacacgcagtggcccgggtgttgtggtgtaaaatgggcactgctgttggatttgggggccacagctaaggctgggtttactgtgagccgaggaaaagaagtgaatggcctgagatgtgtaaagggcttgaataggcaccgctgatccattcccaccttcagggacaaagaggctctggagggtttgtgagtcccataggttttggacatttgtagttcctcttccccttttgtgaaatgtagaatagtgctgtccttttgccccttctgctcatctgctcctagctgtactgtcaccctgtctttaggggagaagtctcatgtttatagtgcctgtgaggtcagggaaggcactgtcaatgctgttttgaaactttgtttccccactgttcagctcacaaaagtattttatcaccctcacgcccctgccctcacccagaagcacaaagtgaaatctgcccccagcagcttcccaagctgtgacccacagcaggttcctagttgttgttttggaccaggctgctggtcatggcccttgtccaactttctgagatctcaaaaagcagcagcccaagccagggcgagtggccgtgggagggttttttggtgtttccccttccctcaacttttagttttgaaaaagtgaaatctgcagtaaagttgctagaataatgcaacaaatacctgtacacctcacctggatcccacagttgttagttcttcagcacatttgcattctccctttctgtgtgggcatcacagatacaacaaagttagtatagcgggtgagtaggaaaaaaaaaaaaaaaagaacacaaactcccaccctcgagagggaggcgccaaaggagacgttgctatcatacgttcatgtcacagagagcaaggcggcttctggagaatgcaatggcagggaagcgggcaaacacttgtagagaggtttgcagttttagaaagggttcacatttagaaatgtaaatttatatttacattttacaaacatcaggatgataaaagggtgcaactgctacggaaaacattatggtggttcttcaaagcattaaaaatagaaccaccacaggatcccgcagtcccgcttctgggtatatctgggtgtatatccagaagggttgaaaggatcttgaagaaatatgtgcacacccatgttcatagcagcagcattattcacagtagccaaaaggtggaagcaactaaagtgtccatcatggatgagtggataaagaaaacgtggcctatccatgcaatagaatattattcaaccttaaaatggaaggaaattctgtcacgctgcaacatggatgagctttgaggactcatgctgagtgaataagccagtgtgaatatttatttggtcttcaactctttgagttgcatgttacctggcatgcaactcctaaaatccttagaatctgaaaatctgtcgcccaggctggagtgcagtggcgcgatctcggctcactgcaagctccgcctcccgggttcatgccattctcctgcctcagcctgaaaaaaatctttttatatgctaatgagttactggtggctggctaagagaatagaaaagcacaaaaagacaaataccgtcgtgaggttcctggagtagtcgaattcacaggggcagaaaatagaatggtggctgccaggagcttggatggggtgcggggatgtgttacagaacggaactggggtccattcgcccggtgcagtaaaaccaggtgtctgcacgaaggtgttttgcactggtggaaagagggcatttatttgcaggtgccaagcaaggagatttgggcagctcacatttaagactcagcctccccatgccttgcagggaagggtttttaaaggcagaggtaaatttcaggaaagcggcagtcacaggcaaaatcctaaaccaatccatggaggttacacgttgcttttggcctagaaggataggatatcttaatgtgggggcttacaggacgtagatggattcaaagattttctgattgcagttggttcaggaggcaaagctttgtctaaaaatttggggtcagcagaaaagatagttagctctgacttgtaggtgtgactccctccagacccctcaggaagagattcagaataaagagcaagggtcagagtgcagtcctcagctcccccttatctgagatctgtgccagcgggtccctttggtgggggtctgggtttctgaaagacagtcggggacatatgttaagatgtctttggtttctttttttcttttctttttttttttgagatggagtctcgctctgtcacccaggccgcagtgcagtggcgtgatctcagctcactgcaacctctgcctcttgggttcaagcaattctcatggctcagcctcccaagtagctgggattacaggcgcccaccaccatgcccagatgaatttttttttttttttttaagtagagacggggtttcatcacgttggccaggctggtctccaactcctggcctcaaatgatccacctgccttggcctcccaaagtgctgggattacgggcgtgagccaccgcacctgaccaagatgtctttagtttctctaggcaaccaaacatctccagactctaacttccttggctattgttttaggctactattaccttcttgcttatcaggttacttacttacatctcagggatagcgaggtacctggaatttcccttgaaagaaattgattttcctttatttccatgctcgggaggtctgcaggcccctaaaatggggtctctgctctatctcaggagtgggaatggggagttgtttagtggagaggacagagtctcagatttacaaggtaaagaagttctggagatctgttgcccatcagtgtgaatggacgccactgaactgtgcctgtacaaatggttaatatggtaacttttgttgcgtgtttttttcccacaatattttaaaaaacagggccctgaagggcctcactgagaaggcagtgtttgagtagagatcgtcaaggaagggagctcagagctttgtgcagaagcatgggcaggtgtgggagcagccagtgtgtgttgtggggcggtgctgaggacgaagggagtgtgttgtggggcccactcaggacccttccttttctctgagggcatgagaagctggtgggttttgagcccagtggcaacatgatctgaccgtagcttttttgttagtgctttctaaaatttattgagttgaagttcacataaagggaagcattttaaagtgtatgcatcagtggcatttggtccacagtgttgctcacccgccacctctatctagtttcatgacgtttcaatcaccccagagtaaaacccgtccccattgagcagtcactcccattcccctccccctagccacctgcagccaccaaaatctttctagctgtgtggatttacctcttccggatgtttccagaagtggaatcatatactatgtggcctttgccgcatggcttctttcactcagcacgatattttcaaggtttatttacattttagcgtgtataaacactccgttggtttttatggctgaatgctattcccttgtgtggataagaccacatcttgttgatccattgatctgtcaatggacatttggggtgtttccacatttggccagttttcctgggatgtccctggttgctgtgttgagaatagatcgaagggcagagaggtgtggaattgggaagactggtgaggcacctactgcactcatccaggcatgagataatggcgactcaggtgaaaggttgctgacaagtgctcaaaacccccttgatcttgaacacagagccagcagggatcgctcttggaccagatatggggtgtgcaaaagagatcggaagtccgggatggccctaacgttctttgcatgaacaaatggaaagttgagatccctgtgagaggaggggccagggtggggttggggagatatcagcttttccattgtggacgtgccacatgtgaaacgccagctaaaccccaagtggagaagtgaaagacatggttgttcccataagtttattgctcacattatgaaagaagccatagtcatgagtgaaccactccctaggttgataaggaaaccaacacggaagatctctttctggaagaagcagccagcctcgtgaaggagcggcccagccgccgggcccgagggtcgccttttgttcggagtggcacgattgtccgttcccagacattctcgcctggagcacgaagccagtatgtttgcagagtaagttggaatccctttgtcacctgtctggaatgttttgtcttccatcccctttgtgattttttttttctgctgttcatactgaaaggcatatgtatttgcaccaataataccaatccatgaactatgaactttataggtatgcggtgatgacattggtgttgtgatctccccgcatgtcctaccatgcttatctgattctggatttgttcaggattcaaattcatcccttcccccagttttcagtgttgtgtatgtattgacctgtggggcaggaagcagggcgaatcatttctacctcagcctaaggaacaagtggaagcaggggccctcttgaatgggttgagctggaggagccgggaacctgagtggcttggagccctgtggggcagccaggtttctgggccagagggtggatggtcctggcaaaggggcagtgggttctcactcacccacatgtaacttcccaacctgtggatgagtgggaggcgctcagcggttctcagccatggctgtgccttgcagtcaaatcatgtcgggggattcaacagatcctggtacccacatagcaccccagagatttgccattggtcacaggtaaggcctgggcgtcagaacttccggaagcacccagatggttctagcatgtcacacaaggctgagaaccccaaggtgggtagagggaagatgcgagccagtgtggtcaatgaaggtaggacagagtgatagtgccagcatggacttgtacagaaagggcttttaaggatgatggctcatgacacagtgacctggaggggccatttggttgagaaccatgacccttcctgcacctctgaattggggctgttgaagaaggcatctgccctggaggtgctcgctccatgagggcagagccaaggcagatcttcggagagggaagggcctcagaccctcaaaggagatgtggcaaacactgtgggagggggcctaggtggccaaaacagcctctcagccatgttggtgagacccgctgctgttgtcccattggtctgaagtgtccctgctggcagctgccccaggtggcgccgcgtccggtacaggccctcccacccgtcacacttcagccccgtggaggctgatgctcaagcgcttggctggacgctctagatggaaggccacgttcaccgccctccttgttccaggctcctgccgagccaccaacgtgtcggctggcggggctgcttattgaggcggggagggtgcaagcaggtagtgttttgcttactcagaggaaatgctctgtgtgcctgcgtaacagctgcacttactggcgatgcttctggatgcttcgctgttctgtatgtttgtatgaacgccgtgcaggtatgctgccaggccgctgcacttcctgaataggtttactggcgtggaaaataaggccacgaaggcagggatgttggatttcacacagattgacactgatcctgaggtgagaccctgccaccaaaatgaaggctgtaatgacttggctcccataaagatgacattctttacttcctgtttaaaagcacgccctgtcctttgatgggcacagctgcagttggcaatgttggcttgtcctactaccagaagtgagtctcttttttggaagtcactttccccagctattgccaaagccacaaatacagcacatgagaaagactgaggaaaagtgaaccgtgctgagggcagcgctagccttcatgggggctgtacagggcacaaaatggcattggtatcgatcacacagagattttgttggctcagttagcctggaaactgggggagggtttcgtttgctttgtttttgttttgttttgttttgtttttttcattttagcagaaactcttctttaaattgaaacccaaagacctgctacaagcaccaataatcataagtgcactcgagggcctgtgaagaggatgaaaagaatccattctgagactctgactacacacacacaatgaactgtgcattgctgagaaattgtttctgaacatcattcttttttgtgcagctttatcgtagtgacagcgacagttcaacgctgccccggaagtccccctttgtccgaaatactttggaaagacgaacccttcgctataagcaggtatgtgccctgtaaacaaatatggaatctgtgcttgccctgcgagtgattttacaagccttaaaaaggtaacatttaaggtcatgtaaatgaaaaggtagtatttctatttcttgtttacttaacagatgtaatgtcgtaatgttgctaatatttcttaagatagtatcatgatttcagataatctgtgatctttacattcttcagtataataaataaccatttttatataataggctgttttctctttttttgacaggagagtatatatagtttagaaaagttgagtttttcaacatgttgcttttctgggcagggatcgtttgaataatatatatatatatatatatatatatatatatatatatatatatatatatatatagtgtgtgtgtgtgtgtgtgtgtgtgtagagaggaagagagacagacacacaaaaaacccccaatttccacgtggcagttgtgctccaccacatacaagagtggctgctgactgggaagaataagaaagtttataatttgggccgggtgcagtggctcacgcctataatcccaacactttgggaggctgaggcgggcggatcacctgaggtcaggagttcgagaccagcctgtccaaaatggtgaaaccccgtctctactaaaattatgaaaattagccagacatggcagcacgtgcctgtaatctcagctactcagaaggctgaggcaggagaattgcatgaacccgggaggcagaggttgcagtgagcttacgtcatgccactgcactccagcctgggagacagagcaagactccgtctcaaaaaaaaaaaaaaaaagtgcataatttggcttcagaagtgtctctcagcagcaccactgctggcatttcagacaggctcattctttgctgtgggggctgccccgtgcactttaggatgttgagcagtgtccctgggctccacccaccagatgccagtaacaccccatcacatacacagcagttgtgacactcaaaatgtccacagacattgccagctgtcctcccgggggccagattctcctggttgagaaccatgaagctctgctgagaattcagcagtgcttttaaagaatttatatttgttaagttacaacccatatttgcatttaaattctgtgtatgtgcaaaatagcgttgtgtgtgtaaaaagcataccgtgactcaggccactgacccatggtgattggcgaatggatttgtggttttgctgcggtgactgctgtctcagggttctgtttcccattggatgggaagtactgctctcagttccgcagacaagagtcttttccctgtcagggctttcctgagcctaggtatgtttgcttacttgaggcttatatggggagggaagctttggacagcttgcatgtgtgtgtctgcgtgtttgcgtgggagtgtgtatactattttttaaacaacaagcactcatggtttataacgtactttctttccccttgtacagtggatcattaagatttttccatgtccatatatttttttcaacttgttacaatggctacattttatactggccttgtaatttatttaacgtttcctgctgttatagacttacttttttttttctgtcataaaccttaattggaccacttttgcatgtcagcagttatgcctttcagatgcaagtttgctgtagacatatatatattctcaaatggcccttcagaaagattgttccatttttgatcctgccagccccatataagagcatctgttgctgcacatttctgccaatacataggtcatcattaaagaaaaacaatttgctgttactaaccttgatactgaactagagatttacattcctcttgcccacatctgtgttttttaaccttgggcgtgcttagagaaatacgtgtgcctgacctgtctcctattaattgtggaagaaccttctagaaggcctgagtgagggctcacagctggcgtctcttgcagtcatgcaggtcttccctggctgagctcatggcccgcacctccctggacttggagctggatctccaggcgtcgagaacacggcagaggcagctgaatgaggagctctgcgccctccgtgagctgcggcagcggttggaggacgcccagctccgtggccagactgacctcccaccctgggtgcttcgggacgagcggctccgtggcctgctgcgggaggccgagcggcaggtgggggtcccctgtggccagctcccgcctgcacctcactgctccctgctccaggctctgaagggagcctcccagacacagaggtggtccctgaaataccccaccactgggctcttggagtcccttctccctctgtgggctgcgagggtggcgtctgtgtggcttctgcgtgcatctggaggctgcgggtgctggaggaggggtcacgggccctccccaccttgttgggggaacattctgggtccccagtcgctaggcctgactccagccaccccctggcctctgtctcctgggaggaattccttggggggagtgtgggtgaggtgggccttactccctcctgtcaccactcgctgactgtggttggttcttctgggctccagggttggcagtgaacttactcattcttccttaaaaaaaaaaaaaaaaaaaaaaatcaataaaatcgtcttgttggtccaacgttgctgttccagacaagacagaccaaacttgactaccgtcatgagcaggcggctgagaagatgctgaagaaggcctccaaggagatctaccagctgcgtgggcagagccacaaagagcccatccaagtgcagacctttaggtatggcggaggcgtggcaaggccggcccctcggccctgcttcctccttactgtcgtgcctttggcatggtaaaaaagtacagtgagtctgtttttgtttttcttctgagacagagtctcactctgtcacccaggctggagtgcagtggtgcgatcttgtctcactgcaccctctgccccctgggctcaagcaagtctcatgcctcaacctcccgagtagctgggattacagatgcgcactactatacccggctaatttttaaatgttagtagactgggttttgccatgttgcccaggctgatctcaaactcctgacctcaaatgatccacctgcctcagcctcccaaagtgctgagattacaggcgtgagcccctgcgtctggccgtgtgagtctgtaaaacccctgggaagttgagaacaaaacaggaatccactgcagccagtagtgtattttcatgtttttatcctgatctttttttcctacagtttttttttcatgccacttctaatcataatgcgggttcagtttggcatttagcattttttaaattaaaatattccatattgctatataatgtgctatcttgtttgactgtaatgtctcatctaatagtttactcaaccactatattttataacatgctgctcgtcttcaaatgtttgctattgtaaataacagtgatatacatacacatacatatatgtccccccacccccagacagggtctcactctgtcagccaggctggagtgtggtggctcagtcatggctcattacagccttgacctcccagggtcaagtgatcctcccacctcaccctcccaggtagctgggactgtaggcacatgccaccatgccctgctcatttttgtagagatggggtctcactgtgttgcccaggctgatctcgaactcctgagctcaagcgatccacctgcctcagctgcccaaagttctgggattacaggcatgagtcgctgcacccgaccacctttgctttttcagttaacttttgattaaggcaaaatgtatctgcaggaaagctgcgtatcatacacacatggtccagtgaattgttacaaactcgtcctaagaatcggtcattatcagtgcccccagatcccacactagagtaaccaccaccttgaattctaatagtatagattggttttgtctgtttttgtttttgctgaggggatttttacagatgcatcagtattcttttgtgtctgtaaaaaaaattaagttgaaattcacataacataaaatgacccattttaaagtgaacagttcagcctttggcgcattcacaatgttgcacaaccacccctctgtctagttccagaacatttttaccaccccaaaagtaaaccctatgcccattaagcagtcactccccgttctccctcccctagctctgtctctagggatatgcctttctgcctgtttcataggaatgggatcatatcttacgtggacttttgcatctggcttctttcctgcagctgagggttttcgaggttcatccatgtagcctatgtgccagtgtgtccttccttgttaagggcgaataaaatgtgtcttttagccctaatttttgtatacatttaatattcacatagttttcactttttcattcatttgttaatacgacaggtatttcctgagcacctaatatacaccaggcactgttctaggtactggagatgaagaaacccctgctcttacggttcttcataattaacatttggagactctatacaagcacatgtgttgttggggacttaaattcagtttgttgtatgaataagaaaagccatgattgatatgagagccaccagctttccgtgtcttcatatcagcttctgacctgtaattgtctccggtcccagggagaagatagcattcttcacaaggccaaggatcaacatacctcctctcccagccgacgacgtctgatggagtgcattgtgcacatgaagtatttatccacctgttttattttcatgaagttcttagactagctgaatttgtctttaaaatatttgtgcaaagctattaatatacacattttgtaaaaaaaaaaaaaaaacacgtatatctatacatatatattttataatagtgacggcaacagggcttggtttttccttgttgtgaaatcgacatctctgaagacaggttattttataaaagatcaactatcatgttaagaatgtacagtttttatgctgttttatttgacttaaaggctggaagacagaaacgaagtgagttcaggcaaattcactgtattgtaatttatttatagtacttttttttccttgaaggaaaatactgactttaagatgtattttaagactgaaattttgttctttagtacttttcatgcagtagaacggaacttggggctggtttggtttttgacacctgaaatgcgaacgctatgtgctaaatttgtcaccgtatcatatgtgcatttaccatgtatattgtacacattcactcccttgatgtcatgttaaaatgtcccctgcagtggttcaatcgtgactcggaagcatgtgtgtgttgcagaggtcagtctctggcgtgggccgcacgccaaccgctcatttctgtgttgcctttggaagcatctttctgtgctcagcgtgagtctgaagcaggcgccagggcctctggtgtacggggcttcagcctgcttgcttgtggtggctgtctgtggggcttcagcctgactgtccgtggtggctgtccatgctgcccgcctccccccaccccgccctgtccgactgtaacagaccaggagggtggcggaggaactcctgccacgccactgtgtcatgaaggaaagtgaaagggaacgaggaagtaggaatgcccacgctcgttgactccgtgggtgaatacagcagttaggacatacacaccatcacctttgaaagtgcttgtttgggggagggaaggacatacgggtaactagaactacccagcgagtcgtccagaggagaggatcaggtttgagtcaggaggctccctgtactggagtcgtcccactattcctcaagaaatcttagaaccagcttgtgaggaaaaacattttttaatgtaataaaaatatgccattattctttgaaatgccaaatgatataaatattttgcctaatacatatttattgtagatgaaatgcactcttctcgatgaggcctcgatttgaatcaatggggtgggccacaggaaatgtcagaggaaccagaactcagaactcttcctcctggacctttcttcccttcccttggaggtatccctttgaatcaggcctctctcttctcatcagtctgtagcttccccccttgtataacctgctttcctttttacatttattaaaagtggattttgtaaaagcatttcattgacacgcgacctatcacagacaatggaattcgtcagtggtggtaagactgaaatcctgatgcttttcacacttcttgtctcttgctatgtatttctgcctctagccttgccatgttttgccttttttttttctttttggccaattcctttttatatgtgcccacaacagaggtggggagacacggagcaccctgggtccttcccagcgctgctgggcaggccccgtctccaggccccagctgttgaaactttgaagggcaacaaacaaccatccacactgccggaccctaggctgttcagggaggcagctcatttccaccccggccccaggacacccagcctgtgccccacaaggatctctctaaatgggagggattgaggctacttttctgccaagccctattaagtagtaatgtggggaaacccactgtgtcagtgcaggaagccctagacaaatgttttcaaataaatttcactgcccagcctgcacagatttccatttgaagtacttcccatccaccctgacacccaaaggggtttttttgttttgttttgtttttgagacagggtcttgctttgttgcccaggctggagtgcagtgacgtggtcatagctcactgcagcctcaacctcctgggctcaagtgaccctcctgcctcagcctcccaaagttctgagatgataggcatgagccattgtgcctagcctattttgatttttttcttagagtcaaggtcttgctctgttgcccaggctgatcttggacttgcgagccaccatgcctggctgggttttttaaaaatagaatctcactgatagcctgcaagaaacagatgcagtgcctgcttccgtatcagtccaaggagccctcgtgtttgccacctttacctttgaacctccccctgcctccctgcctgtgtccgcttttgcagctcaatgcagccatgacaaggaaagaaaagacaaaggaaggccagagagccgcgcagttctctgcaggtgcagatgcaggcagtggaggtggcctgagcaggcagaaggacaccaagcgccctatgttgcttgtcattcatgacgtggtcttggagcttctgactagttcagactgccacgccaaccccagaaaataccccacatgccagaaaagtgaagtcctaggtgtttccatctatgtttcaatctgtccatctaccaggcctcgcgataaaaacaaaacaaaaaaacgctgccaggttttagaagcagttctggtctcaaaaccatcaggatcctgccaccagggttcttttgaaatagtaccacatgtaaaagggaatttggctttcacttcatctaatcactgaattgtcaggctttgattgataattgtagaaataagtagccttctgttgtgggaataagttataatcagtattcatctctttgttttttgtcactcttttctctctaattgtgtcatttgtactgtttgaaaaatatttcttctataaaattaaactaacctgccttaagaacaga

SEQ ID NO: 2983 - DNA, 78159 bp, human
gacctttgccgattgtgttggggacgaacttcctttaggatgggaaaccgtatatgataaacaaattggagtttattacatggaccacataaatagtaagtagtgtgcaaaatctgtggcattatatcaaagatgccaaaaactttttgtagagtttaacaatcgttaccttccaatgcagcattaaattgggttttataaatgtaatgcgaagtttccattagctcagttcttcacaaagtgaagcagttctgtagctgtaccttgcttgtgtcttgctagggactgcatataatatgtttaatggagggttttaataactattacaaggaataaatttcccaggcagtctggaaatagagatacctctcataatgaaaaaattatttgttgcagagtggaactgacaagttattggaataagtgcccaagtgattatgttcacttcatttcgtcttatacatttaactttagctttcatacaccaaaccttttcggggggtgtgtgtgtgtgtgtgtgtgtgtgtgtgtaatggtatagagaccatagcaaaaacaatgggtctttgaccatgccagcctcctttgtagaactgtctagagcagtgcttctcatcctgggtgattttatccctcagggacacttggcattgtctggaagcattttcagtggctgtgcctgggagaggtgctgctggcattcagtgggtgtagaccagggatgctgcttaacaccctacaatgcacaggacagccccccctcaccagataatgaggcgatcccaaatgtcaatggtgccaggatataggaaccctgttctagatctgttctttgccccttaatcttggctgtctcttcgtcagctttcttcgatggggtcccagctgggaatccatttttcactctctctcattttcattctggcttccctcagtggctctgtcattgtcatttcactaccaggatatgaagcatggcttccccttggcttactttctgtcctttggttggtgaagtgcggggcggctgcagggtctgaaggtgcatggtgccccccacctgagtgattttgaggcacttttctagtccagtgccatgactcctcatgtccccactgtgcagtcaactcagattggtgtcttcagggctgattcctacattgtcagttgctggcacccaagatctgagtcccccatctcagatctcggggcagtggggtttttggtgcctggcactcgtccttgggcacgattgcagctcttatccagagattgagcagtggtgattggagacaggggatacctaccgttatggccctgctgccctcccaggcaggtccgggtggcaggaggacttctaggtggacccactgctttttggacagggaaagtacctggcagaagagaagctgagaggccccagtggctctctgccagcctggcacttcacggctgtgtgtgtttgggtaaatgtggccttttgagctaggcttcccagctgatagtctaagcggcagctggtaacacgtaagagctgctcacttcacagggccaccatgctgtggacctgggcacatgcccgtggcttcgttaacacgcttcgtccttcccagggcttggtggtacggatgccccacgcccactgaatctcatctctgagacaagagcaggactctgattttgcatttgttttggtttgtaaatctcctcctgtgagcttttatggcttggagaggctttctaggaggggctttctaggatggtgtgaaaaggggtgagcaaaggatattgacaggagagcagacagggaaggcatttccaaggagaacttacctggaaacattctagcaagcacaccgtgtgtgtgtgtgtgtgtgtgtgtgtgtgtgtgtgtgtcaaaacagacataatgtaaaatttaccattttaaccattttgaggtgtacttcacggaacgtaaaacgaaccatttttaaagtgaatagtttggtagcatttggtgcatttgcagtcttgcacagccatcacctctatcttgttccagaacattttcctcaccccaaagggaaatctcatctccattaagcagtcattccccattccccttcccctatgtcccggtgacccctagtctgctttcggtctctgtggagtctcctgttctgggtatttcatagacatggaatcagatgctatgtggccttttgtgcccggcatctttcacttagctgttttttgagtttcttccatgtcatagcgagcatcagaactttattcctttttatggaattttattcctttgtatatggtttatacaaaccactctgttgtatgcactaagtgaaaggtcctgagagtataaaggtgactgaggctgtgcccctgccatctagaggccatagtttagatgggaaacagaaaagatataaaaacactcatgtgctcagtgttaagggggaagaagggcagcccgcgtaagcaggggagagacgcatgtgcctagaggatcagagaaggcttcagaagaaaaggtgcctttgcagcgtgcctgggaagacggcaggccttcctgtgacagaagaggtctgagtcagcatggcaaaggcaccggggggccagccaagcatatttggggacttcgcagaagttcagtctgtgtagacaatgtttttggggaaaaagacggaaaatagagatgaggctgataagtgagttttgggactcctgtatcaggctaaggagattggactttgtgctttcaaagaggtttctgtgtgaaagcattgcatcccagttaggaaggtcactttggagagtgccctgaggatgggttttggtgggatgagaccagaaggcccagagagtctgactgaagtaaggagagacagagacaagggcgtgtcgccagtgatgatcatatccaggggcaggaacctccagttcttcataacccaccgaatgtttcgggaggaagaggagtgggattctttgaggatgagtcccaggttgcactcccaggctggctccgcagttagatccagatgatgcggctccccacaaggggaagacaggagattgcggaagacaggagaagcaggcgtgtgctgtgtgatgtttcgtttggttttgctcttggtggtgaaaggtggtgtggagaatgagggctgctttggatgaatggctgggaatgactttgggtccatccatgtggaggtgcatccaggaggcaggggggaatgaaagtttggagccggggagagaggctggagctggagttaggcacaggcccttggagagctggacggggaggaagcaggagtgcacatgagggaagctatggtgggaggagacaaggaagtcggtgaggaatgggaaaagactacacagtctagtctggaaaatgaaaggagaagggggctagccaggccaggggcacagaagagtttccatcatctcacacagaaggagtcaatgaggagaaggtcataaatagcaattagtgtcacagttctgagctcttgtgggttcatctcctcccatgcttatttagagtgtggtctttgttggtaaaaacattgtcttgtattgtcttccctcctccaatggactgtttcatatctgtagagtttccttctcatctgcactgtggatataaaaatggaaactgttccacattttggaaaggtttgtgatataaaatcttccataatatgcatcctggtaactaattaattttcacattgatgagtgacatcactgcatgactcttggtcaacctaaggattttacttttaagtcacttatgtttttacctttttaaatttcagaacttacccagattgaggatccaagagaacagtggaggcgagagcaagagcgcatgttgaaggaatatttaattgtagctcaggaggctctcaatgccaagaaagaaatctaccagattaagcagcagcggttcgagctggcccaggaggaataccagcagctgcacaaaatgtgtgaggatgacagccgctcgtacgccagctgtgagttgacttatctcctgttaaaagccattgtgactttaaaagccatctctctgctaggttacctgcaaacactgaaccttccctgggcaagatagcttcataaaggttctaatcgcatactgttaggtcatcagtatttggcactgaaatcaggtgggcacctggcagccactcctgtagcaaggatttatcaaatgcttactttgtgcccagacactgggttatggttggtggtgactaagaaaggaaaggtctctgcccttgagctcacattcaggtggggaaggtaaaaaataaacaagaaaacaaaatttcaggtagggatgtgtaccagctgcctgtctcatgcatgtcagttttgaagagggcttccctcagaaatctctgcagttaacactgcttgtctgggatgatctcttgggaaatccacacagtggcttcattcattctgagtgggaagactcaggagacctcagccatgtcaagccccctgtctctttgtagagttctcctcttgggctgtaggctttagtacgcagtacagggaaggaggaggaacaccatagaacccagagaatcggaggactctccttctgcccctcaggtgagatgaccatgtacagcttgctgttctctaaagggacctctctctagttttggaggctgccagagtggggggcttcatttcattagtactcagcaagtgcttggtgttgaagaaaccaggtccactctcagaacccaaagcattttgctgtggacacggtcagtcaccacatgagccagttccttcccagcagactttcaccctcaacagaccccaacagatgtgcatgactgtgactggcctgggcactcgtgagcttggaaagaatggatgaaagttggtaccactgggttgaattttataaaaacctgtctgtttgagacttggggcctttcctgtgatattagtgccatgttgccatggcagatattaaacacacagctatagctttattctgtgttgcaagtcagaatggaggtaaggctaaggggccacacgttttgtgctctgttttattgcggcaactgttgacggggcagaagccttagaagctatggccaggagtggggtattccctctgcaataggaattgaagatatttctatttccgtgtgtcttgagggaaacagggaactcagttttactgatgtgttgcttccaagccatcttatctccatctctgcagatagtggcacatacctggttggtttttttgagggctttgttttgtttttaacttcccatcagattgtgataggtcagctatgtgtggagttttagaggctggtttcttatcttcacagtcatcttttcttggaatatctttctctgattttggtatgagggtaatatactggcctcatagaatgaattgggaaatgttccttcctcttctgttttctcaaagagtttgtgtaggattggtattagtgctttcttaactatttcatagaattcaccaaaagagccacctggacctggagttctttgtggaatgtttttaactacaaatccaatacttttaatagagaggtatccagattttttgtttcttcttgaatcagttttggcatttgtgtttttcagagaattgtcttatttcatctaatctaaaagtcggcaaacttttctatgaagagtcagatagtaaacattttagactttgtcgaccatatgatctcagtgccaacgattctaccctgtagttatattgcaaaagcatccagaaacaacatgtagacagatgtgcctagctatgttccagtagaagtatcaaaacaggtagcaacctagatttggcccacagggagtttgctgcccagtgatctaagctgtcaagtctatgaagttgtttgtagaattcccttattagccttttaatgtctgtaggctttgaagtgatgtcctctctttaattgctgatattaataatttgtgtcttcttaatcagtatagctaaacttttattgatttttatctatctttacaatacactggcttttgccctgttctcccatttcttgtctgtttctatcttactggtttttcttctttattatttctttccttctacttagtttggctttaatttgttcttccttttctagcttcctaaagtggaaatttagatcactggttttagatctttcttacttcctcatatagccattaaagataaggattctcctctaagtactactttaactgcatctcataaattttgatatgctgtattttctttcagttcaaaataatttctcctttttttttggtggtttttgacccatgggttgtttagaagtaagtcagcaggactttttaaagatgtcatgttgttgttgatttctaacttagttccattgtggtcagagactatgtaacatttcagtcttttgaaatctattgagattacttttatggcctagaatactggttttttttttttttgagatggagtcttgctctgtcgcccaggctggagtgcagtggcacgatcttggctcactggctcactgcaacctccacctcccgggttcaagcgattctcctgcctaagcctcctgaggagctgggactacaggtgtccgccaccatgcccagataatttttgtatttttagtagacacgggattttgccatgttggccaggctggtgtggaactcctgacctcaggtgatccacctgcctcggcctcccaaagtgctgggattataggtgtgagccaccgtgcctggccagtctttttgatgaccagaagcccatgggcttggtgccttgatgtctccctagctgaagcattggcctataacctgttctgagattatatagttagcaattctaaacatttcagaaagctgcttggtagaagttgggttgaatggtataaaattgctgtttttgtatctagaaaagggctgaatattggctattcttataatccaacctaatagtgtgtttctttccagcagtctttgggtaccttatcttttacatgcttgcgtttggttaggtctccaaagaggctctcaaatcagtctttcaaagaatgaaatggaagaaatacatatcagaaaaacttggcaggatgtttcttgccagtgattgaaaagaaaaattgagaccaggtacagtggcttacacctgtaatcccaacactttgggaggccgaggcaggaggatcacttgagaccgggaattcaaaaccagcctgggcaacctagcaggaccctgtctctattaaaaaagaaagaaagaaaaactgagtctagagaaagtgtgtattatgtactggctaccaccagtgcagccaggatgtcagctgcagtgactgtggggaccctggactggatgccctcaatgatgcagacattagaacatcctgtctgattccacacccactctgaggggcagtgaacggggaaccccaatgcagtgccaagctgtaggttaagagtattcagtacttcagcatcctgagttgctaaggatcctgcaggatcaggttttgtatttccatgggcttttcacttctttgatgtttgggcaaatagggaattctactcaattacatttctttttgtgccctatgggattttattaatgctcgtttaaaaagatacactcaagaggctctttttgaagtggtatctgttccttcagtagaggaagctgatgactctgttgttgacttgaggttctaaggtgctcaccagattccatttcctgacctgctggatgtctctgtgtggatacgatctctccctccacttgtgtaggttgccttcgaggccaaaagtgggcctgcctgttttcgtgaaagggctggagatgccagtgggtcttcctggggcctgtcagctcatcagggaaaaagccaactctgaacggaatctaggagttgatccaagtgttttatcaacttgctgctgtccctagggctcccaccaagctctctcaatctgccatttaacccgaactaccaggtacaacaaggaaaaccctgctagagtggactcagatgaattctttctggccacaggataaagtccaatgcagtgattttgttggcttgaccatgatctaacagatggcttctacagccatgccagagggcctgggcccatgttgggagctgctggtggcagtttccatagcacacgttggctgtgtagccacacgggtctcactgcccagatctccctcagtgccagtcatctaaagcaggaggcgtctcctttttctgatactgtgaacagaataacatctggacttaattcccacttctttcttcatgggtaatgacttgaagtgaaaggaaccgatatccaatgagctggtgttttctgtgcattgttgtgatcacagtgttgtcaagcacgtgctgttttctttattgttcacatgagaaactgaatatcagggaggctaaattatttcttcaggattacatacccagcagatggtagaagttggatttaagcccagatctgtttgtgttggtggccttcagtgctctgtacggtttcctagacatggaagaggccactcagaacagctgatggtgtttgtggaacccctcccccatccaactttcaggttatctgaaaataaagactagttataaattgacaagttgtcgggaaattttgcagcaataaagggggcaagtggaaggcagagcactttctagatcttgacttttccatggcccatgtaagatcactaaactgttcatttatttttcgacagttagcacctgctgttgatatatactaaatggcgggaacatgttttttttgttgtttgtttgttttgttttgttttgtttttcgagacggagtctcgctctgtccccaagctggagtgcagtggcgcgatcttggctcactgcagcctctgtgtcccgggttaaagcaattctcctgcctcagcctcctgagcagctgggactactggcgcatgccaccatgcccagctaatttttgtatttttagtaacagggtttcaccatgttggccaggatggtccctatctcttgacctcgtgatctgcctgcctcagcctcccaaagtgctgggattacaggcgtgagccactgcgcccagccgggaacacgttttattcctaatggttgcttgttgggaaagatgaggcaataatgtgtgaacagaggaattaactggaacagccatttctaatgtgggagcagaaggtagggaggagaagtgcatctcacctatacccctcacacatttccctcgagctatggaaatcaccagaagaaaacttcatgcattggagaggaaagattttgtgtcagtattgggccatctggtatctaagaacatccgtgccttgacctgaaagcaaattcagatatttggctggatgctttgcacacttgtctgcatgagagtaggaacccaaccctgcttgatttcaatgagcttctgtgctagctgcctggtgatgcccaggcctcatttatgcttcgtagaacactggggtgaaactgctcaacaatggactcattctctctgagacacacctgctactttttctacagctccattttgtagagttttcttctactttctttattgcaacatgttcttctatttgcctgccttttaacactgaatacgttcattatctcagacacattttttcctggagttattcctttattcttcctgagaaactctagccccaggcacattcagatgaactatatatgaccatttgcaggatcttttggaagaaattcttgcatggggtaggataatagtctaaacctcaggtctgcaaactatgtcaagcctgtgggctggatcctatccactgtgggtgtttgtaaataaagttttattggaacacagccatgtccatttagtaacctatcgtctgtagcagctacagtggcagaattgagtatttgagacagattgtatggcccacaaagtcaaaaatatttagggtctggcccattagagaaaaagtttgctaattcctggtctatacccatagttctcagacctggctgcaagctagaatctttaaaaacttgctgcttggacctcaccccaagagattttgatagaactggccttgggtgggaccaggcttttttttttaagcttcccaggtgatccccagggttgaaatccactgggctagacagagtgtgaatggcccttgtagcagcaggaatatgactttgtttattatcctagttcctaggagttactcaaagtctacattgaaagtctttctgggtggctaggaaagaggcagcgttatctctggtgagaaagtgctgatccaccctgagttcttggattaggtggtggtgaagcttgaccttatcagccatcagccttgccagcattccttctgaggctccaagcctgtctcacaatgactcttccattggtgctctgtttttttttttttgtttttttgtttttttgttgttgttgttgttgagacaggatcttgctctgttgcccaggctggagtgtggtagtgtgatcttggctcactgcagcctcaacctcccgggctcaggcgattctcctacctcagcctcttgagtagctgaaactccagatgtgcgccaccatacctagctaattttggtactttttgtagagatggggttttgccatgttgcccaggctggtctcagactcctggactcaagagatctgcccgcctctacctcccaaagtgctgggattacagatatgagccaccgcacccggcctcattggggctctcgctgttgaaggatttctcatttgctgtctttggttaggaacagggctacaggcaatccattccaattcaaccttttgttttccttcacacacgcatgttggagcaggcaggagaaaaaaggatcatggagcatttttcccatgtattagtcagcaagccagattttggaggttgcagcaaagcacatgtgtttcctgagaaataatcccctagtctgtcctggagggagaattcctggttaggatttggtggcttcttgggttacttctgtagatcacccccaggtggccttacttgattgtttttggtcttttgcttatattgccttaaaaaaaacccatcctgcccgctttgttggccttgcgtatttctccatgtgcctctctggtagatagtacctgtcaacctggaacctgtcagggcttgtcggccttttgcccagagtcattcttggctcccttgagcaactcctgacagtgctgatccctggaggcctacacctggtcctaaggagcaacctgctccagaggatgtctttgaagaaggactgctggtcttttaaagcatgtcttgtctctggggtgaccttaggtacccatagctcagaagacgcctgtacataagagagacaaagacaaacagactcatggacacacacatttcccctttcagtaatctgtcaaactgaaatccagagttaagtactggggtttgcagcattttgagtcctaaatacacaggtcaagttcacctgttgggtggtgggcactggggagctggaggaccgtttcttcttctgggaaagctagcccaattaaaggatctttggcagctgacccaccggagcccagattctagacatgaagccctctatgaatgatggcataatgtattatagatcaagtcactacagactcagtcttttaatctataaaatgggcaaggacacataagtatcatttcaccttcacaaagattttatgagaatagattaaataaatgtgaaaggcaccctgtaatagcaaggtataataatttacattgctgtggtccagctaggctataaccttgttattatattatctgaggcaatgttgtatgcctgagcagactccatatgctatttaatagctctgcccacttaactcttcaagagagaagaaagcttcagaggtgaaagtctggtctttagcataaacctcgagattggagacatgtcttaatagaggaagatactccgtttataaatgttgtggaaggccgggcacggtggctcactcctgtaatcccagcactttgggaggctgaggcaggtggatcacttgaggtctggagttccagaccagtctggccaacgtggcaaaaccccatctctactaaaaatacaaaaaattagccgggtgtggtggcggcgcctgtaatcccagctacttgggaggctgaggcaggaggatcgcttgaacccaggaggtggagtttgcagtgagctgagatcacaccactgtgctctggtttgggtgacagagtgagaccctgtctccaaaagaaaagaagtgttgtgtagtacacgctattatgaggtctggagtcctgatctgttcttggactctgtaaatggttctagtagtcttattggcagatctgaggaactgagaattttatttataaatttaattacattattaaaagttatgccagtgttcacaaccatccttagtatttgaagataaaatgtattcactgtgttagttacttgagtagacttttcccttatcccagtcctggaattttataattttatagagaccatagcaaaagtaacatgaatgggatccacataattaaaaggtattctgtcacttatgatggtttcagctgcagcagagaagaataattctcatgggcctagacaataagaaaattcattgtcacatagcggagtcctctggaggtggggtgggattccccataggtggattcagtgactcagtggagtcattggtttgtcagtttccccctctaggagtggatacatgctgagtctcttggggagaggtagctacccaacacttccggggttctggtacttaggaaggagaaatgggggaaggttgccgtgtagatgtccaacagtatccaagacacctcccctgcgtatttcaagtctctttgctaattttccttatgaaactgcatagacagaggaagattggtacagatttttttttttttttttttgagacagagtcttgctctgtcgccaggctggagtgcagtggcgtgatctcggctcactgcaacctccgcctcctgggttcaagcaatcctcctgcctcagcctccttgagtagctgggattacaggcacctgccaccacacccagctaatttttgtaattttagtagagatggggtttcaccattttggccaggatggtctcgatctcttgacctcgtaatccgcctggctcggcctcccaaagtgctggaattagaggcgtgagccacggcgcctgaccggtactaatgtttagcattgcagtgaactttgttgaactttggtggtaggcttactttctacccttaatgggaaagatcccaggtgataactcttgggcttgtgttcctcccactgcaagttgacaagttgacacatgtgttgtagtgttgtaagccaggattcagcaagccctaacctcatagcctcatttgcatattatctctatcccaagtgaaagaaggcctttaagctcagatctgggaaacttaaagtcccaggagtttaatatggagatgttttctataagttatttctgccttttaaggacattgttggagatgttgctttcattactgattttaaatgaaaccaaagagtcaggcaagatggaagatgtaggatttggaaataggcagtcttgtctaagaaagaattgtttgtaaaatattttactccatgtctttgagagatcatgagtctaagtataagaaaattggagataaagttggcaaacatttagctcttccagttgtttatttccagtagattctgttgtttgaaattctgactgaatgggacttaaatagtagattttccatagaactgttattaaaataggagatccaactgctcaagtgaactttggatgtggttctaattgaggtttgaagtaattgtgctgttgaagctactcaatggtgttgagccatcctctgcagtacatagtccacaaatgattttgaattggtttctcattgttggcacctgagttatctgaatgacagccagcctttgattctcagatcaaaggcgttaaagaaaggactccgtccctgcagatgtgtcttctgagcaggtgatgttaatgacaatagctgggaggcagagggcaccagagtggggtggttcacagatgaagacagaccagcattccactagctaagcagaagaagggaagccatgcagcagtggtatagagcccatgccttcagaaacctaaagaaaggaggcagaagcatcaagaaaaagcaccgcagagcggtggatggggtggtagaaattaggaatagccactcgctgctccagcttccgtaacactggaaaaagcttgcagctctctgtgtgcacagaaatttgctgactgtgcctagcgtgtaaacagctctgtggctcttactcatccctaggtattggttactcacgataatgatgccatgtctgtaaaaagactttaaatcatatacactgcactgtttaggaaagcattgaggtatgtgatgtcttttagctaaacattcatcaaaacaaattattagagtaaaagcacgagtgcctcacttcagtttctgggacaaacaacttgggggcccatcttttttctcaagcctgccagatcctgacgtattactagaaatcttttttattttacaaatttctaatgtttttttcctttcttgtgtcaaaaattgttcatccggagaatataagtgtgaagaaaataaaaataaaatcatttttaatgcagccattgagaataactgcagttaactttttggttctatctttccagtgacgtctgtgtgtgtgtgttttaaaagaaagtaaaagtaggttcatactgcaagtactattcacgtattaagtacagtttcctatgtcataatcacacctcttccccctcaccccgtacccccgctgtgtctatatggtgtttaactgtagtagttttatagtagaactaaacagagttttgattgacctacagccatgtattttattatatgggatcctatagaaagtcctgatgcaaatatcaaacatcaggaagatttgaggatgttaaatgtcaattctttaggagccagtgaccacttgtaaatcagagatttagagtcctttaatgcagtaaatcagaagttccttgtgtgtatgtattttgaaggatccattataaaataaaatattttctttctatttagcattctctggatattcaacaaatacaaagtatgacccacaccaaattaaagcagaaatagcaagtcgtcgggatagggtgagtaaaaccgctgtttttacaaccaggtggacggaagcctggggccttatagcctaggccgctggtgttctactctggttgactcctcctggagggatcgctagcagtgttagactggaagagttctgagggttctgatgctcttccctggtgacccctgaattatctatgtgctaccatgtttcgtctcttcagacccttgtcttggttgtctgggaagggaaacacttttgttgcatttgggacaaagcacaagaaacatcttggcaatgaagcctgctcctctcttggtgtgtcattccctgaatcagggtgtatcttttagtgcagtggttctcaaattttagcacagctaagaaaaatacctgggagcttgttccaagtgcgagcttccaggcctagcccctgagttttgacgtgggcctggagcgggtcccagaatctgtttaaagaagcactccaggagccattgagtttcaggtagtcagagagctcgcttctggacacaaagtttcatgtgcggggtctgagaggagtgggtagaaggaaagatgaagaatgcgttacagaagttgccagctgtaatgtggaaaccttgaaaatgcaaatagttgctggttccccacttgcgtaagagtctgtcaacaatctgggatttttgtatctaagcacagcaggtcttctagaaaggctgcttcttatgcatgtgaatggaagtttgtagtgagaatagatgatcttatgaactgcaagctgagtagaaactcagatgacagtgctaataacaactgtagaaatcattcttcacagctggtttttgggaaaaaaaatgtgatttgtctttagctttccagattaaaacgagagctgacccagatgaagcaggaactgcagtacaaagaaaagggggtggagaccctgcaagagtgagttgcctggacacttgtcccaaagcttcatgcccttcactttcatgcctttatttatgctcatgattttccaatgctaacttcagaatctctcttttccttgaagatatttcgttgctttaaatggaaatacttgggaaacaagacctttatttttatgtttatgcacgtttactatagctgtgcaagacactcatggctagttacatttaaatttgactttttcttagttttagtcttttaaattttttgttctaaaattgacatttaaagtaaaagaaaattaaaagtttagtttcccagtctcagtagtcacatcagaagtactcagtagtgacatgtggctagtgcaggttttctccaccacttagcactagtgggatttggggctggatcattcttgtcttggggggactatcctatgcactgtagaattgtcttgtcttggccaggcctggtggctcacgcctgtaatcccaacactttgggaggccaaggcgggcagatcacctgaggtcaggagttcaagaccagcctggccaacatggtgaaaccccatctctactaaaaagacaaacattagccaggcgtggtggtgcatgcctgtaatcccagctactcgggaggctgaggcacaagaatcgcttggcgggcacctgtcatcccagctattcgggaggctgaggcagggagaatcgcttgaacctgggaggccgaagttgcagtgagccgagattgcgccattgcactccagcttgggcgacagagcgagactgtctctcaaaaacaaacaaacaaacaaaaacacaaagaatgttgtctttactctttacccgctagatgccagtagcaccttccacctgtattgtgacaaccaataatgtttctagacattgccaagtgtcccctaaagtacacatttgctcccagtggagaaccaccgtgctggtggctactgtattgaacaccataggtgacagatttccatcatcacggaaagctcctttggacattccagtctgtaggtcttcctcctgttctcatttttacaataagaacgttatccctactaagagattggggatgaattgtttacaattagtgagctgtatcgagtctgcaggtttcatgaactaaaggtggtgtttgagaaatggtgctggtgtgggtctgaaggtttgctgagccgttctctccattcactggctttccttgctgaacttgcgcatgtgccgcacgccttctgcacctacttttctcatctgcaaatggtgattgttttaggcagctcgggctgctatgacaaataccatagactgggtgacttgaatagcagatatttgtttctcacagttctggaggctggaggtccaatatttggttcctggtgagggcccgattcctgatatgcagatgaccatcttgtcgcagtttcctctcatggctaagagagcaaaaactctgttctctcttccttttcctaatcccatcatggggtcccaccctgtgacctcatctaaccctaatcacctcccaaaggccccaccttcaaatgccatcacattagagggtaaggctgcaacataagaatttggaggacacacaaacacacagtccataacagcaatcactgtgctcagttatactgaggacagcaccagcacctggtacatgcccagcccgaaacaattagtccaactctgtgtggttactgttactgacgcaggtgggcaccatgttgccgtctttcatcctgcatgcagatgcatgaggtgacacacgtgactgcagcactgctctttatggggaggtaataaaggaatgtgaggtacagatgtaattatctaccattacccagctatgtgtttgtgtgcattttggatctacagtcagagcttccttttattaaccctagttagtattagcacagcttcttctttagctttttttttttttttttttaagacagagtcttgctctcgtcgcccaggctggagtgcagtggtgtgatcttggctcactgcaacctccccctcccaggttcaagtgattctcgtgcctcagtctccccagtaactgggattacaggtgcccgccaccacgcctggctaatttttgtattttagtagagatggggttttgccacatttgccaggctggtttccaactcctgacctcaggcgatctgcccgcctcggcctcccagagtgctgggattacaggcatgagccaccgttcccggcctcttctttagttttgtcttaagcaaatcaagcttcttttccaactaaccggctgctggttttgtcattcatgcggtgcataggccagagtgctttccaaatgcaccgacgtgtgttttgtccttttagccccccactccagccagcctccagatactccaacacctcctcagatgcgactgtgtgtgctgtggcagtgtcatcctgtgtcactttggctaaggtggtggataaagaataagcagaaacaaatcatttgatttgtgacaggtcaccaaaagttattaggactacctagttggatttgaggtgaattttctaccttcattaggccacactgtagctgtctctcattgtgatacagtgtctctggacaatatgtagttgtttgtttttttttggtttttttttgagatggggagtctttgtcacccaggctggagtgcagtggtgcaatcttggctcgctgtaacctccatttcctgggttcaagcagttctcctgtcttagcctcccaagtagctgggattacaggcacacgccaccatgcccagctaatttttatatttttagtagagaccgggtttcaccatgttggtcaggctggtctcgaactcctgacctcaggtgatccgcctgcctcagcctcccaaagtgctgggattacaggcatgagccaccacgcccggcccagtaggtggttttaatgttagtcattgtgtgtgccggaggttgcagttaatgtcattctcatttgcagctctgaggaaggtgactggggttcaggaagagtctgagtttgctcaggatccctgagcatcagcagggagccacgtctggcacttccctcatggccatggtttctgtagtgggttgctgggctcagcgcccgttgctttgccttggctccatcgttctggtgaactccatttccttatttgaagacaaaggccatatagcagtgtcagctgtagatggactgatttagaaactgaaacgtactgctgactgagaaaacccccttctccttagcatggctaggatgtgaattcatcttttgtagttgcagtggtttcaagaataggaaaaggcagcctctgtttccctaggggcattagacagagaagcaggagccagaataacgagaattttaacttaacacctgcggccaaaacggagcgcaagttgtgctcctggaagagaggcgggccagtgctgtttggattgtctttctgctttcattatcaagatcccacgcttgggaacagcaattgtaaacttgccacttgccaaggggaggctcctcctgtctgcctgagctcatgagaatacccgccctccccctggaggccaaggagtggcctggggaaggctctggacctggccttggtcctgaggggcccaccccacctcatgcctgaccaggggcaagttagctttcaggagggagctgcccagagctgttgtttaatgggcacgttgccttggctctgtctgacgctgcgttgttactgtgcatgtttactttattctgggacagacacagcctcacaggaagaagagaaaacccaggcacccgtgccactcttaaaatatttttgtaagtggaagataatctggtagcctttctctgagttccacagcttatgagatgaaaacagcctcattatttttctggtattgaacattgggtgtttaggtttggattgaatcatgcaaatgtatatttttttaattgagaaattttagaaggccttttcaagcattgaaaatgtgattaccccatctctactgggaaatcctgactatacgtacagatagcaggtgagctgttatacctaaacatgaagcatctctgattttatcaccaacattgcttaaggcagtggcctgagattttcctccagaaaatttcctgctgttcttgcttcccagaatatccagtgtattcttttccagagcacctcactaggagtttggctgcttataacattttaagcttgccttgtttatcttggtgaatttcctggctagcaaggaaattcatcattacacttgggtccaagtaaggaaaaaagaaccttttgtattttactttaaatctatatatgttgttgattgttgtagagaggaattggccacagatatgttcgctgggttaatgatagaatatgtacacagatgtgtgttttatgtgtatctatgtgaagtgtacacatgtaagcttttaatgatggaaaatatcaaacacaaaagcagagagaatagtatactgaaaccttcctgtacccctcaccccatttaacctgcacaattgccaatcttgtttcggtggtgaccccaccccatctgctaagctctcacggccttattgaagcaaatgccagaatcccatttaatccataaatatgtctcctaaagttatggactccttttgaaaataactctaatccctgtaccccatttactaggcatcttgtgtccagtgagctcttgcatttcttcaggtgtttgggtccagtttgggccacagagtgcctttggttgatgtgtctcttacgtcttttcttttctactctccctcctttttttcccctgacagcttatttgttggagaaagtaatttggttgtcctatagaatttccctaatgttgggttttgctgctgaaattcacatgatgtcattgaacgtgttcctctgtctcttgttatttatgcaaatgggcgtaatagtttgagaggcttgatctgattcaagttggatttcttttctttttttagtaagaatgtttttaggtggtggtgttacttccatcaggaggcaccactctgtgcttgtttctttttgcggtgtgaagatgatcagtaggttctggccttgttagcccaatgctttgatttatattaataacatttcttgtcagctttttacctaagttatggatgtgtatcttccaggataagttcctgaaagcgggcttggtaggttaaagggtgaatgtatttgttgtattataggttgtatttcttatctgaaatgcttaggaccagaagtgttttgaatttcagtttttttttttttttttttttttttttttttttttttggtttggaatatttgcattatacttactggttcaatatccctcatccaaaaatctgaaacctgaaatgcttcactggtcattttctttgggtgtcatgtcaatgcttaaaaagtttcagattttgaagcactttggatttcagattttcagattagggatactcagcttgtattagatatggccaaattcctttgctgaggggttgcaccattttgccttcctaccactaacatatgagtgttctcgtttcctgtgactttgccaacaggatgtgttgataagcatttgcatttttgccagtctcataggtgagagatagtatctcagtgtagtttcaatttgcatttttcttgaggccttttataaaagtcttcagaaaataggagcaccatttacaatgactaattaaagtttagagaaaaattgagcttttccagtgaaaggtcccctggactctgttgccctaaagtttctgaaacgttttggaaaaattaccttactgtaacttactactagtgtccagaggcaaagggaagactcaggaccaggacacgtgcaatgtttcccaactgggtgatgtgcgtgaacggaccaagtgcaccaacagatgtgggcaaattcccctctccagctcctgcctggagctctagaatgtaccttgtgttagattttttttttttttttttttttttgagatggagtctcactctgtggcccaggctggagtgcagtggcacgatcttggctcactgcaacctctgcctcccgggttcaagcgattctcatgcctcagcctcctgagtagctaggactacaggtgcacaccaccatgcccagctaatttttatatttttttagtagagacggggtttcaccatgttgcccaggctggtctcgaacttctggactcaagccatctgcccgtctcggcctcccacagtgctgagattacaggcgtgagccactgcacccggccccttatgttagattctgagtggtcctgcagctgggaagctcatttaacattgcccttccctgagtttcctgctcgtgttattagagccttttcctgccatgatacctataatgtccctgagcactggcttgatggcagaagatgcttttgggtaacactgcctggccaccttgtccatggtgtgctgtttctacacccggcctctgatccttctcacagcttccaccaccacggctctgggccaagcactaatgtgagtctccatcctcacacagtagccatggggttcttccacagctagtgctctccttgtggtccttctgtggctctctctcacctacaacacaagccagactctacataggctggcccccggccctgcctcatttacctctagtttcacctttgaaagggatgtcctgcctttaccgtgggtacttggagctccctctgcttggaatgctctttcccccagattctcacatgcctgctcccccacttccgtgggcctttgcttagtgacatctcgagagatcctggcttaaccatccatctaaaaatgtactctgtcacactctatccccaaactgcttcatttttttttgaaaacatttgtgactgcctgacctaaggatgtacttttcattgtctgtctccttggctcgaatcgtgctgcacgaagacaaggacttggctttgttcgccgcttcatcctgaggacccagccagttctcagcacagggtggggcttgggagtgaatgcagattgcccgggtgctggggggagtggctgaggttgctgttcctgcccgctagtagccatcacagggtccacttctttctcggacactgggacactctgagtgagggcagatgtttccttggccaaaacttttgtccctgggctggaggaactcagggaggcctctagacattgtccagtcaccttcttgccaactgtcctctagcacagcattctcttctgcattttgtgtgatattgttttggcctgggttttaagaagtcctattatcactgctattcaaatcacagaaagggatgctcaccagatgttccactaactagtttccatgaggtacattcttagccactaggtgagcctctgcttcaagacttttgatttcttgattaacttcccaaatggggtgaaacccatttgtctccttaaatatgagccactacatccttctaagcatgcaataccagaatgaagcattactgcatattagaattagcattttctgtctgaagggatttagtagtttcaagaaagagtgggattgttcagtagaacaggcttaaagtaacaatctcccattagcgtagcacctaaggaacagcccacgcgaaaacctcggcaatgctcagataacaacagcgaaacgtacagaaatgggctggaaacaaaaagaggattgttcctggttgtgggacaggtctggtgttccacacaggtcttgctgttgatagaaagccgccggaagctttctgaggttcacccaaggccgtctgccagagctgctgatagaaaatgtagaagttgtaacaaacctttccattcttctgggttgtaatctgtggtattaacacagaatatctttagagggctggcagctctttccttcaagatgtggggttaagaagttatgtggttttactcttatttttcctagtgcagttctcttgacatcttaaattgaacaaccaatatggaaattttagggtggcaggaggtagaggttgacaataaacatctctaaaatgccttttccattgtactaggttcctcatctgaagctgtatcttcttcttttctctccagcccatttctttcaaaagcacaccataaagagcaccagtttactttgggatgacatttgactggttatatgggtggccttcaggtttgacacaatgggcatttagaggccttgactttgaatatattgcgaacctggtgatggagcagacaagtcctggtgtggggggccttggctgtgaacttcactttgcctgttactggctgtgtgaccctcagcaaatcacttaacgtccctgaagctgaatgcaaaatgtagagggtgcaaaagtaaagactgtgagtctgtgcactgaattttgatttcatactgcataataactcatgtccttgtttagtctccttgagcagttaccttttctatcattttatttgtgatgtatggtaaaggcactgtcttgcactcttaattaaaattaagaccagaataaggcagttctttggcagtcacagatcttatgattttttaaacgaactggaatacatcaatatttttaaaaaataccaaatcattgagcacatcatctacattggaccaaagttttttagggaagttttagagagagagagtgtgctctcaaataaatgaattttacagaagtaaaagaagacatttactgtcctttgaagtttttgttggatgaaaatggatcacaattgaaaaaatggaggtgttgtgaagctatgacagctaagaaagtataaggtagcccttccatgaatatcccagtgagttacgagcagtgagtgagaaggccagccattttgatggaagtggggctggttttgagggacaaacaaaagagttttgaaaatgtacaatgggtttatatgcctactgtcaccattcttgctattggctcccacgttttagtagccaccaactggcctgctggtactgtgctgggaactttttctattttattgccaaatctcccgaggaccctcaggtgatgtagactgttaaagtttaccaccttgatcatttggatgaactgttttgtgaaagaagggatttaatgagagcagaataaaaagaaaaaatatgcccacagctcaaactttagttcatgctcacttattttaacttttggcatggaatactctatagttaaagatacgtgtaccttttaataaagatgtataaataaagacttctgctttgtaggaacagacaaggcaatgtgtatttgagaaacctacaagtctgtaacagccattatggaagtgcctgcagggtcaggacacgttggcatttaggagtgtcattattcaccatgcacggtgtgcctctatctgctctcctcggggcagaactcaggactagtgtttataaatattttatttgtagctgatggcaatcacagcaatgctgccgagccccagagccctattcaaagggagtcaatggcttcctgcttgtgttgtttgccctcttcctaggccatggatgctgatagctcaggttgactctggtgccgagttttgcttgagttgtgacatatttggcaaggaatttgttaatgataataaaacaccagagttggcaagttatttactttttctcccatgagtaaggagattctgtgttatcctgataataacagtcaccgcaaacaccatatgccaggcctcctgccaagcaagctcttaccttgcattttctcattaaatctcatgcccatcccatgggagaaatatttttagtgtccccatttgagacaggaagaagcaggtggaaagaggggaagtgactcacccaggtcccacagccagtgagtggcagagctgggtgccactcgcacccaccagcatgccagaggttcctgtgagcggtaagcaagggagttggggctggcagttaatgatccaggttttcaggataacatggagggaaatgttagaaccagaacctgtgaactgggagactcggaacctgaaagaagccagttgctttccagagaaggaattcattccactctggaccaaaatttctcaagttccttagccttagggcttcccatgctggagcctcaggtgtaggggatgtgacaaaggacatgctccagaggccacctccctttgaaggcagaaccaagtcttgttttgttctgtgctctgcgtccagccccagacccaggcctggtgtgtacaggagctggctgggaggatggaagcttggaggaaaggtgggaggaaggggaggaaggagggagggagggacattgccattttccctggatgagtgtttggattgaaggaaagaattgaggacttggtaggagaaagagtgagtaataaattagaaccagaatgaaatcagagttataggagacagaaaaggtttccagcttttgtacaaagcaccattatcgaaagctcactacttcttgctgtgtcccatatattctccctgtacacagatctcattcatatgtttatttaacaaagattttgaccactaacctggagataaacaaaacatgtcctcttttcagagagaggaatttacagtctcgggaaattactcaagcaagcaatcttgttgcgcaatcattagcggaggacgtgggcatcctgtctcggacgtcttcacctgcccagggtgctcctgagcaaagggtgttgtatcgaccagaaggagggacgcttccgtggggtctttctttttcttagccaaaacattactttaactgtttccacctctctatgaagcttttgggttttcgtagttgtatgtttaatggaatgctaggatctcatgtgaaatgacattgatttttctgttttaactaggattgatcggaagatgtcaagtactcacaccagctacaaactggatgaggcgcaggctatcatgagtgagctccggaccatcaagaaggccatttgcacaggcgagaaggagaggcgggacctgatgcatgtaagctgcctgcctgctcatgtgttttattttaagatgtttttaatatacttatgtattacatgttatatagttattgtatatataacatatatgtgtatataatacacacacacacacacatgcatacatacatacgcaccccccactgtatttaagtacgtatatagtcatccctctgtatccttgggggattggttccaagacacacccccatccctcaggataccaaaatcattggatggtcaagtcccttatataaaatggtgtagtatttgcatataacctgcacagtcctcctgtatacttttctttttttttttggagacaggatctctgtcacctaggcttgagtacaatagcacaaaaatggctcactgtagccttgacctcccaggctcaagccatcctctcacctcagcttctagagtagctgggaccacaggtgcgcaccatcatgcctggctaatttttatatttttagtagagacagggtctcaccgtgttggccatgctggtctcaaactcctggcctcgagcgatcctcccgtctcggcctcccaaagtgctgggattacaggcatgagccactctgattgctgcctccatggtcacatgactgtctctttgtctgaatttcctgttcctgtaaggacaccagccattggataacgacccaccctaatccagtatgacctcatcttaactagattacatctgtaaagactatttccaaataaggtcacactcacaggttcctggggttaggacttgaacatatctcctgggggaacataattcaacccacagcaatgggtgatacatttatattgttcaataatcaagataattccaaaggtctatgataagaagtctcgctatcgccccatcctcctactgcccctgactgcctttattacctttttgcctacccttccagcattcatgtgggcacacaaaaagagaatacatgtttagccgccctcacgcaaagccaggactgtgatactgttccgcactagcttcctcacttaacagcaatatcccctacctttccccatatctgtacacaaagagctgcttctttccttgagatggttgcatagtattttactatgtgggtgtatttgtattatatatagctgggatcattgtagctttatactgctttatgtttttttccccttgagcttttgtagtttctgttatttttagaaaaagttgaacttttgcaaatgcaaaaagctgcctccatggtgggaaactcaagcaagacatctgagtggctggccctagtgctgcacatggtggcctcagagaggccaaggcaggggagcgctgcttgacctcatgacgtaaagtgctggaatgcattcagtgcttttggttacagcttttatttttcatctgctaccctaagtgagcacctactgcctgctggcatgtgtctagattctgtagagtataagacccacaggacagaacaagcaaagctcaaactcataggcaaaatgagacagatgcacaaaaaaactaccctgcctgggtagtgccttctaaggtcaaggccatgagggacttgcggagagtcctcatggtgcttgttaagatgcagattaccaggccccaccctagactcactgaattagaatctctggaggtagggcctaggaatctattttcagatgacctctccaggttgtgataagtaaatggttaattgttagattttttttttttttggcacacaggtagcactgagaacagctaccatttattgaggtctctgctcagctgacatcaaacaagatgccccatgtttgttacccatcgtcaataccgcaggctgaaccatgtggtgttccatggtggagacacagaggctttacgccatgaggccaagcagggctgcctgccccggcctctctgaggccaccgtgtgcagcaccagggccagccactcatttgccttgcttgaattcccaccgtggaggcaacagatagaatttctggaagaagcttcaggctcgagcaccttctttgacgtctccatagcctctcaaactctgagaagctccaggaagaggcacaggcagagtcctcttctatccaggttaaataagttgttttgcctttcttatgtgaacttaacaatattggcccctcccaagaaggccttatctcaatctcaagccagttttgtgagttctactgcacttgggcatttttggttctggtgtctgtagtaaaatttgctgaaagtgaatatattcagaagtctaaaagaaatggtcaaaaatctgatttctggctgggtgcagtggctcatgcttataatctcagcactttggggggctgaggcaggaggatagcttgagcccagaactttgagaaaagcccaggcaacatagtgagacctggtctctacaaaaacaaacaaacaaacaaaagtttagctgggtgtggtggcatacctgtagtcccaagtactcaggaagctgaggtcggaggatcacctgagccaaggaggtcgaggctacggtgagctatgattgtgccactgcactccagcctgagtgatagagtgagaccctctctcaaaaaaaaaaaaaaaaaaaaaaaaaatcagaattctgatttctgcttaaaactgccacacagagagatttcatgtgccagaatgcatactaactctaatttttggcaaaccaacatacatatgagattacttttgaccatgtagaattatgactgagaaatgaggtttataaaaatacgtaagctaaaacagcaactcaaagaactgaaaaagaaatacgtaagcattgtctgggagctgttttccccttccctgtttttcctctgtaacaatctcaaggcagcattcatctctgtcaggctcatttacattttcgatagaaatacttatttttttctttaggaaacatgaaggtttaagaaccagtaaaaatggtaccataattgtcctctattttattcacatgctgccagggggacttagttgcgatgtgatttaaatgactaagaattttattagaggtgcctgtgatgaagggcatttatgtgaaatctaacgagcatgggggtgaggtggggcaactgttcagtaataaataatgcagcagacctaaaacaaatgagagaaccacttctggagggaagagacacatcaccatctccgttcaaagagcttgtctcattgtgttccagagcctggccaagctgaccgatagcttcaagaacagctgctccgttaccgactctctagtggacttccctcaccatgtaggcgtgcctggcgatgctggtgtaccccagcagttctgcgatgccggctcccagactgatatcatcggggaggtatatgcgcgcccagggggagaaatgcaccgggagaggggagggctgcttcagtgttgccatcactggtttggtgtaattttccatgttcacttaagaaatgccttcacttttgtgccattaagtttgaagaaaaagtgttgtgtctcacatccagctgtgtgatacaattgaattgcttattactgctgcccttatgatttggactcttataaatgacatactccttgtgagagttgagtttcactgttcttttgacagacatatcactttttagagcatgagtccccacgctttttctgtgaagggccagatagtaaatatagtcactattttaggctttgcaggtagttctgctggaactgccccaccctgtcattgtagtgtacatgcagccataacagagatgccttgcaagcatgtaagactggggcctcgagctgctcaaacgttcacttacggaacagccagtgggctggatttggccccagggccatagttactgattcctgccttagaccactgatttccaaaggctttatagctgtgccaccttgggtgttactttattgctgtttcttactcttctaaaagaatgtcaggaaattgaattgaactaaaagtcatttttgtttgagacttggaagaatgtcataatgcctcctttgttaattagcgaagccttgagttagccacaaaaacaaagttgggaaaatcaccatttgaagcaggatggtggatattcaaagacgctagtattgtaatatcattgagtgaagcttgacattaatttgttaccaaatggaaaaacagtttaaagagcttctttttttttttttaaggattattaagtaaagatgaggtatcaatggaatgcacagtgccacccctcccccgaaattaaataaataaaaggaaagcaacaaaaggaggaaaaaacaattgatggaaaactctgggttttaaataattagctaattaatattttgaaatcttagcaactagtgcctcttcgagtggagtataatgtaggaaatcacggccctttatgtcttgggtgtcctggaacagtcctattttcaaatttgcctgcgttgttccaaacgtacacttggccgtttttgactaggcatcttctttggatgaaagaatatggtcgccatctgtaacacacagaggagaatctgtaattcaaaaatgtttggcatttttgcgtaaagattttggagcgagagaaggaaacaagtgtaagactcattgaattcgtgaataattcattgctgcttattgtaaggttagaattagaatttagtttgagagaaacagttaagatagaaggttctccagtgatttaggtcaacccttctaaaaatgtcaggtgaggagtggtggctggttatgctacttgagcagtcactgctcattgttgataagctcctgaagtttaccggggctgaccctaggtcagcaatctcatagctgttatctcagtttaagtagttgttcccatcctgtgtgatgtgcaggagaccgagatgccaggttacctaaggtcttgtagctgaggagaggcaggtctggttttgaaacatttctcatccctaaacccctgtactttctaagaaaccacatcatgttatagaaaaatagatcaaaaggctatgactgtattagctaaccattgctgcataacagatttccccaaaacctagcctcttacaacaacactcctttattatctcatgcttgatgtggtccaggagactgggctgggtcttctgctccagggtctctcaggaacttccctgcaatcaaggtgtcagccaggactgtggtctcatccaaaagctcacctgggggaggggccactcttaagctcatgtgattgttggcaggattcagttcctcacaggttgctggactgagggcttcagttccttgccacatgggctgctccagcacggcagcctgcttcgtcaaagtgtaccagctgagagtctgctagcaagatggaagtcacagtcttttgtaacctattcacagaaatgacttcccatcacctttgttctgttctattggttagagtcaagttatagacccagtttattctcagggggagggaatttcacacggggagaatcccaggaggtgttggtcattaggggccttcttagaagtctgcctacctcactttgtgcttgtgttgagtctgttttgtggggtggatattgctgtatgtcagatgtgctttttgagactggagatttgcagccacagggttgcacacgctgtagcgctgcataggaactctgaagcaggagtctcttggatccatttggctgtcttttcttttcactaaaatgtccatttaattctcaaagaagagtacagaaacaaagcttagagagaggtgcatacagctttgagaagaggtttgagagatgatgtttactgatcttgatgagttgattgcagggtcactaataaagaggggactgaaatggcaagtagctcatctccactgtggacagcttttggagctgtggcactgccacttaaatatatttatactgaggaagctggagaggagcattggatgaggccgtttaaacatgtataattgtggccaggcacagtggctcatgcttgtaatcctagcactttgggaggctgaggtggccagaggtggccagattgcttgagcccatgagttgaagaccagtctgggcaacatggctgggcaaccacctgggcgtggtggctcatgcctgtagtcccagctacttgggaggctgaggcaggaggatcgcttgagcccaaggggttgaggctgcagtgagctgtgattgtgccactgcactctagtctgagcaatagtgcgagaccctgtctcaaaaaaagaaaccatgaacaattgtcattctggttggagaatgctcagtcccttgtaaggcactttttcatcttgccattcaaggcaataaatttgcgaagacatttttcatcaacatagatcaaaactcgtgtcgataaattcactgctaatcattcaagttgaatattttcagatacttgttgatgggaagttatttcaaaaatgtaaagacttggtggccataatatgtgatctagtaaggtcagatcaacagatggagctgatttattgaaactggagttgtgtgaatatttgcaggaatgaggaattaaccaaaatgtactacagttacttcctgtacatgtctttttttgttttgtgtaggattttattgtcatcaatgtaactggtacaaaaatatttaagtatatctactcgtcacagagcaccgcatttaggctaactctatattggtactccccgagctctggctttttgagaccttgcttgctttccttttgcccttggttctttttttttttttttttttgagacggagtcttgctctgtcgcccaggctgaagtgcagtggctcagtctcggctcactgcaagctccgcctcctgggttcatgccattctcctgcctcagcctcccgagtagctgcgactacaggcgcctgccactacgcccgactaattttttgtatttttagtagaggcggggtttcaccgtgttagccaggatggtctcgatctcctgacctcgtaatccgcccgcctcagactcccaaagtgctgggattacaggcgtgagccaccgcgcctggcttgcccttggttctttaacacacctcgtggcatcagaaggcgtccaccagcccatccgtcacacagctagtccagcttcctcagaccgtggagcttctgagtagaacatcattattttacgtttactgaggaattagagaatgtactgcacaaaatcgggtgactggtttttgcctttgtatcaacttttactaagtaatttcctacttcttttaaaacctaatttgtggttgttgtttggaattacagaatagatagatatgctgctgctgtaaaaaaaaacaaaaaaccctaccagtttaggcaagcaagagtcttcccttccccctcccccctccccagccaggggtggccgcaaagggttattcagtgtttccttccagaccttgcacagattgaaagtgaaagagatgaagaatatttctcattgctgccgaaagtttaagtgaagttgctattttggaaatatgtttttaatatgcgtttcctttctttttttctctcttctgttccggaaagtttgtctttgatgataaaacaagacttgtagaccgagtcagacttaattggcaatatgaagaagccagaaagaggtaagaagcacttttttccaacctcgccttctgcttacttacttactttctcctgtggaaggaagcgtggcatagttcctgtgtgtgattggtcacgtctcatcggagaacagcgtttgatagaataccaagtcaaggatcttcatttacgtgtagcttaatacatacatatgacaacatttcaagtgcatttaaaatgtgaaatttgcaatattacaaacagttatacagacgtgattccataagaatagaaacttttttggctttgtcatccccggtggttcagaacctctacccctccttcccttccctccttccaatagacgagcatcagttccagagggtgtcataagtgaaaccacttgatcttttatatgtgtggcttctaactccataagctaatgggcaaagccatgtatcttggttataagacattcaataagcattaggtcaacaggtgagcagtacctaattgatttcattccatttatgttgtcctgtgtcgtaaaccattggcctcctgcaaattgcagcttgacccactttgtgcacttgtgtttctctttcctcacttccctccctcccttccagtcttcatcctctgacatgcacaaagctgagaggcttccgaaccctcgcatggcatagtattttagggcgtcacgtgtctcctcagctgtgcagggctcccgttttcaatattcttctcctctctgacttttgtattctctttttagggactttctctagtttgtgccttctggaaagagtcttaaagccaaattatttccaaataagtgcttcagaagagtatcaagcatatcttttttaaaaagttacttgagtcacaaatgaaatattgtcatggggggcggggagagcagaatagcagaatgtcgggtggggtgagggagttctttctggaagctaaacagttaggcctgctcagcacactgtaccattcatggacgtctggaaagctactttgttggctttttaaaaaatgtaaaaatagcaacaaaagcacatcatatgattcagtgctccagggccaacttaaacggacatgggccttctgttttctaggaggttttctaaccagtgcctcttggctttttaggatggactcgtggtgggctttaaatttccccacagaacagtgccaagttcatttggcaataccagttgtctgtgtggtgattcttcattatcatgcatattccttctctgtagcctgcaagagtttgtgaggagcgattgtctcttctgagtattcgtctgctcttgcctgtttctggtgaaactgcggagtgtgggtgctggaatttgctacacttaggaacatgattgttacgtgtttggttgtgacatttaccaaacatagcaagtgatttctttgttttctagagatggtgccagtatatggtgagtaaccttctaaatgttgggataatacatttgggtgaaaagtcgagtatttaagaaaattgttcaaggggcaggcatggtacttcatcagttcttttgaataaaataccatattatttcaagatggccagaaccttgttaggaaacgcaccacagctacagaggaaggtccaccttccactgacagtagcggcatgtcagaagtgcctctgtgggctgtgttggagcatttaaaaatcagagatttcttttaaactccacctgggtgggcctgcacaggtgctgcctgtccttttcccactagcatagtggggctccacacagggagcaaggccttcaccctccaggagacctccagcagtgtctgcagacatgtttaggtgtcccaactctagggcaggggccagggaggctgcttgacatcctgttgtgtacaggatggcccccgcagcaaagacttacccggctcagcatggccgcggtgccaaggtccagaaacctcgccctggggcttcttcctgtcttgctcctgaatcttcacgatgcatggacaacaaggggcctacatgagcaggtcgcctgctgactcacaggcatcagcctgctccccactcaccctgctccagccaatcggcccctcgatgttcctcagatgtacaagcacgcctgcactgagcagcccctcgggcctcccaccgggcctcagtcccaccgagccaactcctgacctagcatctgcagctggcagaatgatggtccgtcaaggtgtctgcatcctgatctccacagcctgtgaagatgtggctttccatggcaaaagggacttcgtggatgtaattaaattagggatcctgagatgatggggaaatgagcctatatgatccaggtgggctcagtgtcatcacaagagtcctcataagagagagacaggacggtcggcagtagagaaggagatgtgaggttggaatcagagatcagaatagtgtggggccaggagccaaggagcacgggcagcccctagaagctggaaggtgcaaagaaacagattttcccctggaacctccagaaagaacgcagccctgtagacccattttcgacttctgccctctagaactgtaagggaataataggtgttgctttaagccattaagcttgtggtaatttggggcagaaaagagcaaactcatacagtgcccttggcctgttctgtcttctctgtctggaatggggtggcttttctccaaattgtcacatgacctctccttttgatcaccttgttaagagaggtttccttgaccatcctgaataaaacctcaccaccctgtcctcaccccggtccccctgattggctgagcaaatgttattacctaaccagtgtttacttttcttactgcctgtctctccctgtgaaaatgtaaataaccctcatgagtgcagggattgtaggtcattgctgtaagcccagcagctacatacttggtgaatatttattgaatgagtaaatgagggtcccgtgtggttgcatttgctatttggcctttgcccctgggacggggcaagccagggcagtcccggggccaggtcagctccaggccaactgctctgctcctgggtcccttcctcaaacctccatccaggtgtgagccttggggtctctcgccttgacttgagaagggaaagggcttcaagacatgggtgcctttagggatctgaggtaggcaaggaactgtctctccctttcaaggactatgttcaaggtgtgatacgtcaacacaccgagctagactaacagttctgggccttcatggacattcaaaagggctactagcctttgaactccataattaatcctctccttgggggttggagaaaatggcattggagttgggtcctgaaggagtgctgggattccagtcgccgtccattggggatgggctttctcaggtaagagtgggggtcaggagtgggggtaaggtgtcactctgcagcagctggactggcctggaattgcagagcaaaggccagccaggctggaatggaggatgcatgagcagggaggcaggccacggcatgggggccacgatgccccgaagaggggtcagaattgctgggcatgctgggacgtttgagttggaaagattaagtgtgagccattcagatggtggtatgtggaggagggccatttgaggaacccagatggcatagagatgaagtcaccgagcagctgggctcaccttgggagatggaacacagggagaaaagaggagatgccaggactgagcctgaggaagtccaatcaaaggcctggcgaggacgagactggccagaggggtgtagtaaaaggtccgagaggggatggctggggctggaggaaacaagaagaggaagtacacctgagaagacacttatgtccacgggcccagtggctgtgaaggaacgaaaagggggtggtaccgttggccgacaggcaggcctctgcttcccaagcccagcctgaggtgtccttagtccacagtgcatgggaaaaaggagggccagcggcaggtgttcctaaagccaactcgctgctttccagtcaaagaagcctctcattctcagagatacatacatatgtacatacatacatataaatatatataattaatatatgttttatatatatttaatacatatttattgtatatttttatatattatatttataatacgtgtttaatatacattttttcatatatatttttttctgttaaaacatctttctcttaattaactaatgatgatcattgatgtgaattggttttttccaaaagtctttacttggcaaaataacaagctggcagtcctaaattgttgccatcagcacatcccctttcttaaattggactggcctgggggaagtgtgactgagatggtgctctccctggaattaaaggagaaggatgaccctaaacagggtttccagaggctcacagtaaagtggagggtcatttgaaaggcagatcttggttttgaccatgagtttggtgttttcagtggacttgaagctgctgagaaacatccatgaagtgttcttgtcggtggagtccgcagtggagattgcagttcgctgagtcattgattgcagctccctccgggctctggttcccagatgcggcggtgcacgtctccagtccccttggtgtgattgtttctgcctccagtcattccacattggttactgtagctaaggcttgaccagtaagtgcatgcctgccatgtgaactactcagctgtaggtcacataacccttagcagcctgggcaaggccctagactttacataccttgtagcgttgtcaggatagtcttggctcccctctgccccatccctgtagacagatggaaggctaggaagggttgatgttatcaggtctccccagcaccagatgagcgatttcattacaatggtgttttccgagtgttctgatggactgcctctaagtgaggcacgagagtagaacgatacagacttggggagagagcagtggcaagtggttctctggcaagaactcaacattaacattccaggagccaggtgctgagtaccacaggcaaagcatggtggctttgaggtcccgtccatggtctcttcctcggcccccttgatcaggctgggagataatgtctctgatatccctgtgagcgtccctggagaagtggtgtgccatgagcaggaaggcatcatgtacccccatcaacccaccaaagcatgaaaaagaacacgttgctcttagtggcagtgttagcaaagaataatgcgttcttccctgctccctcattccaagcctaagggacatcatgtgccctttcctcttgcccaggtgaacttctattagattagtgccacaattcagtgtcgtcttttcgttctgctacttcgccgttggacattaatctcccagctctcattcctgaaatcatttcaccctgcaagcttaccttccctactgtattaggttctgcagagaaacagaaccaacaagagtaggggtagggaagagaagggagagagattattttattataggaattggctcacgcaattatggaggccaggaagtcccaccatctgcaagccggagacccaggaaagccagtggtctcattcagtccaagtctgaaggcctgagaactgggggtggggtggggtgtggagtggggtgggtgggtgggtggtcatagtgtaagtcccagagtctgaaggcctgagaaccaggagctttggtgtctgagggcagaaggtggatgtcccagctcaagaagacagacagaattcacccttcctccacccttttgctctattcagtccctcaatgaattggatggtgcccacccacattggtgagggtggatcttctttgctcagtccactgattcaaatgcttatctcttccagaaattccttcccagacacactcagagataatgtttgtaccagctatctgggcaagctttagcccaggcaagttgacacacaaagtaaaccatcatgtatatcctctgcagaacctcctgtgctttgccacttctgaacagtggaggattttatgccttaggcattttggacgtctttccttgcacatatatatttgagattatttttaagatgtgggaaattgtcaaaaatgccgaattctggacaatgagggatttcatatatatatatacattcagattttttttctttcctttttttttttttttttttgaagacagggtctcgctctgtcacccaggctggagtgctggagtgctggagtgctggagtacagtggcgtgatcttgactcactacaacctctgcctcctgggtttaagcgattcttgtgtctcagcctcctgagtagctgggattacaggcacgtgccaccatgcctggctaatttttgtatttttagtagagacggggtttcaccatgttggccaaggctggtctcgaactcctgacctcaagtgatccacccacctcagccttccaaagtactgggattacaggtgtgagccaccccactcagctggatttcatatatattcagatttaaaggaagtttgtggaagtggaactcataattctgagtggtgatgtgatttctagagaattctctggccaaacgaccactatcatgatgactagttttgtgtttttaactgtgggtcctgtgaagcgtaccaaaaggactgcttgcaccttgcctcaggagcgcctcttcggattcccaaggcagacctaatgataggaatattcacactattgattttaaaatttcagaaattttaaaagtgaagttgaaagagcaagtcttcttgaagcaatcccgatgacgcagatggctccttatttttaacttaagggcgcttgttccagaactgtgcacaaactgtagctgttaccatagaaacactctcagtccagataggaacaaaacattcggtccatccagtttctctgcctcttagtttttgttgccaggatcagtcctgctgttcatcagttgtcgaggatcagtgtagtgttatgattccagttgaatttgatcaatcacttggattttttcatttctcaaatgacttcctatctgggttttaggggtggggcacagttgtgagaaataaggaaaagcatctttgccactgtggctctgtcttccctattctggtcaacacggagaagcctgtagactcactgctttttatttgatgaagttgctctctgaagatctgtctgttgcaaagggagaagatgtcagggctgggaagctgaggacggggtgagatattggtgtattagtagacctttcttatcccacatattctagattcagacttctcaaacttctgacataaagagttgagtagaatggacgctggtttagttcaatcagctgaagtgatttcattgtccatctgacttacatctcagctgttttctttaacctttgctttttatttaaatgggtatttacaacaagaaaactaagagaaaatgtaaggagtatcgaacctgtagccgtaattgcaatctgaaggtatgaggctctaagctgaccccgcgtcctggaatgtgccattgggatccctcacgactcatcaccatgggataggaccgtgggctgtccagagttctgcttgctattccagaaagcagcaggattttaggaccatgagaaatgatattgtagactgcagatttttggtataaattcaaataattagggattattcttgatatgcctcagaactttttattattgaaagtgcattgttttcctataaaaatgcaaatcgtatttaagattttcatgtgaattgtgagagtctaaatagtttctgcggcataaatgcatggtttaatggtgcctgggttgtaacagaaaagtgtttgagcaaaaatcataagggaaaaatgattcatattttatgtctgtctacattagacctgctcagggaatagaatttgggaaacacataataaataagaaacctgcatgcttgattgaacatttgctttcttcactatcaggacacgggggcatatattttaaggcttttaaaggcatttgggagagattttatataggccataaaatgcattacccctcaaaaataaaaatcactgaagaatatagttggctcacagaaaaaaaaaaaaatcctctctaattttaagctgctattagttctctttacaaaaaactcgggaaagttattttgttttgcaaactttaaccatgaccttgctttacttccatgtatttaatttcactgaaatgatatttcaaagaaaagcctttctggaaattgtttttcctttaatacccaaaattggaacaacagcactcacaggagcgaggctccaaccagtggatcagctgtttggcgtggatgtagaagaaggtgcattgaaactcagtacatctgtgtttagccttaggcaggaagtctgtttcttcaagtaaacctaacgtactaaagatactccctgcagatggctcgtttccggcccacggcaaggtagacaagtcatacggttttaaaggcaaagccgtcttgtctgtctcatggggacataagaacaatcgattgttgaaggaatcctagtgcttttggcttccagtacagacagacagacagatgtgcctctctcgaccttgctgaagcaggccccaaatgttcacacctagaacatggggacaaagaaagaaattgaacttttcaatatgttccagtttcttctagattcatatatagctctgaaatgaagatgagattgtttgcattgttgcattgttttgaaattttattattaaaccccacaattggaaggcacagaaatgtttgcctagcattcagcacagcccaaacatttccagatgggttgcagattttgtttctgctggagaggtcgtcccttgccgtttgtccttgcatatttttcctgccagctgtgggaagtgacaggacatggtttaatttgggctgctgttctgtttctttatgcctgcagcagacaggtcttttgaaactcaccctttgcctctcctccctcctataattcatttttttcctcattctttttttcctgacagtgcatattacttgagattttcctggaaaggttgtgattatctggaattggatcttccgccaccttcaacagcttgaatccttgtaggctagcagctaacctagagctggcagactcaaatggaatcttgatctcttcatatttaaggctcagaaaactcaaaaggagtgttctgtaaaatacttctgtttatattatatgtatggtaattagtatgagtataaaatggtcgggcaaaatttagctgggctcagactttcctgtggatcagataaatggaaatgaaaaaaagtatgaggacacagatttgctgattgttcttcatcttttatatttatttcttaacttgtcttggtctactgtagaatgttccagaaatgtcattgggtataatgtctgatttagcactgacttatttgtgggtttgcttggagtgtattttccttgggctttggatatatgactgccataaattttaattacactaattagacgtaggtggatgcttaagcccagttggagtcctagccctgttcagctgcctctgtcattagtttttctggtgacatggtttggcaccatcttccaacacgttttccagacattagttttaagttagaaaataacttgtctaataaagctactgacattcaactagtgtctttaccttgttgaagtggacttgagtaaaatgcatacatttaaactgtaacttgtgtacccgtttctttccttaactgtgggctttcagattcgtttggtggctagagagggagtcatgcccgatcctcatgagtccatgtgctcgtgtctagtttaggtggagcctgacttggcacaaggctgggtggcaggttttaacatgtgtggcaatgctagtcaattggggatatccacatggctcatagtgtagagaaggcttctgaggtctagacccagcaggtgggaagccagccttggttagtgccgtggaccgcgggcacaggaggaggcagtctcaggagcacctctgccctgcatctccctcggaggatatagggccacgtgtgcctgccacttccctgttctcacagctctttgtgatctcagagaagcctctggattttgtttttgggcgagtatgccaactatgtcctccacagcatggggttcaggttgagtttgccattcctagtttctccctagaaacatatccctgatctttaaccctacttaaagggcttaaaacattctactcttacttttaaaggatgctttaaaaatacaggccacatctgtttcacttaatctgcattcaacagcacctcatgacacaaaaagtaatgcagtctgtttgccaagcaagcacttggaaatttcgaggcatggaaactgataggagcctctgtttttccaccttgaggattgttgcgctttgcatccacccagatcatctctcaccagcatccatgctcacagggctgcctctcttcctctcacatatttgcaggcgtgtttgttcactgttcaatgcactcagcttttgtcgagtgcccacttgctctccgcaaggtgttttgaattcatgtatggccaggggctctggtgcaggaaggagcacacagaaccagaagacgcggagcatggggcttcgaaggtctttccttcaggacgccagatgatgagtgcatttctcctttgttattttgctaaagcggctgacagtggttagacacagctgaggaggcgggaggccggcagcacttctgggggtccagcatgctgtttagctactgatgagggtgggcagaagaaacaagcagactccctcctgctctgggacagtttcatgtaggaaaccaggagtctgagccgccgagtatgggcatgttgagggctgctggcctttttgtcagttcttcggaacaggcacgatggggttattttcatctcgaatctcaggctaagggagcttcaggaaaagacttctgcaccattttttaggacattgtttccatatccttttaagtgtaagggtcacttggtgtaatcatttcactacttatttggcaaaaggagtttatagaatcagtgtgagacgtggagaaggtgtgaagacggcgttttcagtccgccgatgtccttttttcctccccgtctctcttgcagagtcgccaacatccagcagcagctggcccggcttgacaatgagtcctggccaagcacggccgaggctgacagggaccggctgcagctcatcaaggagaaggaggccctgctgcaggagcttcagctcatcattgcacagcgccgctctgcgggagatgtggcccggctggaggaggagcgggagcgcctagaggaggagctgcggcgtgcacgggccacctccgcacagggcgccacggagaggtgggtcagcggggacacgacctccagcggaaagcctgctggaaaaactccacggggtggcttgtgtgtggctggagggtgttcctgatgatcactcagagcctctcctgcctggatgttccctggcctaggaggggcatgcggtggggggcactgccttctgctccctgggtctctggagcctctgctccgaagcaggaggtgattgacaagggggaaggagtgagggaagatgggtgacctccatctccgcccacgccccacccttcctgaagttggtgcttggtgcttccacctgcctttgtgggacagtgccctgagcaggctgtggtcccgctccggcccgggcagctctgttgcatgggggaagaattccctgttcctgacgtggtgagcatggtgggtatccacctactgctttcctctccaactttgatttctagccaggagagcctgctcttctctggcattgggaagctggccacctgtcgtgcgtctgtcctgaggctccttcaccacgcaggacatgcaaagccagcatagtggctttggtattcggtggcactgagtcgttcagcctttcctcgtgtgccgtgtgtcctggtttccatttgctgtgtgagactgcagattgtgtcaaaggctgggcctgccttccacacttaacagcagtttctctgtggctatcagctgggcttttggagagcagcccctcccccacgtgttaaagtcttgcccccttgagctcacatgagcagctctacagagactctaatagatgcttggatgattcgatctgttcagatgctcttactcctactgtttcacgatggttgtattgttgggcgtcctttatgcttgatgttcatgggtcatcttcataggagacaagtctgtggcttggcacgaggggctcacggcagcctcagggaagcggtggtgtttggagagttgagctcagagtcctaggcaggtgaatttcattttgcctgagatggtggcatgccctgtcacctcacccggaatcaaccgcgaggagaatctgaatgtgaaagagctcttgcacggctgcgtttgttttcagctaaacatttccttctgttccacccctggtattcttgtatgtgtgttctgcgtaggagggcctgggagttcctgttgcttctctgtgaaggggggaggacttggccccacaaatgtcgcctgcatctcagggccccacacccacgctcctttgactgtggctgctgtcaccatgtggaaatccagcacacacgagtgctgtggcccctgagtacaagtctgcagccctccatggagccagtgttagccccgatgcctgggttcaagggtggggacagcaaagccggaccagctttgactcccatgggggtctctcgtgagaccagcccaggtgctgagtcctgggactcagagccctcgaccaggacctaatcgccccaagcgtgtttcctgaatctgctgctaaatgaccttggccggaaaagcacatccacatgtgctaagcacttgcacgcacatcgcatgggggtggggctcttgtagctctgggctttctgtgccggtacacgcagggcccatttctccactccacctcccttcattggaggggtgtttgcagtttgcaagtatgaggccacatggtaggaggcttcccccagcacaggctggcagcattaggagacccggcgtgggccaggtgcagagagagagtgaggttggtgccttaaggctgagccgtgccagctgtagagctgggcccagtctgcctgtctcacctgcagtgtcatcagcagcaaatgggaggcgtttgccgggctgggggtgtcatccgggggagaaagagagagatgcgcacctccttcaggcctcccgccccggcagatgatacgtgcggcggcctcccagctgctcagagccagcatctctggagggagctggtgcacgtctcctgggctgagggagcaggcttgaggtgaaggacacataccctagataatctctcggatggctcgtgtcaacgcttgcaacatcctttgctattttagcttgctcatgttagtgtgtggcaggcatttatacaagatgctgatgttcaacagagaaccccacggctctattacaagatgcctgccatcctgagaaattctctttccaaggatgactgcttttattataggggtgattataaaatgaaagatctatcaaaaagcaaaaattttgttctgctgaacctgaagtcatgttttcctttgtcataatttaatgacatctttacaataaagtactttatgtaaagtaaataaagacagtaaattagactttatattttcttaatctgttagcttacttttctactccttttcatagcagtggtaaatattctttgaagttcgtttcatttgaattggagacacaaggctatgtgctttaggagttgggccctggccagttttctgccaggaaactgtatccccttttctttttgttgaaaaaataagtacagaagtcaggcaaatgtctaagactcttattttagcagtttatgttccagccagttttttagatgtctcagttattgccagcgtggcccctgtttggtaaggaagttacatttttagtcatctgcaactttcagaataaccagcataaaattagactgcaaatgtgggcagtcatgggcacttgtgtgtgatcttgtatccagatgcgctgtctcttgtgcgctccgaaatgcacctgtttgtataatgacaaatgtgttgtattggatagaaggggggaatttgatctaaaacttttttcactacagataaaacaatctgaaaataagtcatgactaaagacagtctaaaaccgagccgtacatatgaatgtatctatatgtcatatgtgtgaaaacagagctggaatgcgctgacggatttagcgatgggttggaaattctaccctggtcactcaagagtggagccagttttcagtaggaactcaatttagattctattaatttgggatttgagctaatagaattcaggttgggttagaatttctgaaaagcattaagaaaaaagttagtagccttggaccgggcttgggtaaattccctacaacaaatggcttcttggagctggtcactgtttgccactggatacgctctgctggtgtcgtctctgcccctggagtcctctgtgacttaatagtgtcccggtgcttgtgagagtgggttccaagttacagctccaaagctcaatgaaggatgtattttgaactcacttttaaactccctttgaaaactctcggctctccatcttctgaaaaagatggggtttttgaggatatcgcccttgataagcgtcagataggatgtgagtatcacagaaaattggggaaatgtttttcagtagtaaaggaaatgcctgtttgttggtagtgtgccttggctttagggtcaatccagcctgaccgaactttgagcttgcgtagcagacgcaagctactttatatgagtttcttcatctgtaaagcaggaatagaatccaaagaccagtaaggaatgaggcagtgcatagaaagcagtgtgcctttctataagcccctcagtggaactttttttttttgagatggagtctcgctctgtcgcccaggctggagtgcagtggcacgatcttggctcactgcaagctccgactcccgactcccgggttcacgccattctcctgcctcagcctcccgagtagctgggactacaggtgcccgccaccacgcccggctaattttttgtatttttagtagagacggggtttcaccgtgttaaccaggatggtctcgatctcctgacctcgtgatccgcccgcctcggcctcccaaagtgctgggattacaggcgtgagccaccgcgcccggccccagaattgctttttaaacgttactttcatttgtacaagctatcaaaacattttccttaaaaattaaaatatcataggtaagtggaatcttagaacattctactcaagagtttattacagctgttctcaaacattttggtctcagaacctccttccgatgttaaaatgctgaggatcccaaagagcttttgtttgtgttggtttttttaaagttcttttttctaactgttttgttttgtttttcatttttccccacccagggacctatcagtgtttatgtggatttttatctgtcagtatttgctaatttagaagttagcgctgggaaatttttaaaatatttatttattaaagataacaataggccgggcacagtggctcatgcctgtaatcccagcactttgggaggccaaggcaggaggattactttagttcaggagttagagaccagcctaggcaacatgacaaaacctcatctttacaaaaaatacaaaagttagctgggtatggtggcacatgcctgtggtcccagctacttgggagcctgaggtgggaggatggcttgagcccgggaggtggaggtggcagtgagctctgatcgcaccactgcactccagcctgcacaacagagcaaggccccatctcaataaataaaaaaagacaatacaaaccctattatgtgttaatattagtaacatttttatgactgataacttttttgaaacaaaaaactatagtgagaagagtggtattatttgcccttgctatccatctctttagcgtctggcttgctagaaggcagctgctttggccattggtgcattcggcctgttgagatagggtcattttgagtgaacacgtgaagaccatctagctgcttaccgatatgccattgggaaggaggggacctcataggacccctgaaggagttttggggatccgccaggggtctttggatcatgctttggaaaccattggtttcaatatatgatattgaacttgaaagtgggttgtgtcgtggctccatttaggacgatgcttgttactctcttgccagctgacctctgcatggcaccatttggaattttgtttgcatcaagagaaacaaaggctcatcagaatttatggcatgtggttgaaacttgtaaacaaactcagactggtttgtcttccttatcctaagttggtggcgcatctgtttcctttatgggtgatagcagctctttgtcaatcacgtgtcatctgccgtacattattttatctatgcagcatcagttccctgagctggagattgtggactccatttttacaggtaatgaaactaagggctcagagagggtgagacatttgcctaaggccacacagcttgtgagtgactggccaggtgggattctctgaatcccaggctgctgtcagacactgtgtctggtttcctctcactcccacctagccaagctctttaaaccccttcggcatgtccccttccctgttggtggaaagaggaaggtattaaaggggcctactgtggccacacgtcacagtgtcatttccatttgtaaaccaggagtgtttccttctagaggcaaacatatttattcatggagttgtccaacaactgtgtattgagtgcctatccacaataggctcgattctaggcggtgggcctactgcagtaggaataaattttattctacaaaattactaagtagaaaaaagtagaaggaaggaaaacaaaaatacctccaaccccatggcctggagatggcaacggctgctgttttgtttcatttgcttctaatgttttaactgtatagatcttagaattatatttgttcttctctagaaggtggcctagtatgagggaatctgatttgttccaaggaatttcaacagatgactgcgtgctctgcgtttgagctcatctgctagttatctgtccttctgctcacttaccactcctcccatccatccaagcagccatccccagccacccacccagccagccatctagccacccacccagccacccacccagccacccatccagccacccatccagccacctacccagccagccatccaccaacccagccacccatccagccacccacccagccacccagccacccatccagccacccacccacccatccagccacccacccatccagccacccacccacacattgacccatccctgtgcccactcctcttctcacgcatcccctcccccgtgcactgtgcctggcgcttccacagagtagcaggcactgctcagggtgccagggatgtatttttcaaacgggacaaaagcagtctctgtgatcttggcccttgtgacctgggtgcttttagaatgggtggtgattgcaacctaattcagctggagggaattgatagtggactgtcttgttatgaaaatattctccctgtctttgaaatgtactaatcgactgtcttcttacctacaggattctgcttcaggaaaaaaggaattgtctacttatgcagctggaagaagccacccgcttaacatcctacctccagtcccagttaaaaaggtaggttactttcaaagagaaaactgtacttgttcatcatgttccaatgactggtacatgaactcgtttcttgtagcttgacctgaaatgttgttaacacagaatggatacattatatttttaacatgctactactgtatgactcaaggaatatggagagaaccacatttggcttcagggtaaataagaggcctgaagtcagatgtattcaaggattttgtaacctaattaacagtttcagaagtgtacatctatacacgtgcgcatttttgttttgggttttttttaaaagcatacgaactttttaagctagtaagatttggctgctcaagaatggccaatgtcaagggcctcagatgtgtcattttctcagatattcctcctaacaatgccccaggtgggaactgttctcaccccagccccagtgggagcccagagggggtgaatggcttgaccaagtgtacctggctagtatgtgttccagccaggactgggactgggacttgggcacgggtctctgctgttgcccactgctctctgccaccctttccgtgctcacagggtgagcaggggtggctgccctgccatctcagatggccatgctgtctcatttcagcctgtgtgccagcaccctgacggtgtcctcggggagcagccgcgggtccctagcctccagccgtgggtctctggcctccagccggggctccctgagctcggtcagcttcacggacatctacggcctcccgcagtacgagaagcccgacgctgagggcagccagcttctacgcttcgacctcattcccttcgactctctggggcgagatgctcccttttcagagcccccaggcccctcgggcttccacaagcagaggcggtccctggacacgccccagtccctggcatcgctgtcctcccgctcctcgctgtcctcgctgtcgcccccaagctcgcccctggacacgcccttcctccctgcctcacgggactcgccgctggcgcagctggcggacagctgtgaggggccaggcctgggcgccctagacagactgcgggcacacgcctcggctatgggggacgaagacttaccaggcatggcggcccttcagccacacggggtccccggggatggggaagggccgcacgagcgaggacccccaccagccagcgctcccgtgggtggaagtaagtgcggatgtggcctcctgcggggcgagggttacctgcagggcggaaactgtggggtccagagtgaggatggctggctttccaggtccatggtgagctttacgtttaggaatattgatgtgatcgggaagagcacacacctgctctttctgatctgtgttggggaaagatcattgaaattgacaaagttgtctttcctaggtatttggcttgttttcaaaaaatacttaattgttgaaaactagggtaagaactacacaggcttccacattcagaggctgctggagatggattagggccttcatgacctttgcagcgtgcgtgccgagatggaaccgtcagtgtgtgcccgcctgagaccattatgccaacaggtgtctggttgtagctagtggaaatcttgacttcttttgttgctttgacatctctttatcttttatagttttcatagtttccaagaacataggtctatcaaatgtggaagtgaaaataattgtgtaatttcaaaagacatgcctgtaagtatcggtcatttctactgatttggtttctctggtgattcttcaaatggaaaaacacggagctccgtggagcctcatccattcagttggtgttggttcagctcctcctcggagctggggtctttcagcttgtagcctgcttggaagaccaaactgctattgaagggaatattgaccccatgtgcttttctcagccacccatggcaactttatcttcctttggttttaaagaggatcaagaacaaggtctcccgttcctgaagttcagcccatttaattgacttttatttgcacggcaaaaatgttttaaatgttccatttaggcaaacactagataatttgtgcagcatagtggatctcagccaggggtgtttttgcgtcctgcccctggggaacacttggcaatgtctggaaacatttttggttgtcacaactaggggatgggagatgctcctggcatgcacagggcagcaccccctccccctcgagaatggtccagccccaaatgtcaagagggctgaggctgagaaaccctagtcacgtactatggagtatttatgcggcaaggggtagaaataaaactagagagcagaaccagtgtggtgtagtggaaacagcttcaaactagcagctgggagaccaggcttttgttccctgccctgtccacttctagctgtgtgaccttgaacacatacctggactgagtctcaccttttccacccttgaatgcagtgatctttgtgaccccttccatttgccaccattctgttacccaagagatagatggattggtagatcaatagataggttgatcactctataaaatagtagtctgttggcacttacgtgcgtaaccagaggccatcatgttctgagactgccccagggctttttggcatctctattttggtgtctgcccctgtgtttgcaaacacactttggtatccccagatacattgtttctgaagtccatatatgcaggtatccttcattagctttgttcctctttataaccacaggttgattgctccatgtttattccgttcagtcagaaaagaaatatccaattaggacttctttcttagtctccctcctctctcccaccaccttctccttaagggattgagattccagaatgtcagtctagttaggcataaaatctgcacaaggcccaagggccactttgggtcagaggagagacagagtgggagggagaagcgctgacttaatttcacatcctggtttctttattttttcctttgctttccgtggcagatgctataatggttgaaacttcttggactgggaagtatttgcttacgtgtgtagacactgccatctcgtggtggagccatatgtcattcgtgattatttcttgtattacactgccatcttgtggcggattcgtatatgacattggtgatgaattcttgtatggcactgccatctggtggcggattcttatatgacaccgccaataaattcctgagtgacactgccatctggtggtagattcttatatgacatcggtggtggattcttgcgtgacactgccgcctagcggtagctttttatgatactgccatctggtgatggttttatatgttacatatattacattgtttcaaggacacatatgtattatgttgttctaaggacacgtttatttgtatccttagaaacttgaaatagttgaccctgctgggtgtccccagagggccgggttgggtagccagcttcaggcatggacacagggggggctcctcgcctcccctgccccatcatgtatcagctgtgctgggaacactgcagtctaagtttggcccccagcaagtcttagtaagacaaaatttttgtaagataaaaatcaaagttgtccaaacttgcaaaccagcctctgaatgattttttccttgtgttttcaatcaatcggaggaaacagaaggcaggtcagaggagtggggcaatacactgtgatttttcatactatttacgtttttgttacagttttgtcttccctggattttaaaagtcaaatgtgttatgattatgaaatacttagctattttcatctacccattagtatttgctaatcaaaacctgtaaaaatcttgactttgctcatattgatgtttttatgatattgatattctgtttaatgttgttggcttaaattctgcagtgttttcactttgtgcttttttttttttttatctcctcatgcggctcgacagaagtgctcactgtaagtggccttgggagtccccttgctcagcgttgttgctcaggccccaggcatacgtttgtgctgtggatggatgtgttcaggatggctggggtgtggccaacgacggttatcttatagctgtgcttcaacacaagttggcaattggccttattgttatctcattgttaatattcaagctgtttaagaactttcctagaagctttcactgttcattccctgtatgtgtttgtttctggaatgtaatggcgttcgttgctgtcatatgccacctggcagctctgctatgctgtggttttgactgtattttcttcctttttaccaagcactgttcacatccttggctcttagtgtctgtctgtcttgaatgatgaaaagggagtaaagagattttcacatgaacatggggaagatttgacccttgtctccctggcactgctcctgagggtccacctctgtgccttgaagccccagggcaggtgtccggggtgtggagcgtggagtctgtgctttttctcagccggggcagttgccgacaggacttcctcctggcagttcctacttccacccaccctgtgggtccagtgactcagcctgggcttcgaggattagctccttcatttctttcctctctgtattgacttctatggcaatgatgagagagaaacgtggccagacttgcgccttgggctgggttggttgcaggtgcttaggctcattacctggtgctgtttccctgcaggcatctacagctgagtctggggaccacgcgtgtcaaggctgggaatgcaaatggtagtggtggtttcctttgctgggggttgatgcagtggttgggggggcttccatttgcagttgagggccaggtgtttgggtccttccatgtggcagggataaagaggagagctggcatctggagtcatgatctgtctgagaggcagtgcctccggccaccgtaggatggaggccagcttccagccctggctgatgggggagaagcagcgaattctccagatgtggtatggcagacctttggaagattcactcggcctccacttaaccttgtgagaccaaaggccacagccccatgtgttctgcgtgctgttgaacatgtttgtatttcattggcgtggatgataatttggttgaaaggagagatggtcaccagtggactcagtttaggaaggcacaaaggtcaaccctttccgtttctagaacttagccaaagaaaagtgcggagatggaagcgggagctggctttgagtgacggtggagtgcccagctggggcttccaatttgattccgtgttccagccgagtgtgcccctccacaaaacagactcctgggctcacagttgcatttagcgcgggaagatgatatacatgtttgtattggttttgttaaaaggaacttattgctatgaggaaatgggtagaaacggctgatgaaatgttaaaaggaaacatttcaatggctatttttggctcttgaataaaatagatgtgaaagataaaaataagcatagcaggaatagcagcgtgctaacccagaagggcggctggaaggctcctgcctgcggtcactgagacagccacgcttgagccccagcttcctcccccggggccgcaggcctcccaggtggtgttttcagagaatgagtgtgggttcaactgtgtcctctgctttgaaggttgctaatttttctagggtttatttggataattaaaatgtttttttcctgagtataaaagcagtatttgttgtataaaacatgggaaatacccgacagcataaagaaggcagtgaaaaccatgacctcttggcgagcgccgctgctgttcccatcgggctaatgctgctttcctgtctcgtttgtgtgcgcggctttcagaaagtgccatttgaggggcttctcatcgtcatcttatgttctgtgtgttcattaagggggtggaaatagatttatgaatccaagaggtagcagaagttcatttcttcaattttcccatatgaaaaacaactagagcacagcatgtctccgtgtgtgtgtgtcccagcgagtctctggaacactcattgacgaagtgtgtgctccagcgtcaaggaccccggtccccggtgctgttatttcctgaccctgtgtgtgtcccttacttacagcagtgactcttcgagaagacagtgccaagaggttggagaggagggcacgccgcatctccgcatgtctgtcggattattcgctagccagcgacagtggggtgtttgaacctctaaccaaaaggtctgaagctagtcttactatttccttctccctacgcagaatcacctgtgttactggcaatcacaaaaagattccgtactgaaactttcatacattgacactttgtttatttttccaggggtaggatatttttctagcttctttcacctttgggtgattgggttttagaaagaagtctttctccctggccctgggggcctaaggcttgagtctgatggagctcaaaaaggagaatcaatgtatgggagagccctgcttttctggaaaggacattcattcattagaaatgaatttcttccctccctcccttccttgttttcgtagctataggaatggtttcacaatgacacagcgccttttggaattccatgctttattttgatcgggcatctttgatgtcattatttctttgtacaatttaagtctccggtatctagaagacagttcacttaaagttaatttttgaacatttcctcaagtattacatgtggttttgaaaggcgtgcaaggttactttcttcttttatttatttattttttgtttgtttgtttgagacaggctctcgctgtcgcccaggctggagtgcagtggtgcaatcatagctcactgcagcctcaaactcctgggcttaagcagttctcccacctcagccccacagatatctgggattatagcacacaccaccgtgcctggctaatttttgtatttttagtagagatggggtttcatcatgttgcccaggctggtcttgaactcctgggcttaagcgatcggcccgcctctgcctcccaaagtgttgggattatagatctactccaccatacttggctaattttgtttgtatttttaatagagatggggtttcaccatgttggccagactggtctcaaactcctggcttcaagtgatccacccacctcagcctcccaaagtgctgggattacaggcatgagccatcgtgcccagccacaaagtctattttcctaaaacaggaacaacataagaaataggctgggcgcggcggctcacgcctgtaatcccagcactttgggaggctgaggtgggctgatcacctgaggtcaggagtttgagaccagcctggccaacatggtgaaaccctgtctctactaaaagtacaaacattagctgggcgttgtggtgggtgcctgtaatcccagctactggggaagctgaggcaggagaatcgcttgagcccaggaggtggaggttgcagtgagccgaggttgcaccagtgcactccagcctgggcaacagagccagactctatctcagaaacaaaacaaaataaaacaacaaaaatacccagcagtttgtaggcaggtacccagtaagatgcctcatggattctgggggcccgccctgttccttcagacacatgatgacctcattgacttaacgtcacaacttaacaaagccctctctcagcacgagggagctcctgcagaatctgtagcgaccggttccctcaggaatgaagttggttgcatttacccctctgttcaggaacgaagatgccgaggagcctgcctacggagacacggccagtaacggagatccccagatccacgtgggactcctgtgagtacagaccctaccctgtttcccctggggctgggctggagactgggcccaacccgtggctcccacctgcacacacagggctggagggacccttgttacccgaggtctgaggtgaggggacagaggtggcaggaaggagtgacagggaaaagtggctccactgttgtcttccaacatggagattcacagctgagagccgccacttcctggagctgggggctccggcaggcaaagtgtggctctcggggacagttgcgcccgtgtctgccaggagttggttctgctcactgcagcacaggtagcggactccctccctcaccgtcaaggaagtaatccgctggttggcaggacaacaatttttggtttctaattacagtgtcaataagggcagtgactgtgaggtgcccctgaggaaaacagggtgtttgggtcccagccatttcctttgctcactctcgtcacttcagtccagggctcctccacctggcatggttggcatttggtcattctttgttacggggactgtgctgtacctgggctttacccactaggtgcagatgtctcctgcagatagggtggggcagaatcccaggcagtggatggccactgctgcagttgagtcagaaggatggttttacttggggggcacctgccgtccatgactcgtgtctggtttcctaggcgcgacagtggcagcgagtgtctcctcgtgcacgtgctgcagctgaagaacccggcggggctggcggtgaaggaagactgcaaagtgtaagccaggccccagggcagtggccagccagccacatggctgaggagggaaaagacagtttgggagcctgaatttccaggaaagcaccagggagtgtgtgtctgaagtgtaaagtcttcaaaagagtctagtgaatgatttgaggctggtgaaggtgccggtgctggtggcaagctagtgtgtgccgtgttggcgtggaggaagcacttgcctgtgccgtacaggactgcatcctcctggcccggggatggggttgctgatgtcgtcgtgctctgctctgtgatcttgagagacctctggctgggaccagggcatccttgactgagcggggaggaggaaataggcattgggagcagctggtgactttggcctcgatcgtgggagcgctgcctctctgagctccgtggccccagatgggggcctgatggagggtcccacttacccaagcaggtgaccatgcctgtaatggtctgttcaagtcgcagggtggggcccctttggtgagtcttctaaaggcctcaggatccctgagtgtgagcagctgggggctcggctggggttcggccaccccaatgacctctgcagtgctcacagatggctcagcccctcccatgtgccagacttggggcagggagggtgggaaatacgggctaccccatgggtgatgggcagagaaagcagtgggggagccatgcagaaaaaccagaggggcgattcccaaaaaggtggggagcagcagggcctggaagcatccgctgcttcagtcctggcttggaagtcatcctccttgtgagtgacttcccccatccctggggtacatcgttctatgcttagttgagaaaggaactttttgcaaaggactctgagactgtagccacagctgcccaaagggggctgcacgtggggggtctgtgcgcattgtgtaggtcgcgcctgctctgggactgcgccatctgtgagcgccgcctgcacgcgctcttccctcccccgttctgtttgcagccacatccgagtctatttgcccccactggactcgggcacgcccaacacttactgctccaaggctctggagttccaagtgccgctggtgtttaacgaagtgttcagaatccccgtgcattccagcgcgttgacactgaagtcacttcagttatacgtgtgttcagtgactccgcagctgcaggaagaactgctggtatggcgccaggctccgcccgccccgtcctccttccttccttcgtgtttcagtcagccggtcttttttttgtgtgtatctttctttcccttctttctcttgtactcttttgtgatgctttcttaggtttcgtatgtctttgccttttggcctccctctctctcttctgcctccatctctagttccctccctcctttcccctctgccatcctccctttctcccgtggtgggttgcttggaagttgtgatcttcttcagtgtttctgtggctggaaatacaaacagggatgatccaaccagtgatgttgtcaagcaccttgtcctctaaatgtgtcctctcaactagtactcacgaccctgtgggatgcctttgcgtcagccccatcttcagtccagggaacaaagtagggttgacagatttagcaaatagaaatacaagacagtcagctaaattcgaatttcaaataaattatggatgctctttaaagtgtaagtatttcccatgcggtgtttaagactcacagggaaaccctgtgttgtttatttgaagtgcagattcacctgggcgccctgcacgttacctggcaaccccggggcgaggcctcaggagaatccgcagtttgtcctcagtatcccagccatccaaggcccatgccagggttggaagccagggtggattccttccatggccagagtgttctgtcttggttctgtcccctcagcggcacaattagggcatgtagagttcagcagtcgtttcttatttcagaaattcctgagcgaatctgcctcatcactgcagtagagctgtgagcctggcccagcactccaggttgcccattcttttgccctttctgatcccttcccagcactttctgattgggcggaacaggcgaccagggagccacccattagactcctctgcagttgctttcattgtgctgcagtcctttaagtaggaatgaaatcttttatgtcttgtttggttaagattgaagggtagcctgggcacagtggctcatgcctgtaatcccagcactttgggaggccaaggcgggtggatcacctgagctcaggagtttgagaccagcctggccaacatagcgaaaccccatctctactaaaaatacaaaaattagccgggtgtggtggcgcacacttgtaatcccagctactcgggaggctgaggcgagggaatctctcgaactagggagggaggtggaggttgcagtgagctgagatcgcaccactgcactccagcctgggcaacggagcaacactccatcacacacacacgcacacacgcacacacacacgcacacacacaaagattgaagggtgaactggatttttttgagacagggtctcactctgttgcccaggctggaatgcagtggtatgattttggctcaccacagccttctgagtagctgggaccacagttgtacatcatcatgcccggctgatttttaacttttttgtagaggcagagtcttgctctgttgcccaggctggtctcgaactcctgggctcaagcaatcctcccacctcggcctcccaaaatcctgggattacaggcatgagccacctgccctgcctgaactggatattttaaaggactctagtcatcacggcgaaatcattcagtgcctgttctggcatttctttaatacccctgcagggcattgctcagattaacctggctgactatgacagtttgagtgagatgcagctgcgctggcattccgtgcaggtgttcaccagctctgaaccatcaaggacgcgggaggctgggtgtgcaggagagagctccgcccgggaccctgcacacaccatctccatctccggcaagacggtacttggccctgctctaaggagctgatcactgctgccttcgtgaccctgagactggctttgtcttggggaagtcatttcttagaagtgtctttgtagacgtaagtcagtatagtggggtaaaggagtagagtttccatatggccattgcatgcgaatgtttttttaatgcaaatgtgttcatggtcatgggtggtacactggctagttttaaatatgagccctcagagctgcaggagaaggccacatgaatgcctccaccacagacctaggtagggtgagtttcttctcacggaagggcagcagagtggcctcctacctgtgccatgtggacacctgccgtgtgcgcagggtctgctggcctgagctgtcctcacgcaccccctcttcctgcaggatgcggtgacggtgctcctggccagaaccacggcacagctgcaggcggtggagagggaactggccgaggagcgggccaagctggagtacacggaggaggaggtcctggagatggagcgcaaggaggagcaggccgaggccatatccgagcggtaagggctagctcagcgggcaggctccggctcatgccctccctggaaaggagcatgggtgccctgtggtcagaaggctcgtgaaaactgtcaggggggagcacattttctctggggagacagccagtgtgccaggcagcatggctgtctctgaggtgcacttgctttcctcagccatgcctccatagaaggtgctgggcaatccttaggcaccactgcccagaagtcgattctggtggaaattgagtgctggtgtggacgagggcagctccccgaagtctctctcctgactctcacgtgtgcttttcaccttttccttctgtctgtcctggagtttcttgtcgagagtgggactgttgaagcactgccctctcccaggattggatacagtaaggtcccttgaagttgttggatttttttcttttttaacacctgtattgagatataatgtacctcccatgcagttcacccgtttaaagtgcacagttaggtggtttttaggactgaatgggcacagtcaattttacagcattttattttcatcacacactctctgcctgtccctagccaaatgcgctcccaggttctcctctgattccctgcaactacaaatctgccctctgtgtctatggacttgccggtctggacacttcctacaaatggggtcatgcggcgtccctttctgcttcacgtgaagcagcctattggtgaatccttggccccgtggagacctgcatgcgatagatgaatgattccggtgaatgggtgcccctggtgccctggtttgcgttcatcgtctctggaggtgctgtacatattgctgtacttccgcatttttccataaagtgcgccatctttccagggcttcctgctgcttcccagtggctttccctgagtttagtttacagaggaatttattttggggagcgatagtgcatgcagaggggaaggtgttgtgttcagggatggacaggagttgggaggggtttggggctgagtggtgcagttttctgggatcttcagtggctgccattggtgacagagaaagcccctcttaagtacagtccttcaagagccatcttccctggaaaacagaagcgcccttttactttatgagagatgcaacagtcttcaatcattggaaagaaataggttgtattgcattacctctactactgtgctctaagagtagcatgaaatacatcccgtttggtgaccatttgggcttctgcaatgtccgccttcaggagttggcaagcggactcggtggatagcggctgtagcaactgcacccagaccagccctccgtacccagagccctgttgcatgggtatcgactccatcctgggccacccatttgctgctcaggcagggccttacagccccgagaaatttcagccctcgcctcttaaggtaagtagaaaacataggagattgtccggagcccctcaccccaaatattttgccatacgtaccaggtatactgccctggaaggagaggctgtgtgcccccaaattcttcgtgagaagtgtgaggggatgggggaagatgcaccaaaggcaagcagagccgaggctcccagggaggagagccacgtggctgacctgcacacacacacgcagtggcccgggtgttgtggtgtaaaatgggcactgctgttggatttgggggccacagctaaggctgggtttactgtgagccgaggaaaagaagtgaatggcctgagatgtgtaaagggcttgaataggcaccgctgatccattcccaccttcagggacaaagaggctctggagggtttgtgagtcccataggttttggacatttgtagttcctcttccccttttgtgaaatgtagaatagtgctgtccttttgccccttctgctcatctgctcctagctgtactgtcaccctgtctttaggggagaagtctcatgtttatagtgcctgtgaggtcagggaaggcactgtcaatgctgttttgaaactttgtttccccactgttcagctcacaaaagtattttatcaccctcacgcccctgccctcacccagaagcacaaagtgaaatctgcccccagcagcttcccaagctgtgacccacagcaggttcctagttgttgttttggaccaggctgctggtcatggcccttgtccaactttctgagatctcaaaaagcagcagcccaagccagggcgagtggccgtgggagggttttttggtgtttccccttccctcaacttttagttttgaaaaagtgaaatctgcagtaaagttgctagaataatgcaacaaatacctgtacacctcacctggatcccacagttgttagttcttcagcacatttgcattctccctttctgtgtgggcatcacagatacaacaaagttagtatagcgggtgagtaggaaaaaaaaaaaaaaaagaacacaaactcccaccctcgagagggaggcgccaaaggagacgttgctatcatacgttcatgtcacagagagcaaggcggcttctggagaatgcaatggcagggaagcgggcaaacacttgtagagaggtttgcagttttagaaagggttcacatttagaaatgtaaatttatatttacattttacaaacatcaggatgataaaagggtgcaactgctacggaaaacattatggtggttcttcaaagcattaaaaatagaaccaccacaggatcccgcagtcccgcttctgggtatatctgggtgtatatccagaagggttgaaaggatcttgaagaaatatgtgcacacccatgttcatagcagcagcattattcacagtagccaaaaggtggaagcaactaaagtgtccatcatggatgagtggataaagaaaacgtggcctatccatgcaatagaatattattcaaccttaaaatggaaggaaattctgtcacgctgcaacatggatgagctttgaggactcatgctgagtgaataagccagtgtgaatatttatttggtcttcaactctttgagttgcatgttacctggcatgcaactcctaaaatccttagaatctgaaaatctgtcgcccaggctggagtgcagtggcgcgatctcggctcactgcaagctccgcctcccgggttcatgccattctcctgcctcagcctgaaaaaaatctttttatatgctaatgagttactggtggctggctaagagaatagaaaagcacaaaaagacaaataccgtcgtgaggttcctggagtagtcgaattcacaggggcagaaaatagaatggtggctgccaggagcttggatggggtgcggggatgtgttacagaacggaactggggtccattcgcccggtgcagtaaaaccaggtgtctgcacgaaggtgttttgcactggtggaaagagggcatttatttgcaggtgccaagcaaggagatttgggcagctcacatttaagactcagcctccccatgccttgcagggaagggtttttaaaggcagaggtaaatttcaggaaagcggcagtcacaggcaaaatcctaaaccaatccatggaggttacacgttgcttttggcctagaaggataggatatcttaatgtgggggcttacaggacgtagatggattcaaagattttctgattgcagttggttcaggaggcaaagctttgtctaaaaatttggggtcagcagaaaagatagttagctctgacttgtaggtgtgactccctccagacccctcaggaagagattcagaataaagagcaagggtcagagtgcagtcctcagctcccccttatctgagatctgtgccagcgggtccctttggtgggggtctgggtttctgaaagacagtcggggacatatgttaagatgtctttggtttctttttttcttttctttttttttttgagatggagtctcgctctgtcacccaggccgcagtgcagtggcgtgatctcagctcactgcaacctctgcctcttgggttcaagcaattctcatggctcagcctcccaagtagctgggattacaggcgcccaccaccatgcccagatgaatttttttttttttttttaagtagagacggggtttcatcacgttggccaggctggtctccaactcctggcctcaaatgatccacctgccttggcctcccaaagtgctgggattacgggcgtgagccaccgcacctgaccaagatgtctttagtttctctaggcaaccaaacatctccagactctaacttccttggctattgttttaggctactattaccttcttgcttatcaggttacttacttacatctcagggatagcgaggtacctggaatttcccttgaaagaaattgattttcctttatttccatgctcgggaggtctgcaggcccctaaaatggggtctctgctctatctcaggagtgggaatggggagttgtttagtggagaggacagagtctcagatttacaaggtaaagaagttctggagatctgttgcccatcagtgtgaatggacgccactgaactgtgcctgtacaaatggttaatatggtaacttttgttgcgtgtttttttcccacaatattttaaaaaacagggccctgaagggcctcactgagaaggcagtgtttgagtagagatcgtcaaggaagggagctcagagctttgtgcagaagcatgggcaggtgtgggagcagccagtgtgtgttgtggggcggtgctgaggacgaagggagtgtgttgtggggcccactcaggacccttccttttctctgagggcatgagaagctggtgggttttgagcccagtggcaacatgatctgaccgtagcttttttgttagtgctttctaaaatttattgagttgaagttcacataaagggaagcattttaaagtgtatgcatcagtggcatttggtccacagtgttgctcacccgccacctctatctagtttcatgacgtttcaatcaccccagagtaaaacccgtccccattgagcagtcactcccattcccctccccctagccacctgcagccaccaaaatctttctagctgtgtggatttacctcttccggatgtttccagaagtggaatcatatactatgtggcctttgccgcatggcttctttcactcagcacgatattttcaaggtttatttacattttagcgtgtataaacactccgttggtttttatggctgaatgctattcccttgtgtggataagaccacatcttgttgatccattgatctgtcaatggacatttggggtgtttccacatttggccagttttcctgggatgtccctggttgctgtgttgagaatagatcgaagggcagagaggtgtggaattgggaagactggtgaggcacctactgcactcatccaggcatgagataatggcgactcaggtgaaaggttgctgacaagtgctcaaaacccccttgatcttgaacacagagccagcagggatcgctcttggaccagatatggggtgtgcaaaagagatcggaagtccgggatggccctaacgttctttgcatgaacaaatggaaagttgagatccctgtgagaggaggggccagggtggggttggggagatatcagcttttccattgtggacgtgccacatgtgaaacgccagctaaaccccaagtggagaagtgaaagacatggttgttcccataagtttattgctcacattatgaaagaagccatagtcatgagtgaaccactccctaggttgataaggaaaccaacacggaagatctctttctggaagaagcagccagcctcgtgaaggagcggcccagccgccgggcccgagggtcgccttttgttcggagtggcacgattgtccgttcccagacattctcgcctggagcacgaagccagtatgtttgcagagtaagttggaatccctttgtcacctgtctggaatgttttgtcttccatcccctttgtgattttttttttctgctgttcatactgaaaggcatatgtatttgcaccaataataccaatccatgaactatgaactttataggtatgcggtgatgacattggtgttgtgatctccccgcatgtcctaccatgcttatctgattctggatttgttcaggattcaaattcatcccttcccccagttttcagtgttgtgtatgtattgacctgtggggcaggaagcagggcgaatcatttctacctcagcctaaggaacaagtggaagcaggggccctcttgaatgggttgagctggaggagccgggaacctgagtggcttggagccctgtggggcagccaggtttctgggccagagggtggatggtcctggcaaaggggcagtgggttctcactcacccacatgtaacttcccaacctgtggatgagtgggaggcgctcagcggttctcagccatggctgtgccttgcagtcaaatcatgtcgggggattcaacagatcctggtacccacatagcaccccagagatttgccattggtcacaggtaaggcctgggcgtcagaacttccggaagcacccagatggttctagcatgtcacacaaggctgagaaccccaaggtgggtagagggaagatgcgagccagtgtggtcaatgaaggtaggacagagtgatagtgccagcatggacttgtacagaaagggcttttaaggatgatggctcatgacacagtgacctggaggggccatttggttgagaaccatgacccttcctgcacctctgaattggggctgttgaagaaggcatctgccctggaggtgctcgctccatgagggcagagccaaggcagatcttcggagagggaagggcctcagaccctcaaaggagatgtggcaaacactgtgggagggggcctaggtggccaaaacagcctctcagccatgttggtgagacccgctgctgttgtcccattggtctgaagtgtccctgctggcagctgccccaggtggcgccgcgtccggtacaggccctcccacccgtcacacttcagccccgtggaggctgatgctcaagcgcttggctggacgctctagatggaaggccacgttcaccgccctccttgttccaggctcctgccgagccaccaacgtgtcggctggcggggctgcttattgaggcggggagggtgcaagcaggtagtgttttgcttactcagaggaaatgctctgtgtgcctgcgtaacagctgcacttactggcgatgcttctggatgcttcgctgttctgtatgtttgtatgaacgccgtgcaggtatgctgccaggccgctgcacttcctgaataggtttactggcgtggaaaataaggccacgaaggcagggatgttggatttcacacagattgacactgatcctgaggtgagaccctgccaccaaaatgaaggctgtaatgacttggctcccataaagatgacattctttacttcctgtttaaaagcacgccctgtcctttgatgggcacagctgcagttggcaatgttggcttgtcctactaccagaagtgagtctcttttttggaagtcactttccccagctattgccaaagccacaaatacagcacatgagaaagactgaggaaaagtgaaccgtgctgagggcagcgctagccttcatgggggctgtacagggcacaaaatggcattggtatcgatcacacagagattttgttggctcagttagcctggaaactgggggagggtttcgtttgctttgtttttgttttgttttgttttgtttttttcattttagcagaaactcttctttaaattgaaacccaaagacctgctacaagcaccaataatcataagtgcactcgagggcctgtgaagaggatgaaaagaatccattctgagactctgactacacacacacaatgaactgtgcattgctgagaaattgtttctgaacatcattcttttttgtgcagctttatcgtagtgacagcgacagttcaacgctgccccggaagtccccctttgtccgaaatactttggaaagacgaacccttcgctataagcaggtatgtgccctgtaaacaaatatggaatctgtgcttgccctgcgagtgattttacaagccttaaaaaggtaacatttaaggtcatgtaaatgaaaaggtagtatttctatttcttgtttacttaacagatgtaatgtcgtaatgttgctaatatttcttaagatagtatcatgatttcagataatctgtgatctttacattcttcagtataataaataaccatttttatataataggctgttttctctttttttgacaggagagtatatatagtttagaaaagttgagtttttcaacatgttgcttttctgggcagggatcgtttgaataatatatatatatatatatatatatatatatatatatatatatatatatatatatagtgtgtgtgtgtgtgtgtgtgtgtgtagagaggaagagagacagacacacaaaaaacccccaatttccacgtggcagttgtgctccaccacatacaagagtggctgctgactgggaagaataagaaagtttataatttgggccgggtgcagtggctcacgcctataatcccaacactttgggaggctgaggcgggcggatcacctgaggtcaggagttcgagaccagcctgtccaaaatggtgaaaccccgtctctactaaaattatgaaaattagccagacatggcagcacgtgcctgtaatctcagctactcagaaggctgaggcaggagaattgcatgaacccgggaggcagaggttgcagtgagcttacgtcatgccactgcactccagcctgggagacagagcaagactccgtctcaaaaaaaaaaaaaaaaagtgcataatttggcttcagaagtgtctctcagcagcaccactgctggcatttcagacaggctcattctttgctgtgggggctgccccgtgcactttaggatgttgagcagtgtccctgggctccacccaccagatgccagtaacaccccatcacatacacagcagttgtgacactcaaaatgtccacagacattgccagctgtcctcccgggggccagattctcctggttgagaaccatgaagctctgctgagaattcagcagtgcttttaaagaatttatatttgttaagttacaacccatatttgcatttaaattctgtgtatgtgcaaaatagcgttgtgtgtgtaaaaagcataccgtgactcaggccactgacccatggtgattggcgaatggatttgtggttttgctgcggtgactgctgtctcagggttctgtttcccattggatgggaagtactgctctcagttccgcagacaagagtcttttccctgtcagggctttcctgagcctaggtatgtttgcttacttgaggcttatatggggagggaagctttggacagcttgcatgtgtgtgtctgcgtgtttgcgtgggagtgtgtatactattttttaaacaacaagcactcatggtttataacgtactttctttccccttgtacagtggatcattaagatttttccatgtccatatatttttttcaacttgttacaatggctacattttatactggccttgtaatttatttaacgtttcctgctgttatagacttacttttttttttctgtcataaaccttaattggaccacttttgcatgtcagcagttatgcctttcagatgcaagtttgctgtagacatatatatattctcaaatggcccttcagaaagattgttccatttttgatcctgccagccccatataagagcatctgttgctgcacatttctgccaatacataggtcatcattaaagaaaaacaatttgctgttactaaccttgatactgaactagagatttacattcctcttgcccacatctgtgttttttaaccttgggcgtgcttagagaaatacgtgtgcctgacctgtctcctattaattgtggaagaaccttctagaaggcctgagtgagggctcacagctggcgtctcttgcagtcatgcaggtcttccctggctgagctcatggcccgcacctccctggacttggagctggatctccaggcgtcgagaacacggcagaggcagctgaatgaggagctctgcgccctccgtgagctgcggcagcggttggaggacgcccagctccgtggccagactgacctcccaccctgggtgcttcgggacgagcggctccgtggcctgctgcgggaggccgagcggcaggtgggggtcccctgtggccagctcccgcctgcacctcactgctccctgctccaggctctgaagggagcctcccagacacagaggtggtccctgaaataccccaccactgggctcttggagtcccttctccctctgtgggctgcgagggtggcgtctgtgtggcttctgcgtgcatctggaggctgcgggtgctggaggaggggtcacgggccctccccaccttgttgggggaacattctgggtccccagtcgctaggcctgactccagccaccccctggcctctgtctcctgggaggaattccttggggggagtgtgggtgaggtgggccttactccctcctgtcaccactcgctgactgtggttggttcttctgggctccagggttggcagtgaacttactcattcttccttaaaaaaaaaaaaaaaaaaaaaaatcaataaaatcgtcttgttggtccaacgttgctgttccagacaagacagaccaaacttgactaccgtcatgagcaggcggctgagaagatgctgaagaaggcctccaaggagatctaccagctgcgtgggcagagccacaaagagcccatccaagtgcagacctttaggtatggcggaggcgtggcaaggccggcccctcggccctgcttcctccttactgtcgtgcctttggcatggtaaaaaagtacagtgagtctgtttttgtttttcttctgagacagagtctcactctgtcacccaggctggagtgcagtggtgcgatcttgtctcactgcaccctctgccccctgggctcaagcaagtctcatgcctcaacctcccgagtagctgggattacagatgcgcactactatacccggctaatttttaaatgttagtagactgggttttgccatgttgcccaggctgatctcaaactcctgacctcaaatgatccacctgcctcagcctcccaaagtgctgagattacaggcgtgagcccctgcgtctggccgtgtgagtctgtaaaacccctgggaagttgagaacaaaacaggaatccactgcagccagtagtgtattttcatgtttttatcctgatctttttttcctacagtttttttttcatgccacttctaatcataatgcgggttcagtttggcatttagcattttttaaattaaaatattccatattgctatataatgtgctatcttgtttgactgtaatgtctcatctaatagtttactcaaccactatattttataacatgctgctcgtcttcaaatgtttgctattgtaaataacagtgatatacatacacatacatatatgtccccccacccccagacagggtctcactctgtcagccaggctggagtgtggtggctcagtcatggctcattacagccttgacctcccagggtcaagtgatcctcccacctcaccctcccaggtagctgggactgtaggcacatgccaccatgccctgctcatttttgtagagatggggtctcactgtgttgcccaggctgatctcgaactcctgagctcaagcgatccacctgcctcagctgcccaaagttctgggattacaggcatgagtcgctgcacccgaccacctttgctttttcagttaacttttgattaaggcaaaatgtatctgcaggaaagctgcgtatcatacacacatggtccagtgaattgttacaaactcgtcctaagaatcggtcattatcagtgcccccagatcccacactagagtaaccaccaccttgaattctaatagtatagattggttttgtctgtttttgtttttgctgaggggatttttacagatgcatcagtattcttttgtgtctgtaaaaaaaattaagttgaaattcacataacataaaatgacccattttaaagtgaacagttcagcctttggcgcattcacaatgttgcacaaccacccctctgtctagttccagaacatttttaccaccccaaaagtaaaccctatgcccattaagcagtcactccccgttctccctcccctagctctgtctctagggatatgcctttctgcctgtttcataggaatgggatcatatcttacgtggacttttgcatctggcttctttcctgcagctgagggttttcgaggttcatccatgtagcctatgtgccagtgtgtccttccttgttaagggcgaataaaatgtgtcttttagccctaatttttgtatacatttaatattcacatagttttcactttttcattcatttgttaatacgacaggtatttcctgagcacctaatatacaccaggcactgttctaggtactggagatgaagaaacccctgctcttacggttcttcataattaacatttggagactctatacaagcacatgtgttgttggggacttaaattcagtttgttgtatgaataagaaaagccatgattgatatgagagccaccagctttccgtgtcttcatatcagcttctgacctgtaattgtctccggtcccagggagaagatagcattcttcacaaggccaaggatcaacatacctcctctcccagccgacgacgtctgatggagtgcattgtgcacatgaagtatttatccacctgttttattttcatgaagttcttagactagctgaatttgtctttaaaatatttgtgcaaagctattaatatacacattttgt

SEQ ID NO: 2984 - DNA, 75220 bp, human
ctcgaggatgctgtccaggtgggcggccgcgggcgcgatgcggcactgcaggtaaggggcgcgcggcgcctggatgccctccccggcgcccccggcagcgcggacgctgcaggtggagcccggcccgcgggcctgcagcccggctgcgcccccagaaacccaaagtggggcctctggctgctgcggcgcctgctgcccacagctgcctgctgcagctgcatgcacccggccggggatggcccgtggcaggcccacgcgtgacttgggtcttggcgtgcccgccccgagaaagcgggcaggggccagacagaaagacgggggagggaaaaaaccgctccggcgggggaacaaaatctgaagtgaccacactgcatgcattctaagtagacagaggggcttttaagaggtaactatcaagtgttttcctagtgtcattctgcttcttaaataacgacatgtttactaattacaggcctttgtcctcagtaattagcctcatttctttcaaagcaaaagcgggctggggagtggaaacttcttggttagcaatttaagagccagatgtgcaatctaaattgctttgcattattttgcaaggttccagcatttacagggcatacgtcagaaacgtattttttttttccttccaggtgttttaagtagattaaaaaagaacggtatccaatacaataaaaataaattgcagcttccaaagataacatgtgagcgtaagagacagctacatctctaagaaccaaatgatctttagcagagagtgggggtggagataacaccaaaacctaagaattcccagagttcttgttaattctctcgctgataattcgcttgctgaatggagaggcttgatgacagcgccagatggaggggtcaggtgacttcagttctagcatgacagtgggtgggggattttaatggactgtttctagagcgtttacatgcctttctcggggtcaggaagaaactacagccaggacgtgtgggggcacccttagggggagaatgtggcattattttcccctctaaaacctgacccttctggaagctttgttgtcactaaactgtattggaactcacatcatgaataatttgaccaaccagcaacgttggggggcctgtaaagcaatgctatttccatcaataattgaaggaggcatttctttcagaatttgggacacccagatgtgttgctgcagtaatttagtaacttgtttattgcaattttcttcctttggttcagtttggttacacaaattaagatccccgggtccccgccctcccttctcctccagcccaaccctagatagagcaaagcagatgatagaggtggatctaatacagacctagattccacttttggctttgtgactgtgcagccttggatatgtcatttagtgtctttgggcctcgactatctcgtcctcaaagtaacaaagggatttaggtcagggtgtctcaaccttggcactactggcatttggggccagataactccttgtggtgaggctgtcctgtgcattgtaggatgtttagcagaatctccgacctccacctactagatgctagtagcacttccccctcccagcccccagttgtgacaatcaaaaatgttgccagacattgccaaatgtcccctgagggctcccttgccccctgttgagaaccactgattgagatgatctcgaaatattcttcttcgggctccaagaattcattttcttatgattggtttgatgccaagcccttgatcagaaatctgattccctttcttaatatcacatatattggaaaacacaatgtgaaggcgtttttatgctgtgaatttccagaaatagcttctgtgaaaaggggaggagctgtttgtatgccatttgtagctgggaggcgagcttggcagaaaggagagtgttagggaaagaggaaaaaaacagagcactagatgaacgtgtgtggaaacctgccggggcttcgtgctcagcagacctggagcacgtccctggacgtagtctaaccctgggttagacctaacagctgagagtccatttccttgtctgcaaaaatgagaataacagtgtccactcggaggtgttgtgaggatgaaacgacacgacatctggtgctggtgggggacgtggtgaggacgagagggtggtaatgtctatgcagctaggaggaggcaaacacaaatggcccgcaccaccagcgacacggacactcgcttgggcagacatggtcgcatgctttaagcttcagtccaggactaaagatctggctttgacacctaggagggtgaccgtggctgcatcacttcaccctgcagagctgctgtcggatctgtaaagtggggccaaccgtgcttgctgactctgcttccttggctgttggggagggacggatggaagtgagagggtctgcaggctgggaaactcccaagagacaggaagcgggggtggcagcagcatagcaagggggggacatgtttactatgtgtgtgtatgtggtggtggtggggtgcttagaatggccagaaaacatttccttgtgccccaggctttggactttgatgtgtccctcccctgggttccctttccgttgccatcagcttgctctctctctctctctctctctctctctctctctctctgtctgtctcatctttcctggcaccatgaaaatggtctcctggggggagataggaaagccctggtgggggaggttggccttcggtgaggaagacccactgtgcagagggctagggtgagagcagctggctccatccactccccacgccactgtcctcacaggcttcagtccacggacatcccagggcaggcctgtcacgctcctgtgtgcctccagtgggcttggtgctctgtatgagccatctggccttgtctcttcaacaaggtaatatcatgaaagaaatttttaaaaagggaggtggggtattctccatcaaacgagacttaagagacggaatagccaaatatcacttgtggccctcgattggattcggcccaaacaaacgtgtaacaggcattttggggatgcctggagatgctttgatgtgactggctattaggtgacactaggagactgctgctgctttgattagatgtgacagtctgtgatgtgttcggcagcccctcggacagatgcagtgatccccacccctggcagctgcaacttggcatcaccctctcccctggggtttggtctggaccaagtaatgaacttccaatgaatacgtctagcaaggggtgggggagaggcacttccaccatgagggtgtaaaggggcttctgcctggggtgtgttttctctcttgggttgcttacactgaagctgccatgtcgtgatcagccctacaaaagggtccatctgccgtggtgaggacccgaggtccattccaacagcctgagaagaactgagacccgctgacggtgtgagggtgtgagcgggctcggaggcagacccttcaggcccagttgagtcttttttttttttttttttttttgagacagagtctcggtctgtcacccaggctgcagtgcagtggtagcgatctcagctcactgcaacctccgcctcctgggttcaagcgattgtcatgcttcagcctccctagtagctaggaatacagggacacgccaccacggctggctaatttttgtatttttagtagagatgggattttgccatgttggacaggctggtctcgaactcctgacctcaggtgatccgcccaccttggcctcccaaagtgctgggattacaggcatgagccaccacgcctggccgcagttgagtcttgagatgcttgcagccctgtgagacaccttgagctgaggcaccagctaagccactccagggttcctgacacagaaacagtgacatgatagatgtttgtgtcctgctgctatgctttggggtaagttgttaggcagcaatagatagctaatacatgtgtttatgtagaaaagtcttcttgtttagagatgtatactaaagtgtttagagatgaagtgtcatggtagcagtcatttactttttttctttttttgatgttttcttgagatctctttaatgtatgacttaataggagacagatgaattctcatacttggttctacattcaatctgtttcaatatcgcatgtcatgtagcctctggaaaattccattgtatgctcatgagagaatgaacttagaaaaaggcaaataacaatgtcagaatattgtgaaatgtttttgacatcatggactcccttaaagggacttggggagcccaaggagtccccagatgacactttgaagatcaggcttcaagatcaataatttacttttaaatggttcagttaaatgaagagagagaaagagataaagcagatagagccaaatgtgaacaactgttcagtctgattggtgttattcactggattcttctggatgatgttctgtgtaattgaaaatgttcataataaaaaattaagaaaaaaagaaaagaaatgtaaacccttagacacactggggattctgactgaataggtctgggggtgaagcccagggcttaacctgtgctccaggtgcccccatcacatgggccagaggccccagccactttgccccagaggtcctcgccttacctgcctcctctccacctgtcagccttgcagtagcagaccaaaggggtttagtgtgatgacgcatctcttctaccaacctgggggaagaggtgtgtggggacagtcccccctcctatcccttcccccatacacactttcccttggtaacaagacctttgtttaaccacattttcagtgggtggcttttttatgtgcaggaatttttttttttttgtgataagtatttttttaaatgactttcatttcttttctttttttttttgagatggaatctctctttgttgcccaggccggagtgcagtggcttgatctcggctcactgcaaccttcatctcccaggttcaagtgattctcctgcctcagcctccttgtagctgggattacaggcacgcaccaccacgcctggctaatttttgtatttttagtagagacgagtttcaccatgttatccaggctggtctcgaactcctgacctcaggggatgtgcccgcctcggcctcccaaagtgctgggattataggcttgagccactgctcccggccccttaattacttcttcattcagcaaatattccttgggtctgtgcgtctaggccagggtttctcaaccttgacactgtggacgttagggtccagatgattcatttttatggggggctgttctgggcaatgtagggtattgagccgcatccctggccaccatccactagatgccagtggcaccccatctcccagttgtaataacaaaaaatgtctctagacatggccaaatgtcccctgggggtcagtattgcccccagttggttgagtcctacaagtctaggcagtgggatacatgttaggaccaaatggacaaggttcctgccctcacgggactgatttgagctgagggaagaggaagtagctgttggataggctgtgtgttgagtgaaaggatggacagcaaaggatgcacagcactggactccaaacgctggtcagggagggcaagaaggcctctctgaggggtcgcacttgagcagagatccgaatggagagagagccacttgagcacggtgggctgagtgctcagggctgagggaacagccagtgcaaaggccctgaggcagggcaggacaggaagcgtttgcggaaagcagggagatcggcgtgtgcaaagtagagctacccagagagtaggggtggggacaggtgctcagaggggcgcagggggcaggccatcctggaactggcagttgtggtgtcaaccctggattgtcctcagtgtgatggaaagccactggatgctcctgtgtcggggagtgacatgttgagactgggttaaaaggactggctgctgtcaggagcagagtcagaggtgggtgagaaagaaagcagggcagccagcaaggaggctaggaggcgaggctggaggccagatggggagtggccagggtgaccaggtgagttggactgaggagctaacctctttagcagcaatgttgtcctaggtgccagagtgggcccttggtgatcaaagaagcctggcgtgggagggtagtgtgaactacagggcaggacatggaggctgcagacgtgtcctcatgcatccggctcagtcgcagcatcacctttgatgggcggtggcctcccagggacagcagaggaaatggccatgcacattcccacatgacacctgaaaagctctctttcccgcttcttgtcgtggctgaagtctcccaagctgtcaggctgccggtggctccggtgattctggctacacagcttgcttgctgtcctcgggcccagcacatttgttcctgccactgagtctctgaattggctgttctctgtggctggagggtcaacccccacacttgttcccttgttgccttctccaagtggccctggtcgccctgcaccgcctgtcacgtgcgcttctgcgggatgcagtggcctgcaatcgggggttcatggaagcccctgcctgctggcttgccatcttcacactgttcttgacgtggtcctgccctgccccagggcctttgcactggctattccctcagccctgagcactcagccccctcgtattcaacagagagcctgctgttggctgggttgaaagtagatgtgagaccggagccttcctcacagaggggacttgaacccctcttgaagctgcagaagaggagagtcctggaaggctggggtcaggcccttgacctgccctggggacgacacatgggaacagcagggtcatgaaggagaggctgtgggtgggcgctccccctgagggtggtgttcccctctttccatctgaggcagttggggcgcccaggatgggtttggggtttgctgatgtgagagctaccccaacgctgtgtttccttatgggggaggctgctcctggtcctgggtgctgggcctgcggctcctctctgtggctgccgctcccctgagccttgcccgcagtttcgcgatgcttcccgatgggctgactgtgtcctcctatctcttggctcttcacttcccttctgggttgatttggctaaatatgaaagttctttttcgccctccactctaacccctggaggtgctggttgggtgaaaaggcctctgtggttagcagatagccgagagattgttcctcttagcttagtcacgcatcacaccagctcgccttttaccccaaacatggaattggctcaaatgtcagcccgtgtgttggtcagagtggcctgcctctcttcaccgtggcgtcccgggccaccaggaacagcacatgaacgcggttttgggtgccttccagcatttaggctttacacacttgccagtcacgagtggctcctgaaattttctttttatccatgagggggtgtgaaccttggataagcagaaaataggttgttgtggagaaaacctgtcagaaaatggtgaagggaaggccaggctgtggaggtgccagaagagcgagggatttcccacctgcactgtcttcagcagctgtgatggcttgaactgtgtccccaacaaattcatagattcaagtcctaaccttcagtacttcaagacgtgaccttatttggagatagggccttgacagaggtcatcatggtgaaacgaaggcatcagcagcgcgcgtcccttcatctcagacttctggcctccggaactgggagaaaacccttttctgttatctgagccacccagtccgtggtgcttggttacggcagccctagcaagcacgtgcagcagcatttttttgtggatgcatgagagcgcgacccaggggcctttaattaagctattctcacacggtgtaggagaaacgtggcccccagtgccctctccatggaggcacatggctctgggtcctgaggtggcagaggcctgcctgctgttgtggagaaaggcccctgggacctgggctggatccagctgccccctcactgtgtgtgagacttaacctctgtgccgcagtttgcttatctgtaacttatctgtaacgtgggcctgagggaggcggtacttcatacacgggggaagtgcttagaatgaagccaggtacacggagccctgtacaaaggcgttgtgactattattatgggaagaagtctctggggaaattccaaacccttggctcttggcaccagcaacacaaacacctcacagcccagccctcctgtccctgggatgggggtgtgagaacactgaggccattgtgtcacccgaggccacatgtggttggcctcatcctatttccaacacgtgggctgggtttcaacgtggaacgaatggctgcatggccctgggtccataggaagcctgccatggtcacacaacagctgcctagtcctatggaagccagactgtgattgaaggaacacagggagtgctgggggcagggccggggccggggaggaagtgggaggaggaaaaaggaagtgtctccgctggttcgaggcagaattttgaaacaggcacagtttctttctgaacatccttttgctctgagcttccccctgtttgaaactccttggtcgtgtggccctccacccctcactgggggccaccacctggctcccgtcactgtcagtgccttcctgtcttctcccctctggtgtttggagggttagctagaaggggtggaatgagtcctggccacctcatcatcctaaaggtgcccgcattttaaaagcaagactcaaaatgattacaaatgaaaatgaaattcctggggtttcaggcaaggtggaataaggcagtgaaaagcttttgtattggagccagcctccaagatgggcctcgaccatcctacctccaggtgttcatgctcatgtgtggtcccctcccatatggaaccattcagggctgacctgtgtcaccaataggataccgtggaagcgacagtgtgtgacttccaaagctaggtcattagagaccctcctggttctcttggaccaccccctctagagaaagccaactgccatgtcgtggggacattcagggtatcctgtggggatgccagcgagcaagttggttgctatgtgagggagcccccgtccaactttcagatgacagcagccctggctgacatcctgaccacaacctcctgagagacgctgagccagaaagacccagccacactgctccccacttcctgacacatagaaaccgtgtgaatggtcagtgtaaatggtaattagtgatgcagcttcagataactgaaatgactagtaatggtccaaagctttcttggaggggaggcccagtgctggtctctccttgggtcagctccccaggctctggccatagctgccttcgttttgccccttctgaagctccacttttctctgatcgttccatatttgttcatggtattttctctctctttccttcctaggttggagaggagaggagcttcatgcaaagtttaggtctattgatgataaattagggcatattgaggatgagtttggatatatagatttttagtaaatgggcaacggtctgtatttcatgaaaatgtatatcctgtgtatctctttatagcctggaggcttcagtaaaatattccccaaatgccagtggggtttggctgtctgggcgttactttgggcattcggcctttgcagatgcgggatgtcatttttgatgcgagcagcccccttttcctccagcaccagggaaacacgccacagcctgtaatgcaatgtggagcccgtgtcctctgcccgctgcacaggggatttgccaactccagcgcctttgctttgtcagggctttcagacttctgacctcaattatttcagtgggaggtcatttttgcaagagaggatgcaatgggtgtttgaaaagagaaagtatttcacgggcacttcaaagaagtgttgcaagcatgccaatgaaaaacctcacttttgtaaagtgaagcagtgagatttaactccagctgatggcttgtttgggttgcctttggtcaacttttaattgaaatccatgtgcagaaaagtgcacaaaaggtaagcgtgcagcttgatgaattgtcacaaggtgaacacacctgggtaacagtgcccagatccagaaatggaacatgaccagttcccagaagccaccctcatgtccccttccaagggtaactgctatcctgaataacgccactggttccttctgcttgtttggaactttatagggatggaatctcggatccctttgtgtctgcttttctttgtgtctttcttttacttgacattaggcttgtgagcttcattcttattatgggatggagtggtacctctttcctcctcatagccctgtatagcctaatagctttctttgtatgtaaagtgtctcttttctgtcactgcttttaagagatcttctttttcacttgtttaacagttcgattatgctatgccttggtgtagttttcttcatttttttgtgtgtgcttggggtttgttgagcttcttctatctataggattatatagtctaatagtttaaatctttgtgtaaacaagatttcctatattgaatgttctggtcagtgtatctacatttatttccgagaaacttcttgagagagcttaaagggatttttaaggcagtttccctctcaagctgtcacctcctccacttggataaaaacagtgaaggatttgtcttgttgggctgataagaaaccgtcagcttgtggtgcttttagcctctgttatgggtccagagtccactccctcaggctccattgattctgtgtcgaatgcctgtggctggatatcaggaggacacctgtttttgtcagcccaactcttttcatgagtgaaaagtaacaagggaaacaagatgaattcagaaaaacaaacaaacaaacaaacaaaaccagtaaggaaaggcaaggtatgcccctcagacaggcattgctacaaattattatcatgtctttaaaaaaatattttctgtttttctttttaaaattttttaattttgctacaaattataaaactggtgggtgatggtggacgtttcaaaaccactcacgtgtgacatggcagtgacttcaggctggcctacatagccttttgttctctgtacatgtacagataaaaatctttcttgattctttttttttctttttcttttcttttctttttttttttttttgagatagagtctcgctctgttgtccaggctggagtgcagtggtgttatcttggctcactgcaagctccgcctcctggattcaagcgattctcctgcctcagcctcctaagtagctgggattacaggcatgcaccaccatgcctggctagttttgtatttttagtagagatggggtttcaccatgttggccaggctggtcttgaactcctgacctcaggtggtccacctgcctcggcctcccaaagtgctgggattacaggcatgagccaccacacccgccctcttatcttgattcttgagcatgtctgtgcagtgatgtccaaagcattcaatagctgactacttgatagggttttatatctattgatggatatagtattaataacactccctgtagaatagaggtagtatgtgtgcctggctaagctttttgtggcttagtggacactatttctatatagcaacattcagcaaacacttcattttatgcaggtccggatagtaaatagagatgagtaacataagcctttgccctcaaggagctcacagccaaatatgggaggaagcatgtttgtaaataatcacttgaacaaaatgcagtttctaaataagattgatgttaaaaatattaatataaacaatattaaaattttagtgattaaaacacaatggcaaggatgcaggtcatgaaatgagtggaaaataggaagggaacaaaaggttatactaggccagtggctcttaatgtgcgcccttggatcagctgcagcagcctcccttggaagcttgttagaaatgcagattccccggccccatccaagccttgccggatctgaagctctgagggtgggacctgacagtctgggtttccccagccctcctggtaatgctgatgcacgttcaagctgaagaaccactggtttagacggtgataagccaccagggttctgtcgggaagcctaggacaggccattttagtgcccacgttgtcccctaattgccagaagcctcagcacagcttggacccttttgttaggggactgatgtatgtcggcaatcaataaagtatattagggagtttttctgaattttttttgagacagcgtctcgctgtgtcacccaggctggagtgcagtggcgcgatctccgctcactgcaacctccgcctcccgggttcatgagattctcttgcgtcagcctccagagtagctgctgggattacaggtgcccaccaccatgcttggctaatttttgtatttttagtagagacggagttttaccatgttggtcaggctggtctcgagctcctgacctcaggtgatccacccacctcggcctctcaaagtgctggggttacaggtgtgagccaccgcgtccggctctgaattcttaaatgaagggaaagttttactttgcccaactagtacagcttactactttatttcttttatggattgtgtttttgatgtcatttctaataactgtttgcctagccctaggttttgctcatttgtgtaggagaggtaaagatcactcacatgggtttacacaggcaagggcataactggctgaagaaatataaaatgccatgtgatgctgccttcgtttgggtccttgcagaagtggaacttgaaattaggtttctggtgcaagttgatttgggaggggagtggggaagtgagaccaggaaaggaaggcagccattagggccgggctgttaatgtcacgcaatgggcgactggagcttaattccacactttggaaactctaggaaatggtgctcgctgtgtcatgggcccccaagatcacctctgggtctggtgatttcctaggagggctcataaaacttgacacatggcatatgcatggctatgatttagtaaagcaagaggacacagagaaaaatcaacaaagggaaaaggcttatggggtgaagtctggagaaaagcaggcacgtgcttccaagagtcctctcccagtggggtcacacagaacatgcctactcctgcccatggtgagttgagacaacatgtgtgaaatgtccaccagggaaggtccttagagactcagcgcctgggatttgtattgggggctgctcacataggcaccctctgcctagcacacatcaaaattccagactcccagagagaaagcaggcattcagcatagatcacagtatttggacaaagagtttaggcacagtgagccactcttaccagctctgggaatggtgggaaccctcccaaaatacaaattcccagatgccagccaagggccaaccttgcaaacaggcctttctaaggagagcagtctcaggtctgctatattacgtgttttctgcacaggtacaaagcacatgccttgaaataatctcattcaagggacaagggagtaggacatttgaagatgtctggttttctccagactttgccccgcaagccttttccctcgggagtcagttcttgagagtcatcgattaatacctattcccaataatgcacttcaggcatgccatgtaagcagagccaccttctgtgggtctcaaaacaatgacagtgaccttagactaagcgatatggttggaaattagctagagcttactggaaggttttgagtgatatgagtggggcgctggcagcatcagatacagtagttattctagaaattggatggggacaacagagccatgtgtatagggtagttcgcatgcctggggtcgtgtggcagtattgtaactgtgaatgaagagaccgaggtcaaggcttcgctctaacctccttaggtagatgcttccttcctgtgtctgctcattggaggaatgggaaagtgtgtgtgtttgtgtgtgtgtgtgtatgtgagagagagagagagggcatgcgtgtgtgtgtgtgtgtgagcattgtgggggcagaaaatcctggtacactagctgtattttaaacttccacttctaatctttcagttctgagcagcgtgaataggcagataaacaaatgtttgctatagcctcaaacattcatgccagaacatttttttccctccttccacacaagtaaattaagagaacagcggtctgttgtataatttgaagatggctattaatttgtgttggattgcatttcttaagcatgttatgttattcgaggagcaggagaccctggaggaggcgcttgtggggaagctttgaagctggagcaggaaggagtgaaatgacacagtctgatgacgatcacggtaatgcaggccttgcagcctggcgacattcttcaaaggcaactaactgcaagactgccctcttcccctcccctctcagacatctccaagaccctgccaaccgccagatgaaaccaatcttcctagagcctcgtgtggtggtctcaggcatcgcttgggagtgccttagaaattcggcgtctcaaatgcagtcttgggccacaccccagctctccaggatcagaatctgccgtttaataagaccctaagggatgcatggctcatccaagtcggagtcagatctcacccgaggccgcacattggcagcacctggggagcttttaaaaatgctgatgcctgggcgctgcctcagggaccccggtttaatgactctgggcggggcctgctccttgggctttctgaatgctcccacgtggttcggctgcgcaccccgggctgggaaccgtggggttccctggcagtacccttctggaattctccttccccagcctcccagtcacgtgactgcttaatctcctccctctgtggctctttctctgtcctctgctcctggctccccgatttctgaaggcagcccggtctcttttctttctttgttacctcctggccattctccaaagtgcctctgcgggggcgggagcttgtgagaaattcgagcctcagccatgccccagacctgctgaatcagcacctgcagtttaaccagaagcccaggggatgcgcatgtgcattgtcatatgagaagcgctggtctaggtgacgtaagctgggaaagaaacccagggaatctgctggaatgtagggagcctgggctcaggaactggaaggcgtctgtctgggtctctggcttgtttgttttctagctgtctcaacttgccactgtggtcatttggggctagatcactcttctctgtgcgggtcgtcctgtgcatttaggacgctgggcagcatctctggcttttacccacatcatgccatagcaatccccctccccagaggtgataaccaagaatgtctccaggcattgtcaagcatcccctgggggcagaatggtctctaggggacactttggtgtctgcctctggcctcattccctcccgccatacacccttggtagggttggtggttccaagttagccactaccgtggaaagagagacttcctttctccccctcgtccatgtgtgcggccctgcatgggtcccacgctcatccccatagccggtcattgtgcctggtggtcggggcactgtcattggccagattgggttctgtgccacatctggggccaggggccagctttgttagcaattgaaggagactgggagagttctgatggaggcacaaatggctattttggaccactctagcagccctttacggacccaagtcctccgctgacccttcacccaataacaagctcatttagcaaatatctgttatgtggcaacgaacagctgggccctgttccagggcgggcattttataaacagtcttcaggaccatcctaggaggtggtcttgttagcccatattgcaggtgagcagactgcagctcagcagggctggtgacacccatggcaacctgcggagcccagttgctccctaattccccccaccctgtgccctgctgtcagccctacctttctgtcacccccttgagctcttcctcccctccaggctgccctacactgccatatagctggacgaattgtaaaaggaacactgtgtcatcatgcctctgctcaagtcaggaaagactgttgctgctgtcatcttttgtcccctccccagtcccctcacctccctgcccctcagaatactctcctgacttctattgtgtttacgtctctacttttcattgtagatttaccaaagaattctggttcctgagctttgttaatttacttctgcccgtttttgaacatgatgtaaacgggatcacacagagtgtttggatgcatccggattcttttgctctgtattctgtgtttactcattgcaagcatactttgggaagtgcttgagtcaaagggtgggtagatgagaagccactgaaggtgacagaggaatggccgtgggtcagagagggaattaccttggcattacttgggcagagctggagtggtgggctacgcagttaggaggttgcggtgacctgggtaggagctccagcttagggtctgaaggccgtggggaggatggcaggtgaggcgtggtaggtttgggagggttgtcctgccttctctttctgacgaggtaggagttacaggttggaggagatggaaaaagggggaagcattcctcatacaggcttgttggaccagcaggagctgaaccagcagtcgtcttgggttgcagtgaagccccctctgagactaggggctcccagcaccaaggaactggcagccagcagccagcagccactgaggccagcacctctcgtaatccacaaggttggaagaaaagcagctcggtaaaggctgcttgtgatgagtcactggggctcctggaaaatctgtaagaaatgaagcttttgagatgtttatttttagctgccgtctgaccatggcctgtctctgaacttgatgttcttgggccctctcctctggctgtgtgttctagaatttctgttgtgtcctatgcttttcatggtgtcatgtgaacactacaggtaactgtgatgatcttgaacactttgttagcgctatggtatgatcatatttttattcatgagccgaggcacccggaatcttgaagcattcggatcactaattacttggagaaacttttctgattgtaggatctcacagaaacctctctctctctctctcccaccctctctctctctttctctctctctctccctccctccctctctctctctctccccctccctccctctccctctctctctctctctctctctctctgtgtgtgtgtgtatgtgtgtaataggaactcatctttattttcccaaagctttaaggttgaaatgttgatggtgacatcctttagttgcattgttgggtttctggaaactcattccttcccttaaataatcctaaggggaatgactgtggccacttgtctttatattatacttgtccccgtgggtcacgattatttgtttgctgggttttgttgggaggtgagggccgcaaatgtgctggtagctctggtgccttggacagtggcctggcaggtagcagatgcccaataaacacccatggtgtaaagcaggggccggcaaagcacagcctgcaggccagatccagcctgttcctgtttttgtaaataaagtgttgtcagcaggcagccacatcccttcatttccatattgtccgtggctgctctgctgtacaatggcacagtccagtaatcgcaatggagactatatggcatatggcccgcgaagctgaaaagatttcccacctggacctttctcagaaacatttgcaaactcctatcagttaagttactacgaggaaacaggaaggagcaaggggcaggaacagcttgtgggagaggctcatgagagccggaggtggttttagtagcagtttctaccctgcccacgctggcaggggaccctgccgggacttgcctctagggtggccttccttgcttgttggagactcttaatcttttaatctgagttatgactttccgttccatctgtccaagtcatctggggattagctaatagagcaagttggcaaataatctgacatggtctgatttgggaggggaatactggcataaacattggcaggtactgtggcacctggccactgctgggcagaggacagagggaacaggtggaagggcttcaaccacagcgttttatggacggtgtaaatactgatggcagcacaaagtgtaatggctccagatgggaaatcacccaagtgtcacccgcagtagaatggataactacattggggctgattcctcagtcaaatactgtgaaacaggagtcggccaagttcgtgatcctgtgggccaactccagctcactgcctgctttcgtacagcttatgagctaagaatggtttttgcatttttatatggttgagaaaaaaccaaaagaataatattttgccacacatgaagatgatatggaattcatatttcagtgtccgcgaataaagttttattgaaacacagcaccaggcattgatgtgtctatggtctctggctgctttgcaatgacagcggtggagctgagtcgtctagacagagactgcatggcccagaaatcttcaaatatttactctctggcccttcacagaaaaagtttggtggcccctgttacagtgcaaagagaatgaacagatagttacactgaacaacatgggtagatcttgcaacataatatagaatgaaagaagctggaaacaagatttcatttctttaaagttcagaagcaggcaacagtaatctatagtgtgagggttgggatagtggttaccctttggggtgggtcagggactagcgggggcttgaagtggtgtctaggggctggtcatgtttcgtcccatgatctgagcactccatacatgggtgagttccctttgtgaaaatgtgtggagctgttcatctatgatttttgcattttacgaatacatgtttacttcaataaaaagcttactcaagaaaagtgatttcagtctggcagctcctcagaaggttaaacagagttcccatctgacccagcaatccactcctgggcatatacccaagagaaatgaaaacatatgtccatgcaaagacttgtacacagatgttcctaacagccttattcataatagcccaaaagtagaaacaacccaaatggccgtcagctgatgagtggataaacaaaatgtgatacagccacacaatggaatcttattcagcaataaataaaaaggggtgaagcactgatacgcaccacagcctggatgacccttgaaagcattatgctaggtggaagaagccagatgcaagaggccacatactgcatgattccacttactgcatgattccacttatacgaaatgtccagaataggcaaacgcataggatggaaagtatattagtggctgcctaggctgggagaaggaagtgattgctaatgggtagggggtcatttttaggggggtgaaaatgttctggaattggatagtggtgatgattggacagccttgtgaatttcctgtaaaccactgaattgtacactttaaaagagtacatcttatggtatgtgaattacctctttaaaaatgctgtaagagattgctgctacagacctgtgtgtatctgtacaagtcagaaggaaaaggtctcaaggtgacagccacctcatccattcttcctgctactcctccaaatgcagatatcttgaaagttgacaggcagggggaatgcctgacttcccccaggtaatccagactcttcctctagatccaagccagttgagtagcacagagcagtttctagaatgtagctaacatgggcatgttaattttgctacttttgtttactaaaactgcagttctcagaaaaacaggataaactaaaagatcctagataacttgcttcctggacttttcctgtgattatgcctgacttcgcccccattttcctgatgtctgttttcctttggtctgattggagaggaatgggaatctatgtagtagccactggggcccattcccatagctgagcctgggctgtcggctccttgctggttcctccaagacttcattgcttcacagccaatgaaatggagcagtaaaaaaacaaacaaaaaacaacaaaaacaaaacaaaaaacaaaacaaaaacattaaaaaagacttcactgcttacctgtaggttgctttttatatatagttctcaatctcttctgaattaaacttcttggtccccacttctagatgttaagggccataatggttgcaaatattgtgataacttttgagaggatcccttttgagggtgcgagatgactacccagaggatctgaaggttttcattttgctgacactgaagagtgtatttcttaggattttctgctctgtaatgacagataatcacagctggcagtgaagatagcgctgaactttctgtaaagtcccagccctaaacattatctgtggcagagacaaacagttttaattaatgacaaaaggtttgcttgtccctgcgagggtgaaaggggccggtgctgtttcattccctgtgccatgtactgggctgaaggggcaggggagggagcatcccagggtcctggcttttgagagaggggcagagagggtcagctgtggtcacacacccatacttgggagtcgtacaagtctcttggttagtggtcttgccactttgaatagaggtatttcagatttgaaagaaaacagtctaaacagtctcctcaaagtaaatgctttgaggagtttttaggaaaagctatttcgaatgtcaggcatagattcatgttttaatggcctcactgattcttggtaagtggaatcccccagaaggtcccccagaagctcagttggaccaccacaatctccctgaacagaactggagtccatcaggtcccctctatcagttacagaaagcagaggagtgagcagatcaacctcagaaacaaggcgacatgcagggggataaggaaggggtgttttcatgaaacatgattttcattttaacaaacatttatgaagcgctaaccacatgccaggcacaaattgctttacaaatgtcagctcattccgtcttcttcacagcaccctgaggcaggtagtgctgcaattcctacttcatagatgggggagactgaggcacagtaagaaaggtccaacaacttgcttaaggtcacacgggtggtaagtggcagagctgagatctgaactcatgcagcgctgttctggagtctgtgttttaaccagtatgcgtgtgatgctgcctctcttgtgatgaacatcagaatatagagggacaaagtacaatattgaagatccaaatatctcatactgccaatttgttttaaaatacaactacgaagaaaacataccaacaggttatgggagttatcaagggcatgatgatgggtaatccttattttttttcttgatagttttctgtatttgtcaagaagttttgtaagttgggtggttggttgtgtgttttaaaaaaatagccacaataatatctctgacttcggaatgctcatctagaactttgccatttcctcatcaagaggtagagtctactttctctctccttgaacctgggtgggattttgtgactgcctcaatgaacagcaagtggcaaaagggacggtatctgacttctgaggctgagccacgcaaggtgatacagcttctgccgggtctctctctcttaacacacttgctttggggcccagagcctctgggtaggatatactgccacctggccgggcgcagtggctcacgcctgtaatcccagcactttgggatgccgaggtgggcggatcacctgaggtcgggagtttgaaaccagcctgaccaacatggagaaacaccatctctactaaaaatacaaaattagctgggcgtggtggtgcatgcctgtaatcccagctacttgggaggctgaggcaggagaatagcttgaacccaggaggcggaggttgcggtgagctgatattgcgccattgcactccagcctgggcaacaagagtgaaactccatctcaaaaaaaaaaaaaaaaaaaaaaaaaaagaaagaaagaaaagaaaagaaatactgccacccaaagtcacatgctgaagagaccacatggggatgccacatggaaagagagagaggcctgggaaccccagctgttctagtctccagctgttgagtctcttggcccaggcaccagatgtgtgagtgaacaagccttcggatgatgccagctccagcccctgtctgaccaagaccttgtgaaagaccctgggtgaggatggtcttgctgagtccaatgagaccccagtaccaggatagataaagatatgatgggctgcgtgcagtggctcacacctgtaatcccagcattttgggaggctgaggtaggaggattgtttgagcccaggagtttgagaccagcctgggcaacatagtgagaccccatctctacagataataaaaaaaaattagccagtgtggtggcatgcatctgtggtcccatcttctcaagaggctgaggcaggaggatcgcttgagtctgggaggttgaggctgtgttgagctgtgattgtgccactgcactctactgtgggtgacagagtgagaccctgaaaaaaaaaagaaagaaaagaaagaaaaagaaaagaaagaaaaagaaagaatcctttggaatggctaaagaagatgccccaactgtgtctggggaaattaatgcaagttccacagatagggtgaaacagaacagggttctgcagtgtgaataggagctttcaaggcagaggagaaggttcaaggtagaagagaaaagcacattcaaagatacgggtttctacctgacatttttggtcaaacatggataaccatgattcacctagggtagcatttttatattcagccaagccttgattctacttagaatctgtccttctagatcttgatctaggtgatttcctgctttctttcatcttctagaacctgttatgttattgctaatacccaaccataaaaagtccaggtttccttcgagtgttacagatccctgttctgagagcgagctgacccattcagagtcacttttaacatcagagctgtaaatgacatcattaatactattgtattaatacatgcttgtcttcgttgggtcctgggtgaagtgagttttactggacaggatctgctgttgaagaacttgagcctgattccttggggtcttcatgcttggagaccaaacctactgatacttttttgccttgaggcattggttgcaagatataggtgtcctgcattccttccacagttcctttggaggcaaataatggttgtgtaggagagatgttctcttgtcaggcaggatacttccagcctgaactgaggcaaattccactccaccctctcactattggtactgtcatgtatggctgctccagtcctccccagagttggtctgcattgctccagctaacttgacctgtcttccttccttcagagctcaagttcattctacctattaacccataattatcatgctgctgaataacaactccttcaaaggactcagtggcttaaaacaacaaccattcattattttcacaagtctacaggttggctgcatggttggatggggccaaagttggctgatcttggctggactcacacataaatctgtggtcggctggacctagatgattttttccccctttgagatggagtctcgctctgtcgcgcatgctggagtgcggtggcgcaatcttggctcactgcaacttccacctcccaggttcaagtgattctcctgcctcagcctcctgagtagctgggactacaggtgcctgccaccacacctggctaatttttgtatttttagtggagacggggtttcaccatgttggccaagctggtcttgaactcctgacctcaggtgatccacccgcctcggcctcccaaagtgctgggattacaggcgtgagccatcgggcctggcccctagatgatcttttaatcccaacctcacaatagacaccaacacctccttctgggtccccagggaagtcctctgaggctctgcagatcagagcctgtttattttcctcaggaccactgcatgttccgtcaaagtttaaagatatgattgctctctacagtgattttttgtttcaagcattattgcctgaagtagttgtttgactagagatgtagttaaattttaggtggtatcaactccttttgaatagactgtccaagtctctgcgattctatctgctggttgggtttttctgacaagggctctcttggagggtcaacagcctgtcgtcttgtttttcccatcagagattttctttcccacatatattaagaggttattttcatgttgtttttgtatacatgagaatgaaatctttgctttctaattttactctcttcctcatatcattggttgctactgacttctgcgatgtgattcttccctgggcactcatcagggggtattattttcaacttggcatggctcaaacctcaaacttttaaagttttaaagcagccgagttgcactgatgatcaataaatcaatcactgtgaccactttattgcttgtaaggtgattaccctactttgcccatagtgactcttcaatttgattaaaatgcagtttcattgggtcgtggttgagtcctctagatatataaatacatgagagaagcctgcactcaaatgtttttataaccacccttcagatttttaaccatctatgccagcacttttgtggtcctcatcctataattcaaatttccatgctctttgccaaagtaattcttatttatgcatattccaacctcttgtctctgtaagactgtattcttttttctgctaactggtggtgagccttggtcccactgcaaagcattttctacagctgaaatgagctcctgtgcaatctgtaaatcaggctctgatggtgggagaatatgggagatggtgttggttcactcgcgattgttttccaggtgaggagagctggaatagtgggagtagaattattatcttggataggaaaggaagacacattcaactgtgctactgccctggcagcaggagcccttttgactgcattttaagacattaaaaatgagcatctgtcctggagctccttgcccagggcagcgtgccaccagcttctcatggctcttggctcgcggcaggttgtcccacctcccttgtccagctccagggtggccccactcacatagagggctcctgccatctgcagattgcctgggctcccaccaactcattaaagtcttgccagcattttcactgtgccattggagtacattttgaatatccatgatgacaatcacataggctgcctgcctgagtggtccactttgtctcccataggaaccaattattgctttgattaccattattttcatttaaaccctatttgcccctccagccctgtcatttggacaccttgcttttgcagaatgtgaggttttccaggaatgtatataattaattaatcctcatttgcagattccatatttgcaaatttgcctactggctaaaatgttatgtgtagccccccagatcaatactcgtggagctttcgaggttgttcatagatacgtgtgtgtgtagagcgacaaaaagtgccagcagtgcccgttccttgctgaggtctgagaaggcgatgctctgccttcctgcttccactctcctcctgtcaacaagggtccttttcgtgttctatttagtgccatgtttttcacagttttgtgctttttttgttggtaattttgctgtttaaaatggccctgcaatgcagtgctgggaagctgtctggtgttcctgagtgtaggagggctgtgacatgttttatggagaagccttgttcaggcatgagtgatagtgctgctggctgtgaggtcaatgttaataactcaacaatatctattagagtgtctttaaacagaagtatataaacaaggtacatcttgattgtttgatgaaaatgtgaccaaagattttgcaggaacttaaccctgtattctcttgggaacagtagttcagtattcagtaattcagtgtttgaggtgactttatagagcataacctccacgaataatgataattgactgtgtatatatttcattacagcacagatgcctatgctgaaataatttttcttatataagaaaatagggcacatggactattcttcttgcatggccatggcatgtcctgctcatgtctttaacgaccggttttcttgcccaggtgtaattagcatggtcaatgcgggagcgatgagtggctctggaaacctgatggatttcctcgatgagccgttccctgatgtggggacgtatgaggacttccacaccatcgactggctaagggaaaagtcacgggacaccgacagacacaggaaggtaggtggcattccgaaaggacacactgcaaatggctaagccatgttttcattcaaaagttactgagctggggcttaggtccacgtacgtgtcatgtgctgggttagggtctaaagaagaaaagagccagtgggaggagcagatatattggcagatcattgtactagcaggagctttgggcaggacgttgtgtcatatggagggattgtggtgtggaggagagggaggggactttgcaggtgccatttctggaacctgttttctcatccatgaggatggaagtgattatgcctgaaaaggaaatgagattatgtgtatatgaaagcacatatgacagtgcctggtgtctagttggcaatcagtatatattttaatggaccacaatggttatctgtcaagtgctgtgggatcatttaggttcggttagggaagggtttttcagcaagggtaacatttcagttgggtcttgaaagatgactaagattttgctaggcagaggaacggtgaggattctaaacatcaggaatgccccccttttttaagtcacagaggcatgaaagaatctgatgtatctgggcaattcagggagctccgaggatctggtggaggattcctgcagagggagggatagggatgagtgtggaaatggaggcagcagggccacgtggggaacggccatgctggcggtggagaggagtttgcatttcatgctgaaagccacagaagacaataaagatgcgctgcaaagggagaaacaggaagcttggaaatgagtccaggagaccgaaggcagtgatgtgtaggtggagagaggggatcaggatggagaggtattttgaggcgccacggacgggattcaggggaggtgctggggccaggaggggaatggggtcacagaacaccaggctttggcctgatgaggatgatgcctttgatgcctagaggaagcaaggggggactggcagactgcggaggaggccattgagttctgtgtagatgcgttggtttgagctgcgctgcggatgggtgatcacaggtggcgagaactctgtggttcaagggtgagggaagggccggggggagaatgaggtccctgtgtgcaagtggaggctgaagctttagaaacagccacggtggcgtgggtgtgcagagacagaagggaagaggtagtcaaatccccaggcagtgcccagagttaccaggtccaggggaggcagatggggagcctgtgacaagaggggaccctgccaagagcagtcccctgtgaatggaaagggtgttgtgtaggggcctgctcacaaggtcaccctctatggagaggtcaggtaggaggcgagccagcggcatgggggctggcggtgaggggagagctgcttcagacgagggtgaggagtgacatggacagtgtgaccatgtcacatcgcctcacgagggctggcacgaaaggaggaggggaatgtgtagggagccaggctcagtcatgaagatgttgcagcctcttggctctgcagtgcaggaatgtggggtcgaggcagcattccctctagagcacagctcagcagactgcatcctgcgggccaaagccagctggcaccttgttttagaaataaagttttattggaactcagccatgcccatccatttccatatttttatgactccttttgtgctacagtggcagggttgaggagttgcaacggagaccatccggcccgcaaagcccaaaatatttactctctggtcctttacagaaaacatttgcccaccactgctctaaaaggccgtgagggaatgatgatctcagaggagcataggattctgttagcacagggaggtgtgtgtaggtagtccatctgctgtgggagacgtgatctgtgccagctaattctaagttcgtgctgctaaaatttaaccttgaaaacaaaaggaggagatgaagtctgtgtgaagaggctttttaatgaaacttagcaatgtaagttaagatagtaactcatattcagaatggagacaccgaaccaatgtcccccttcagcatagcttttaaatcatcaaagatcaaatcacatttagtatgttttttaattaagtgaattatttgagtgtgtgctcgaattctttggagacttttgtggcatctttatagctctgtgaactagaaagctcgtcgtaccgttgcggcacataactgaaagaatcacatcagtgggaatttagctgcttgatgacattcattttattttcttaattaccctgtttcccgaggaaacagtttcaaggaaaaaagcatgaattcgaaaatgcattcggatcagttgctgtatctgctttgttctagatcaccagcaagagcaaggagtccatatgggagttcatcaagagcctgctggatgcctggtcgggatgggtggtgatgctgctcatcggcctgctggcgggtacgtggatgggcatgcggcactcccgtgggaagctgcagaggccgaaacctcaaaacacgaaccctctgggagatttggaatatagcgcgtgtcgcttgtcgcttttacccctgtgggagggatttattacttgaaatatctaagggcaaaatgcatggctgtatatttaacctaaaatccatcatcaataaggcatgcccaaggcatgagctcaggcacaggcttctgaagagctgtgacgatagagctggtagcctttccacacagagcagagttttcttactataccggatttgactgaaaacacacattttttttggaaacggtcttgttccattgcccaggctggagggcagtggaatgatgccagttcactgcagcctccacctcccggggttgaacaatcctcccacctcagcctcctgagtagccaggaccacaggcatgcgccaccatgctcagctaatttttgttattttttcatagagatggggtctcactgtgttgctcaggctggtctcaaactcctgggctcaagccatcctcctgcctcagccaaagtgttgggattacaggtgtgagccactgagcccagccaagcacacattttatattcggttattcttgattatgtagatgacaacaaaatcagggactgttttatcttcaataacaaaatgtcatatgagattgccttttgctactactggtaggctctgggatgaactggaaacatcctgcaacagtcagcaccatgctagacacccacgggagctgaggcaggcccaggggcctccatcatcctgaccctcaggaactctgcatctttcctttttagaatcccaacaccgtgtttgcgagcagtagatgtttccagagtaaatggatgctatctggaggggaaacacgtctttttaatatcaaacgcaccagcccttccgggaaatagtttcctgaaacttatgtccttttaggagattgtgaaggttaatgtctaagaataaaaaatttggcatgacgaagaggtttccttaataaaaatcccctgcatataacaacataatagttatggttagagaacagatcagggaattgactagaacacaggcagaatatatgtagtaagtggtctaagaaggacagaacacaaatggggcacagatagagttttgtgattccaggggctttcagtttccaggtgatcttgatttattccctagctcatcggaggaggggcttggttgccagggaagggctctacctccctcacctgcctcagcattccgtaaagagctaagaggaatgctcagagggggagttctttcctactagtcacagatgctgtctgtccgtttctccaagcctgtccttcctttaccagtggcatttcccgtcatgtactggcagcagccagggcaggaaattagacttcattgtcacaagggattggacgaccaattttgcttgactgcttctataaaggcctttgaaggtgggccaggtgggagtttgctatgaattttgatgtccttatttagagtagattgataaaaccttatagtgtgtcatttttcttggctcgtaggaaggagaaataaatagggtaaatgaagaaactcagaacaggaatagatgttctgataacggcacagcttagattcattgactgacctaggagcccaactgggctgactttaatctgattttgaccagctggctttattatccacttgatttccatcagctctttcacgagggggaattaaaaacaatatgctgctgccctggcttcacttaaacagtatctctggagaggacctctagcttgaatacagcctgcccctcccctctgtgattgtaatgtgcagccaggggtgagcaccactggccaaaggagagcccatgcgcacgtcagcaggggaatacatgggagggtgagaatggggtgatgctgaaaatgaagggactacagtgttcttttgatttggatgcactttgaagggacagccagagagccacgtcccactcacttcccccttcctcgctggactaacagtggagaggacctggggtctcactgcctggccggctgtcccctcagtggctgttgtcttcggactcccctcatgggtaggcccacagcatctccgcatgtgcttatcagaagtcaccgctaggtgtcactgttggaccacgaaagaaagctgaggcctgctgaagcgcagtcagaaccagaatcagcaaggaagattgggtgtgcagtaggggggttgtgaatgaatgaataatgatgaaacttggggtgatcatcctgtttgcccctggatatctgcaggaccctcccatcttcttcaccttcttcttcaaatactgcacgatgtcacttatctgtggagtccaaaaaaataaaaccagtgtcatagaaacagagtagaaaggtggctgctagagggaggggtggggacaggatggggaaagagatgttgatcagagggcgtaagtttcagttagactggaggaataagctttagtgagcggtcgcactgcatggtgaccacaattaatgatcatgtattgtatatttcaaaattgctaaaagagtagactttaataatctcaccacaaaaataaactggggaggtgattcggttggtgcgaaggtaattgtggtttttgccattaaaataacggcatgatcggatctttaattagctcgatcaagtctttctataatgtatacatagatcaaaacatgacattgatatacacaattattatgtgtcagttttaaaaagttaaaaaatcaagataatgagctctttgcctttgtttttcctgtggaaaaacaaagaactgtggatagttctaaatttgacattaccggaccctgtggaaagacctcatgaaatactaaatattatggttcttgcgtgctgttgctagggggcagtgtttacttagctgactctgcaaactagcattaagcggaaccaagcttgcatccaggatttcatgatctagagaaaatactttgagcatgtaggatttcttttcactgggtttcagtttccaactttaaatcaggaaatagttttcaccattccacaaggtatatgtacttcaaaacatcatgttgtatatgattacaacatacaatcttatgtgtccattttaaaatgaaagaataaatcaggaaatagctaatgatatctctaacttaattagactaattatatatatttgtatatttggaatcaagtctttcattattgaattgcatgtttaaaaatttcaaacctgtctgatatttaaaatttaaaaaacaataaaattacatccctctctctgtaagcctcacctccctcacctgctctatggatgtatatatgtatgtatgtaaagctttattgaaatataactcacattccatataattcacccatttaaagtatacaattcagtggtttttaatgtatcacagagttgtacaaccatcaccgtggtcgattttagaataattttatcatgcccaaaagaatcattataccctgtagctatcaagcccctgctccccaaccatcccccttccagccctaggccactgttaacctgctttctgtctctatggatttgcctattctgggcatttcatataaatggaatcatacaatatgtggtctttgtgattaacttattctactcagcataatatgttcaaagtttgtccatgttgtagcacgtgtcagtacttcattccttttcactaccaagtacaattccattgtatggatagaccacacgttgtttatccacttatccattgatggatatttgagttctttctactttgtgactattttgaagaatgctgctatgaacatttttgttcaagtgtttgtgtgcatggatgttttcatttctcttgggtatatgcctaggaatagaattggtttttttgagacagggtctggttctggcgcgatcatggttcgttacagactgggcttgagcaatctgcctgcctcagcctcctgagtagctgggactataggcgcgtgccaccatatctggttaattttttttttttttttttttttttttttgtagagacaggatcttgtcatgctgttcaggctagtcctgaactcctggcctcaaacgatttgtccacctcggccttccaaagtgctgggactactggcataagccactgcgcctggcccttatactttttaacagagcctttaatatacttattttctcctgtcccaggtacagttacacaaaggcaggggcctgggtctactctttgcactgctgtattcccaagacatggatgagtaactgccgtgtagtaggtacatgttcagtaactatcccttgaatgaatgaatggacctgagttttctgattttttcattcatttatttattgcaatattttattcaacatggatatatagtgccaaccatgcacctgacatggatataacaatggacaagacagatagggtccttgcccacttagagtggacacagggtctggatgccaggcctgaccccccactgtggtatgaaaaccaaacaatgaaaccttttttacccaccacttatagactagtggaagtacacacacacacacacacacacacacacggagaaaaagagaaagagagctaattgtgatattaggatgcgagaggtgtggtgatggggaaggacaggcagccacaggaatgccagggaagtacacctaacccaggcttaggaaatcaggaaagacttcccagaggaggtgatataaatgctggaatctggatgataagtaggagtctgatgggaggggagggcagtgcttgctgagatggtgcaggtaggagagcgtggcacattccaggaacatggagtgggcagggtgtggggagttagtgagggaaagagatgaagctggagagatctgaggggccagctgtcagggtgggtgacctgttgaggatttgggtgttctcccaagaataatgggtaaccatggcagggctttccacaggggagtggcacaggtcagtctggcatttggaaagcctatttgaccacagtgtggagaggccatgaatggggcaggactgaggctggagaccagagaggaagctcctgcagcagtccagccagcaatgacttcaacacggtgatctgaaagacagcccgagtggggatgggggaaactgcagtgattcaagagagatttcagaggtggagctgctgggatatggggattgcctggaagggggttgctttcccagatttctagtttgcacagtagtgtgcctggatggtgggttcctctcccagttgggacgaagctgaggctgggaggaggatgctttagttcggtgtcggatggtggtggactgaagtggagatatctagtagacccaagaaggcaaatagacttgtgttctttgacaatgcccattcattggctttgactgcctggggctttgctacaaagatttgggagggtaggtccacaagtgtgtgtcatgattgattagtgatgtctgtcatgggcatgtcaaaagaattgtgaaggggaatccaatagagtgtgctattattgattggtgatgtctgctgtgggcatcggaagctgacggctgggctatgtagtgattggctctgtaatagccagtgggctctatgtgcttggaaaagcatagcttgagatgtacatttatacctaatggtaaatagtaggatatgaataaggttgccagggttgagagcatagtataaaaagagaaaagggtttagggtcaagctttgaggaaatggcctttagaagttgggtggaggagtcagaaagatcagaggagtcagagcaaaccagagagtgaggaggaaagcaggagagcatgatgtggaagccacgggaagaggtgtttctggaagggtggagtggtcaacagagtcagatgatgctgagagctctggaactggggtcagcaaactttttctgcaagaggccagagagtaaatattttcaggtttgtggcccatgtggtttctatctcagctcttcagttctgccactgtagcatgaaggcagccacagagtgcatgtaattgaatggtgtagctgtgctccaataaaactttatttacaaaaacaggctgtgggccagatttggcccatgggctgtagtttgtggatcctgttctagaggaatgagctaaggccattgccttagctgcatgggaatctcctggtagattgaggggatggactgggccaagggaaggaaagagattggatggtgactagagggaaagtggaaacagggagggttttttttttttaatgtttaaatgctgatggcaaggagaggaagaggttgaagatacaggagaaggaaaggggaatgggaagaacgaggccccatggaggaaggagatgtagagctgaggtgggcggtgtccgatgcaacaccaggagaagagaagggaggggtgagtgctgatgccaggtgtggatgcttttggtgaggatgtggatgcagaaccgatcctgtaataatgatgcagtgaaaaggctgaaaaatgaagatgcttgaaagcattctctgcctttgtgagagatgagaatgcattattctggaaagagacccaaggccgccttttgtgatccattcaactgcacattccgttttctcccatttctattggcttttaaaatacttatttagttttatagacccataattctttataatttaaataatgcagagagttttaataaacaggatcttcccgaatttggttctcatttggtggcaaaaccttactcatttatgatgtgaggccgtcgtagttgttatgagtccattttgtctgaattatcatgtttccctgagaaatattaatgtgtgtgattctaggatcctgccccagaagccattgagagagttctgtcttttacactataaatacccaatgtcaaaaacttggaaagggaaaaattgcaaaagttgcttgtctctcctacccagttcaagctactgaaccctttgtatttctcattgggcttgtgctgccttgcccataacataaatgttcaagtgctgcaagtttaatgaaagaagcttcctatgtaagtgacagccccattgcaagtttattgcctgctctggaatctgggccatcattgctgatgtgcccctgtctggccgccgtgttggtctcattcttgtcgcatcatggggcgattcctcttagtggctcgtgttacttcttccaggcaccttggctggggtcatcgatctcgccgtggactggatgacggacctgaaggagggggtctgcctgtctgccttctggtatagccatgagcagtgttgctggacttctaacgagaccacttttgaggacagagacaagtgtcccctgtggcagaaatggtcggagctgctggtgaatcagtcagaggtgggtatttgggcagggtcctggctggggacccctgccgttccatgcgtgcttgggaatgctgctgggagatttgtgaatgtctgtgatttcaccttcaagtgcctgctctgaagttcgtggcttaacactagatgacgggctttttccagctctaatgctaccactcaaacttcacttgcaaaacccttccccactgtttcatgtgcacaatgcatatatatatatatatacactttaagcctcatatttggctttatcttgttatatttggctttattttttcttaccgaaggtggtttgctgatcatgctgaagaaacaaggttgactttgatatcttctaattgagaagaacataactttttaagttatcctttaaaaaaaacagctttagtgagataaattcacagttcacattgttcacccgtttaaagtgtacgatttaatgcttgtagtatattcagttttgcagccgttaccacaatctaattttagaacattttcgtcatcctttccaaaactctgtctccattagcagtcactcccatgtcccccaacctgccagctctgagcaaccactaatctaccttttgtctctctagatttgcctcttctggatgtttcatgtaaatgaaatcatacaatgtgtggactttgtgtctggcttcttccacctagcatcatgtttccagacttcttcctattgtagcatgaaccattacttcatttttttatggccgaataatattctattgtatgaatggaccacattttatttatccatttgttggttgcttttgctttttggctatgatgaatgatgttgctatgaacatttctgtacaggtttttgtgaagacatatgtttcatttctctcaagtatatatctgggaatggagttgctgggtcagatggttactctatgtttaaccttttgagcagctgtcagactgttttccaaagtagctgtaccattttacattcccaccagcagtgtatgagacttccaatttgtccaccttcctgtcagcacttgttattatctgtttttgattatagccatcctagtggttatgaagtggcatctcattgtgctttcagtcatcttccattgcattttatgaccacattatagaggatgttctgggccttctataaagagaatgccctaggcacaggagataatagtggtgaaccacagacctatagcatttagagcttcagatctttattaaaatcttagttcaggaaagagttaacttctaacccatttcagtggttaccaccatgactatgagttattaaaggatcagaaagccacgtgaggaggaaccaggttgtcaagcttcacattaggggtaatgtgaggatctctcaagctagaactaatctttcaaggtatatgtaatctatttatacatctcctcccttccccactttttttttttttttttgcctgactgacttaccacagctgaagacatttggaatgcactttgccatttttgctaaacctctttctcagtggaattgaaaattaattccttcaaatctcagaaggagacagggatcttgaaatctcacatgttctcagtgctctccattacttccaaaaagaaattctctacttgggttgatgggagcgggcagacagaattggctgtgcgccatatttttattcttctctcctacttgcaatgtgtgttttggggaaatacagccatccatcttttcagctgtttttaagatttatactttgattcgaagaattacctttagtaagagtgagagttatttttagcctccaaaaaagtacatatttaagtgggtgaaaggtatttcttagtccgatttctcaccgcatagggtgtgaatatatgtgcttgtaaaggccagagcagtctcctggaacgtgtttttgcatttaataggcacacatgtggctgtccatggcctgacttgtaggtgacctctcttttctgccccctttacttaagtaatccagatggtggcaagaagctgaggtctagagagtgtggtctgtacccagcagaccaggcctttcacgcataggaccccagactgtgtttttggttcagaaaaccttctccatacatcagataatttggaataaatggttcaatgaattattctgaaagtgatcacgtttttcttctctgatagtgcctctcaaatgttagtgcgcatagaacctcctggagggcttgttaaaacatattgacctgggccccagccgggagtgtctggtgtctggttcagcagttctcgggtgaggcctgagagtctgcatgtctcataagccactgatgtggctggaccatggaccccaccctgagcagcagtattctaaaatacaggcccgacccgtattcattggcagtgcgggtgcttgctgtgcttgggcgtggccttaatgaaagctaagagagaccaagccaccacagacaagacaaaactaatctgccagggtctcggaggcaggattttctgcatcacacctttgattaactctatgcaagtggtgattaaaaccaagcatcatccacggtttccattactgctgagccttccctgtgtagaaggcgcgtgtaaacagctcccagagaaacacccgctgctctgtttgtgtgtactgactgtagcaatagcaacagctgataaacctacgctggccttttggtttatacaggactgggaccaaacctgcccaatcccgtcaaagcttttgttgtcaagacagatggggaggggttgagtctgttgctcaggtcagctgtggctaatgtttccttttgtgttttgtgtctgttgtctagggtgccagtgcttacattctgaattacttaatgtacatcctatgggcgctgctgtttgcatttttggctgtctccctggtgcgtgtatttgcaccatatgcctgtggctctggcataccagaggtgagttctggctgatttttttggtaccaataataagaatagcaaattcttctgtagcactgtcatgccaagcacagttccaagcgttttacttctactaactcattaagtttctcaataagactatgacgtaggtactattattctgcatttgatagttgacgaaactaaagcacagagaggttaagtgacttgccccaggtaaccaagctggtaagctgtgagttgaacccagtgttctgacttcaggatttacacactgtcttcaagatttctgtgctattgcttctcagatgataaaagccttgtctttgtaaaccaggcataactcttaaagcctgtggaatcagagttcattaaccacacacataaacacgctgtaataactcatcagtgcatctgtgatgtaatgtgagagacgatagtggaggtttgttgctgtgaaagttcactgatgatgaaatctctcttgccatgttttgctcttctggtggcaagctaatagcaatcttttaaaaacctgaattctgcctttaatacatgtactgtgaacgtacccccgtgaatttcgagttcttataaatagttttcagcactttcatgtaaccgaagcatgagggaagtgacctcaccgattaagaggagtgcctgagaccaaacttgaaacctatgaggacctactgggcagaatcatgataattgagctgattcccgaaaagcccagatggtggaaattttagccagaagtaattttaaaagttctggtattatcactgtaatccatgcagttcagttctcctttgggttgatgccttagcgatgcacacaggcagtgggctagagagtttgaagatgtagttgtgggctgagtatggcagtaaatccacaccctttgggaggaccctgcagccctgatggtggtccaggcagtttgcagaaagggctgaagtcatgaaaagacaatcagaggcaaaattcaacatggtcttgtttcaggaaagatagaaaaaagaagtcttaatatgtcatgctgaatttttgatggttgatgttaacatattgcttcaggaacctgaaaaataagctgtattaccaacctgttttctcagcgcagccagttctgctataatgcaacatacgcattcctaaaaatcaccatgccatgcaaaatcacacaacagaaaccacagggctttatggggaacatgaattaggggcacaatacacaaaacttcatcactgacacatatgacaaaaagaggaacctagtaaaaacaggagcacagctgtacacattaagtggctaagaaatatgtaaataccacaataaatatgtcacttcctgcaaagaacttgaagtttgcttgtggaagtgggtgtcgcaagggctgcaacttacgcgttgctgtgaagggcataaggaaggttatctgaagttgtaggggaagttgagacagcaggcgtagatgggtgtggcaccctggcatatgtgtgaaccggtagatgtttgactcgtgtattttgtgttttcctacatgactgggtgcaattttctgcatttacctggtatttctcctggaggaaatgcgcataaatagacataaaatttgagttatgctcaaattcctccctaacatgagtggcattggaacaaatttgcattttctttttttctttttccttttctttttctttctttcttttttttcttttttgagacagagtctcgctctgttgcccaggctggagtgcagtggcacaatctcggctcagtgcaacctccgtttcccaggttcaagcgattctcatgcctcagccccccaagtagctggggttgcggatgtgtaccaccatgcctggctaattttttttttggttttatttttaagtagagacggggtttcaccatgttggcctagcctcatgtgatccatccgcctcggcctcctaaagtgttgggattacaggcgtgagccgccacgcctggccttcttgtttttttattgttttatatagagacgaggtctcactctattgcccgggctggtctcaaattcctgggctcaagtgatcctcccgcctcagcctcctgtggagctgggactgcaggcacgtgccaccatgcccaactaatttttgtatttttttgtaggtttttgccatgttgcccaggctggtcttgaaatcctgggctcaagcaatcctcccgccttggcctcccaaagtgctaggattacaggagtgagccacagtgcttgaggcaaatttgcattttccaaccaagtgtcgtagcagagctgactgtattttatttgatgtctaaaacatctcagtttgtgatcccactgcccaacagtaggcatttttgactcaagcattttgcaaataaggagatggccgatggggaattggtggaaaatagaagcagtaagaggcacactgggtagtcccatctctcccttccaagaactgtagatgtgtggctcagctggtgtccttatagacagggagttcgaatatcagttctatctttgaagggctggctggactttgtcatcatctaaattgggcattttattggtgatagctgaactcagaaggagtaaaatactgagttgaggatttgtttcttttcttttctttttttgacaaggtctcactctgttgcccaggctggagtgcagtggcatgatcacagctcactgcagctttgaactcccagtttcaggcagtcctcctgcctcagcctcctgagtagctgagactataggtgtgcatcatcatacctggctaatttttgtactttttgtaaaggtgggctttcaccatgttgcccagactggtctctaactcctgggcttaagtgattcgcctgccttggcctcccaaagtgctgggattacaggtgtgagccactgtacctagctgagcatttgtttcttatgtgacaaaagtgcaagggatacatagacatggatgaaattaaaaaatgtgatgttaagtgaaaaagcaagttttacaaggagaaagtatgattgatagaacgtctataaacagctaaaatgaaaaaacgtatgtgctaaaactatagagaaaggggaagaaatggtaggaagtggtgaggggaaggaggaaggttcgactggggaggcaaacacgaggtagccactcttctgtttcttaaacttggtagtgggcacatgggtactcgcttttattagtattcttttaactctatataagtgcgtgatggattcatttctctatttcctaaatagttcataacaatcttttaaagaactttcaggaaccaaatggaggtttgacccagcagtagcaaagtcttcatgttactatagtagagctggaaattcttaacataaggatacagtatttttcccagttcttggaggagagggtcagagtaaaaagtaaatataaataaataaatcatgggtaaaaagaatctcctcccagtcagcacccaactaaatatggaaactgacttcagttgagacatgaagctgttcttcattcattctagcaaagatattgactgaactatttggaaaacatgtttatcattgtctgaggtgatctgccataagctgctatatggcacactgtgtaagaatgaactttgactgtgatgcacttatgtatatttaaaaaattgctcatcctccctagcatttgtttctaaaacattttgattacttagagtgaaaaattcctttggaaacattttttaaaatgcaaatttaggtcaggtacgggggctcatgcctgtaatcccagctacttaggaggctgaggtgggaggattgcttgaggccaggagttcgaggctgcagtaagctatgattgcaccactgcactccagcccggacaacagagcaagaccttgtttctaaaacagaaaaaagaagcaaatttaaagaaggttttttttattttatgtaataaatgctctctataaaagttctataaagcacatttaaaggtgaatgcttgcctgtaatcccagcactttcagaggccaaggtgggaagattgcttgagcccaggagttcaagaccagcctgggcaatgtagtgagacctcatctctacaaaaaaatgaaaataagcggcagagtgtggtggctcacacctgtaatcccagcactttgggaggctgagctgggtggatcacttgaggccagaaatttgagaccagcctggccaacatggcaaaaccccgtctctactaaaaatacaaaaattagccggcgtggtggcacgtgccagtaatcccagctacttgggaggttgaggcacgagaatcgcttgaacctgggagatagaggttgcagtgagctgagatcacaccactgcactccagtctgggtgacagagcaagattctgtctcataaaaaaaaaataaaaatagccaggtttggtggtgcactcctgtagtcccagctactctggggactgaggtgagaggatcacttgagcccaggaaattgagactgcagtgagctgtgattgtgccactgtactccagcctgggtgacagagccagaccctgcctcaaaaaaaaaaaaaaaaaaaaaaaaaaaaaaaagagtgaatactcagcttttgttgcacgtgggacttgagagagaactgggtaagggtgtcctctttctacttgcttccttttgtcagtagaaccactgtcgtgtcaactatatgagaaatcataccctctcagaacttactctgtgttgatgtttcagtttattaaaaaacataaaacataaacactcttacaaatatttatttatcggaaagagttctggttttcaggttaacaccagcaagtcacaaatccgctgcagtacatctcgttaaagccctgctcgcttcagtctctatgaattcaaattaaagcaagtgattggattttgccatctactgggaatgaatttgtcttatttagtccctaatttgatcatgagaattttataaaatcatgttagagaattacaaaatacctattacattgttcaattcaccacatgtcatggctggcaaaggctcaggtaatttagatgcttgtaattttctaaatggtattacgcttttaaactatacccttgggtccaaatccacattaactaactgacaaaaaattatagataattttatttgaggcaacacaaaagggcagaattgtggcaggcgtaataaaacatcccttaaataaagggatctgagatcccagagcacgggctcaattaagctaactaccactagttaaggacgggtctaaccaccactagtttgtctgccacgagttcaaggctagttcaggaaacaccatctgactgtatagctaggagaccttgcacatgttctgtaggaaggagctcactgagtccttcaggaacatacacactcttggatgagctcacttcatgaccctccccaaatcgcccaaggtgacatgatgctcagtagaaggacctggtgaaagaacaaagagtgtttcacggctctcccttaaatactgtattgagaaataaggaatctctgtgctgctcttttcaggaatcaagcagtgctctccacctgggctgcattttcgagtcacctacagaggctgtaaaaatcctcataccctggatgcacctcagaccaattatatcaaatctctggggtgagagccagccagcagtgttttctaattccccaggtgactctgatgagtgccacggttgagaacgactgtagtagctatttgagaaactgattacttggcagagcaatgcccacaaggaggtgttttgaagttacataaataacactgacaagagataaccttgtcccattatgtattacataatgggaaaaccagaaattgaccacagatttcattgactgattcacttggtgtctaattaatctgtgattacaggcttgtaagttgctaacccggcagtaaacattcagtccatttcagccaattgggggacgggttggaggtagaaaagttgtttgatcattgatgatgcttctatatctaagagaataccattttggcaggggagaggcccttggtgtatgaagttaatcactgtgataggcacccagttgaattctaaaagcattaggcaaagactcaagtgaacgtttaggaagaaagccattatttggtatttataaaatgcagcaggtctggaaatggagcaagataacactccctatagtcaaagtcctttacaataaaagagggtaggatttgatagaagagaaggggtcatgatggattcaaacatctttacatcccccaaacatatatcattggaatgttgagcgtcttcttcattttctactgttgtattaagaatattttcaaacatacagaaaagttgaaagaattggacagtaaaaattcattaattcattgcctccagcaggggttggcaaacttttcctataaaagaaagagagtcaatatattaggccttggaggccaatgggcaagatggagcaactattctcaccagaaagctagtagtcttttttttttttttttttttttttttttttttttttacatactacttttaaaaatgttaaaactacacttggctcgtgggtcatacaaaaataggtagtgggccagatttggaccacagtctgtagtttgtcaacccctgacctaaagttcaactgtcattttgctcttgtaggggcaaacacctttttaggggtttgcggctgggcctgcgaattaaattgacatataagacagatcaacaggagaaaagcatacatgtttatttaatgaattttacatgacatgggagccttcataaggagtgaagacccaaagatgaagttagggttgaatacttatgtgctgaattggacgagtagtaatctatgaaagtgtgacgaggcagaggagcctgggctggggggttagctgggtgaagtggccaggaggatgagggttagtctaacaaggttggttcatgcagatttccctcagcctcaacttcctgtctttgatgataagaatgatgcttccttctagtatcggaagggcatctttcacatgggaatttcatctccagcttttaagaaacaaaatgggccagttgcggtggctcatgcctgtaatcccagcactttgggaggccaaggcgggcggatcacaagatcaggagatggagtccatcctggctaacagggtgaaaccccatctctactaaaagtacaaaaaattagccgggcatgatggcgggtgactgtagtcccagctactcaggaggctgaggcaggagaatggcgtgaacccaggaggcagagcttgcagtgagccgagaccgcaccactgcactccagcctgggcaacagtgcaagactccatctcaaaaaaaaaaaaaaaaaagaaaaagaaacagaatggtcaggtgatgttcttgttcttgtacctgctgtttttcaagagcctttaacccaaaatagtcagtttgccagagtggcatattttggggtggcatattccttttttttttttttttttgaaacaggatcttgctctgtcacccaggctacagtgtagtggcacgatcacggctcactgcagccttgaccttccgggctcaagtgattctcctacctcagcctcccaagtagctaggaccacaggtgcatgtcatcatgccaagctaattttaatttctttttttttttctttgcagagatggggtctctctatgttgcccaggctggttttgaactcctgggctcaagcgatcctcccacctcggcctcccaaagtgctgggattacaggtgtgagccactgtgcccagcctggggtagcatattcttaactacttcactctccttgccttgtcacatagtcagccagctctccatctcttaatctaggatatatttcagagtcaaaagttaacagttaacatcaataggtacatgtctcttctcaacataacaaaaggtaatgtgaacaggataaaatgccataaatcaagtgagaccttgttaatgatttattcagtcctctttaggatcttttggtactctaggactccttacgatttaccatgcattgagtttttaatatttcagttaatataaaattatagttaaatcaaaaatgaaaatggtttctgttccatgctattgagtgaatctaaactttgaacgtgtctctcagaggaattatagctcttttcctagccatggattgaaggagttcattccctcttgttctccatcctctgtttcagataaagaccattttgagcggctttatcatcaggggctacttggggaagtggaccctgctaatcaagacagtcacgctggtgctggtagtgtcctccggtctgagccttgggaaggaagggccgctagtgcacgtggcttgttgctgtggcaacttcttcagcagccttttctccaagtacagcaagaatgagggcaagaggcgggaggtgagccagctcagcttccatctgcagcgaaactttcttctcaaagccccctcctgctgtctgacttgcaggtttgcacgtttgttttcatggaaggccttgaagcttatgtagaactatttgttttgtaggtgctttcagctgcagcggctgctggagtctctgttgcctttggtgcaccaattggaggcgtgcttttcagtctagaagaggtgagaatgggcagctgagggaattcgtgattttgagcagcaaggcccgttgagggttagaatcaaagaagtattggataagattccggcagttaattaaggagccacaatttccactgttttttttttgttttgtttttgtttttgtttttgttttttttgagactgagtctcactctgtcacccaggctgcagtgcaatggcgcaatcttggctcactacaacctccgcttcccgggttgaagcaattctcctgtcccagcctcctgagtagctgggactataggtgcacgccaccacgcctggctcatttttgtgtttttagtagagatgggggtttcaccatattggtcaggctggtcttgaactcctgacctcaggtgatccacctgcctcggcctcccaaagtactgggattacaggcgtgagccacaatacccggccaccagcgataaattcctgttttcaagtattgtttcaaaaattgccaaggtgattttttaaaaagatttacagtattctccctctcataaccaacttaattaagcatttttgattttggtaacccaaacgggttattccaggggttggcaaacgtttctgtaaaaggccaggtagtaaatgtttttggttttgtgggccatgcaatttctgttgtagctgctcagctctgctgtcatagcatgaaagcagctgtgaacaatacgtacacaaatgggcatgtctgcatttccatagatgtttccttatgggcactgaaatttgaattttatggttttcacatgtcacaaaatattgttcttcttttgaatatttcaaatcaaaagattttttcacctttttcaatcaattaaaaatgtaaaaaccattcttaactcatgtgccatacaaatgcattcactgggctgcacgtgacttgcagcccagagttttccaaaccctgatctactctgttttctgtagaatccaatccagaggtttatttgcttctaggggagtctctgtgccatgaacagaattatgattaaatacttttctcttaaaaatatagcccaaacccaccttgattagtgtccattccacttctagacatagttagattcctccaggtatctttgctgatgcgttttggtcacattaagtccaggctcatggaatgagtgtgtccactcttggacttagagtgtgactttcctgccaaccagagggcttggctctgagcagctctttctccggccagtctttaattttccactttttcatctcaggtcagttactactttcccctgaagaccttgtggaggtcatttttcgcagccctggtggcggcctttacgctgagatccatcaatccctttgggaatagccgtctcgttctcttttatgtggaataccacacgccctggtacatggctgaactcttccccttcatcctgcttggggtcttcgggggcttgtggggaaccctcttcatccgctgcaacatcgcctggtgcaggaggcgcaagaccaccaggctggggaagtacccggtgctggaggtcattgtggtgactgccatcactgccatcattgcctaccccaatccctacacacgccagagcaccagcgagctcatttctgagctgttcaatgactgtggagcccttgagtcttcccagctctgtgactacatcaatgaccccaacatgactcggcctgtggatgacattccagaccggccggctggtgtcggtgtttacacggccatgtggcagctggccctggcactgatcttcaaaatcgtcgttaccatatttacctttggcatgaaggtaagtgaaagggaaggaagatggggtggggacccatgtccttctggggacagcaccctactctctaaaataaaattgcggtgggaaaaaaaggggaactggcctttcttgaatgttctcatgtgccaggcacttgacattcctttaatcaataggaaataacttctaataaacaataagcttatgaaatagagattttaatcccattttacaactgaggaaactaaggctctgagatcttaagtggcttgatcagacccacagcttatgggagacagagctaggcatcaaacccacttcacacattcccagaacaggtggtggtgaccacaggtttcctgccgctggccaggtgatgccaggtggtggaaaaagcccaggtttggctcagtttggctcattaaacatgcattgagtatcagctgtatcttaggcatcgtgctaagtctgagggatacagaacccaaacagaaagctgcccttgcagagcacacagctctgggagaaagagatgcagacctggagttctgacattgtgatgagcaccacgctggtatgacgggagcacagagtgagtgtgtcccccgtctgggtagggctgggcatgacaggggctctttgcacacatcctctttgaagaacagagctgtggatgacagcacatgctttcttttcctcctccctccctccctccctccctcccttccttcccttccttcccttctcttccctccccttcccttcccttttcccttttccctttcctcttccccctttcccctttcccccttcccttcctttcgtcttgttcccaggctggaatacagtggcatgatcacagctcactgcagcctcaacctcctgggctcaaatgatcctcccatctcagcctcccaagtagctgggatcataggcgtgaaccaccacacttggtgatttaaaaaaattttttgtacagatgaggctcttgctgtgttgccctggctggtcccaaactcccaggctccagtgatcctcctgcctcagcctcccaaagtgctgggatcataggcatgagccaccacaccacacccaacagcacatgccttcattactcttgttcctaaagccagagaagagacagctggtttcctctttcattgtgttaaaatcatttgttaaaatcattatgttaaaatactttaaaagcccctcctaaagaactttcttttatggaacctgggattttgttattatagctttttttttttttttgaaatgaggtaaaacccataaaacataaatgatcattttaaagtatacagttcagtggcattacatacattcacaatattgtgcaattaacacctgtatttagctttagaacattttcatcccccaaacggaaatcccatctccattaacagtcattccccatttttccctcctgcagccccggcaaccactaatctgtctctagattcgcctattttggacacttcatataaatgatatcatataatatgtggcctttggtgactggcttttttcgtttagtgcaatgttttcaaggttcattcacattgtagcatgtgtcactacttcatttttatggctgaatagtattccattctatggagatcccacattttgtttatccactcatcctttgatggacatttgtgttgtttccaccttttggctattatgaataatgctatcattacttacttaaagaaacttttattagagtatatcgttcatatagagaagtgtacagcttgatggagtttcataaaacacacacacacacctgtgtaaccagcacccaggaccagaagcagaacattatccacctcccagagcccccttttgtgttccattactattgctttctgtgtggcatttctatgaattgtcttttaattttatttatttttattaaaaatataaaatagagaccaagctccctatgtttcccaggctggtcttaaacccctgagctccagtgatcctcctgctttggcctcccaaagtgctaggattacacacatgcgccattgtgccctgcctgaattgtcttttttttttttttttttttttggagacagggtctcactctgttgtccaggctggagtgcagtggcacaatcatgggtcactgcagcctcgaccttctgggctcaagtgatcctcctgcctcagcccactgggactacagacacgtgccaccatgcccagctgatttttgtattttttgtagagatggggtcttgccatgttgaccaggctggtctggaactcctgggctcaagtgatccgcctgccttggcctcccaaagcgttagaattacaggcgtgagccatcacacccagcctgaattgtcttttttttttttttttttaaatttaatggtcgggcatggtggctcatgcctgtaatccaagcactttgggaggccaaggtgggtggatcacttgaggtcaggagttcaagaccagcctggctaatatagtgaaaccccatttcttctaaaaatacaaaaattagctgggcgtggtgacacacgcctgtggtcccagctactcgggaggctgaggcataagaatcacttgaacgcaggaggcagaggctgcagtgagctgagatcacgccactgcacacgggcctgggcgacagagcgagattccgtctcaaaaaaaaaaaaaaaaaaaaaaagaaaaaaattctaagaagttgtttacttgagtgtgtcatagtggtcaaatacaaacctgaatttgggccttaagaacaaggatgagtaggccttattaaacagctggctgtctctgatctgtcatctcctagcaaagggatttgttttcatgtctcaggaagatgctggtaacattttatgatgcttgctgagaaaagtctcctttgatgttacagggatataaatgatgtagaataaggggaagctcagaaaggaatgatttcctaaggagtattctgactctagaaatcacacccaaggatccaaacttcacttgaattaggttaaagttctgcttccatcctcagatgggtaaccacctggggctggctggcatcattgcagctgctgcccatggtcagcggtcacgtgtcatttcagcgaacacagggagtcaggcttgttctatagtacatgtgtggtcattagataaactaaaatgtatcttcatccagcagggtagagaacacgctggtaccaagatctcttagtttacattctatttctttgctgcccctatcctggcttgaaaatattcagaatacttattagaaaatgtacttcattaggaagagggaattgcctccctcgtctctctctgacaggtattcagctaccacctactagagagggcagggagccattgaagtgctttctggaagatccagggtggctgcaatgatggacttagcttctttattttacctgggagcagtcgcaggcccttcttttccattttcatgctgtggcttgacatttaattttaaaagccattctgaatgacatggcaaggggcgagagaaagtggtgtctcaactgacagatgctcactttgaatgttatttgcagtggggcttatcattctttaatccacagcaggcaaacccagccagcttttgaaggagagggaatcaaagtataaaattgcgtcctctctaagttgcagtagatatgactgactaggcaggtcaaattatttgtcccacctttccccagctgacctattttgcagagttgcacctcctctgaagactgaagctaaatgcaagcccgtcgagggggaatgtgtttcttgggggtcgtgaagcggggacttggtctttttccctcatgttgcttttctctgtgtctcctcaagatcccgtcgggcctcttcatccccagcatggctgtgggcgcgatagcgggcaggatggtgggaattggcgtggagcagctggcctaccatcaccatgactggatcatcttcaggaactggtgcagacccggtgcagactgtgtcacgccagggctgtacgcaatggtgggagctgcggcctgcctcggtacgaccatgggtggggcagggagggggaccggggaactaatctggcttagaggactgccaagaaggaagacatggacttgaacattttctttactcaggataggctgggttgtgtggctataacaagtaaacccctaaatcacaatggcttaacgcaccaaggctatgtctcgctcactatgcagacacacacacacacacacaaacagatgccctcaacttatgatggggttaacatcctgataaatgcatcataaactgaaaatattataagttgaaaatgcattgaatacacctaacctaccaaacgttgtagcttagcttagcctaccttaaacatgttcagaacacttacatttgcctacatctgggcacaatcatctaacacaaagcctattttataatgaagttgaatatctcttgtaatttattgaatattgtactggaagtgagaaacagatggttgcctgtgtacttgaggcatggtttctactgaatgcctgttgcttttgtaccacggaaagtggcaaaattgtaagttaaaccatcgtaagtcagggactgtctgtaaataaaaatcttggtttagcagaaggcgcttctccacctaatcattcaggggcacaaaggtgggtctgtcccctgtctatagtccttaagaatttctgtgatattctgtttatggggttcttgaagagcaccatgcttgcttagtcagaagcttgcagagcccatgtaggatccactcaccaaaaagcttgtgtgggccacggtgaatagacaacccgggatccgtcattggagcagaggccccagtgagatgcaacttcaggctccccaacgcaaagccacatttgacagggcctggcctgggttccagaggcccagtgtaggaagcatgtaggagagtctgcttggaacaggtgtgaggggaatttacagcctgtctgtcattttccccaaatcatgcttccgtgagctgcccggcttgcactttggaatcttactcctcccctctgttgcaggtggagttaccaggatgacggtgtcattggtggtcatcatgtttgaattaaccgggggtctggagtacatcgtgcccctgatggcggcggctgtgaccagcaagtgggtagctgatgcatttgggaaagaaggcatctacgaggcccacatccacttaaatgggtaccctttccttgacgtgaaggacgagtttactcaccgcacactggccaccgacgtcatgcggccccggcggggagagccgccactgtcggtgctcacccaggacagcatgactgtcgaggacgtggagacgctcatcaaggagaccgactacaacggcttccccgtggtggtctccagagactccgagcgcctcattggatttgcccagaggagggaactgattctcgcaataagtgagtaaagagagggaagctcacattttaccaagagccgaatggcatcctttgtacccctaacattatccaagatttttgaggtgatgtgcattaagccaggggctctcaagctttcacatgtctctgggtcacccaggggtctggctcaaaagcagattctgattgagcaggtcttgggtgggatccgatactacatccctcacaagttccccattaacgccgatattgctggtccccacgtcacactgtaaggaaaaaggctttaaacccaagtcttgggtagacattcttggttgcaaagtgactgcatgtttgcaagcagccccctggccctgctccgctgctgcctttcagcaattgttggctaaagctgagaaggaagagaggcgacagcctggagtggcccgggctgagctgtctcagagactttcaggtgtaccaaccatccggctgagatcacgagttctctgccccagacaccccttgccaccacacaagtcttttgcttcactttgtgatatgatgtcagattccacagttagaggcccttgtgggtaaatgtgcagacatcgctgaaaccaattgcgtgagatgattttcctcttgtgtttgaatgacaatcagctgcactgaggggcaggctgttgagttgggggaggggagtatgggatgatgcccaggtcagggtgtcccaacgacaggtggatcagagaagcaagcccatgggccccatcagccgagggatggctccaacagaagggtaaacaggaggtaggagaattcctaagacagaggggcctagggctgcgggctgagggccagaggtctggttgtgagttgctgggaccccaggcaaggagaagctgtgagccttggaggggtagagtcctgctgggcctcaaggtggcaggggcaaggaccagcatagcacatccacgggcacgctcaccatccttgctctgtgatctgtacaacattccagcatctcatgatagaccagggcccatggcgtggctcccatgtgcacacgacagttttactatatatcttctagagtattcttgaagcttgtcaatgggactttccctggtctgatgttggaatggcccactgttaatacatctccaccaggcaactgcttacttctctccctgtcctttgtttcctgtttccaaggcacctcccttaaacctcttcccagtgttacatagctttaaaatatctttaaggcatcttcatcaaaggctttataacaataagttgagataagctatcctctcccattttagcttgacactcaaacatttttacctcccccaaagtaaaaattgattttgtattttagacaccgtagcaagtttgtgcttaagtgttcggcgatgcttctccttattataggtcctgttgcttaacgggtaggtaggtgcctttgtgtaaatattgccttataaataatgaggtttttttaaggttaagtaggattgggtttgtttaaaaatactgtaatcagcagcctttaaaaattttttcattccctaggatcttttaagcaaaggttgaaatttaaaaactaaggtaataaatgtcacagaatctattatctattgtatagctccaggcacacctgctaagaggcagcttactaattttgctgaaacccattactgtaatcaagtgggaagcagtaattgtcatcaaccagttagagaagaaatttaagcttaccaaccaagtactcttctcgaagctatgtttggaatgtctgaagaggcaccacacggtgtaaatactacctatatgctttcaatcagaccgataataatatagaaggtgctatttacatggtttgtgcagagggaaggagtgttttgctctgaggaatcagaaaagctgtttttctggcctgtggaaatagaagagcccctgtactctggtggagaaatacaggtgcatgacctgtatttgaggaatcttgtgccattttatgagtatagaaatatgacagcatttagctagacactatcccatgccaatttcacttcctagaggaattgggagcaaagattatagacagatccaagatagtatggatcagaaaagaaaggtaagtgaggtaaataaggatttttcttacatatcatgtttaaaaattgtagcaactgctcacatgaagctgaaaatgttttgttatgttttggaatgccaaagcatggcgttatctttgttagagagcacgtcgttagcaccacctaggcaacgtgactctcttcaccatcacatactagcacacggggctgtatgcgactcttgctcaagttcctggcaaatgggcctttacctctcattgctctgcaaatatgaggactcgcctgtacttagcagggctcaggtgcttcttgtcttgagttctgcagttaagtagaggttcaaagaggactcagcggggagttgcagagatgattaaagggtggaaagttagagtttcagggaagagttaaggaaactctcaggtttttttggtctggtggatgatttattaggctggtacaaaagtagttgcggtttttgccgttactttcaatggcaagaaccgcaattacttttgcaccaacctaatgattctccagcatgtggaagacgcttagttgcagaaaggggtctacatccagcactgaacaagaagctaagtgtcaggtctgtcagacaagggagaaagaggtttctgcccgggagggctgttagttactggactaggtcatggagaatagtggtgtcatctacacctttctgttggggatgtgtgtgtgtgtgtgtgtatatatatatatatatatatacacacacacacatagagggacttctccatgctttagtagacagacaataacttgtaaaacaatctgctttttcttctgtataatctttacttttttatcatatcatctttgtactacttctgtggttgctttcaattttccattttaacctatctcattaattatatctgtcttatggacgcatttaaaaaaattttttgagacagggtctcgctgtttcacccaggctggagtgcagtggcgcgatcatagctcactgcagcctctacccactgggctcaagcagtcttcctgcttcagcctccggagaagctaggactacaggcttgcaccaccatgcctggctaagcatttttaattaacaggatgatagactattacttccctaaaaacacagttcaagtgggagtactcctcctcagcactgctgacatttggggcttgatgattctctgtgctggggctgtcttgtgcactcttgggtgctgagcagcatcccagggctccacccactggatgtcagcagcacttgccctctcctattgtgataaccaaaaatgtctttagacattgccaaatgtcccctgagggtggaggcagaattgctcccagttgagaaccattgctctaaagccactcaatagcctaatgaatatgtgattatttccaattttgaaaaatttcttggcctatcacatagtttgtgaaatttctcttacccatactttattatttaccatctctacatctggcatatgaacatattgcttctaggaaatggaatgttgagtaaccttagcaggtgctcataaaatatacattccttcatttttttttttttttcactaagtcttgctctgtttcccaggctggagtgcagtggcgacatctcggctcaccccagcctccacctcccagattcaagcaattctcctgcctcagcctcccgagtagatgggactacaggcgcatgccaccaggcgtggctaatttttgtatttttagtagggacggagcttcaccatgttggtcaggctggtctcgaactcctgatcttaagtgatccgcccacctcagcctcccaaagtgctgggattacaggcatgagccactgtgcctggcctaaaatgtacattcttttttaagagctgtggccactgagactcattctagtagaatatatgacaaacctcctacattaaagacagttttaaaaacagtttaactatttttaaaacatttaaaaatgaagtttattacattttttcaaaatgaaagtaatacacactccaaatattggggaaatcagaagaaaaaggaaacatttaaaaagccacctacattcttatcaccaaagaagacatgattgatatttagtgcatttcctttttgtcttttaggtcttttaaaaagatgcattttcggttgtattgttttggtttctttttcaacacagactcccaagtgttcctagggtctgtgggtctcttttcttgtagcactggctcatcccctgggtgaggagttagttggtttatcctttcacacaggaaatatttcttaagtgtccaccatgtgctgataccatcctagaagctcagagtccagggatgacagcacactgcctctgccctctgtgaacttacatgcaggcattttggtgtctgatgatttctggtccaaactgagagcagatgtttcaccctggtagagaattgcaaagagctttcttgctggttgttcttccattcacaggcttttgcctgttcttagcacctctacccacaaagtttgaagcctcctgtaagtctgtaatagagttccaaagtggcctagcagaacctttctgaggagagtagcagttgccactgtgggaacagcaaggtgcatagctcaggcttctggctctgaccctagctgatgcctatatttttgcttggcagtaaataccttgtgtgctttccttcctgatgcctcctatgtgagataggttcagttttatgtggcaggcagaaccagatacactgacatttagtagacctactcatccgttcattcatatgtgcatttggcaaatatctgttttgtgtctactgtgtgttaggcattgtccaggcactgggagtgcactggtgagcaagagttcattgagctagtggctgttagaatcagggcttctaacccaatcagtaggttcaaaggagatataagcatgttatttattttattgtagcaagtggatcgaccatttattaaattgtatttggttttagaaggggttcagcaaatccatgtcatcaactcttgattggggtttgcaacttgatccaatcctgacattcactcagtggttgaaattgatggaaatcctgttagtgggactttaagagaatcggctggtctatgggaatgagcaaataagtgtgtgttgccagttgcctccctgccttagtgggtaaggacagaatcatcttggtttaggagagaagtacgtagtatatatcgaacagtctacatttgaaaacgcgttgtgcctcagagtcgtctggtatttgtggcagaatcataccccatttgatgtaacttgatttaacctgacccatgtaatgtgaaggcatttgcccagcaggccctctgttcctcttttaaacagagaccctttttcagactcagcctgaccccagatgctgccagttttccattagagtactctattgcactaaatggccttagaggaggcagttagaattttatttttgaaagaacaatataggtgaatagtagtctttgagaaggtaagaagtgtattatgggaaccaggatccattttaaagcaagccttgctgtacattttccctaaccttttcccatgaaccaaaagaaagattaaaattccaacagaaggaaaatcgccttggagaaatatcttgagaccgatggatttatttcatgtgtggcttaaaatagcctgggtttctagcaccgcgttaagctgtatttctaatgagttcctgttaccctacttttcttcagctttctttcacatggccttttctatagacagaaataggctaattgctaccataacagttttactatctttctttgagggatccacaaaatggcccatttttaagacaggagatccgaagggttgaggggggatgcagcttttctggggttgtttctttggacccaagggtcgcgtttgggattgagctgcatttctgggctgtgagcctgggctggccgtattggtttcttgttcctcccaggattcataatgccatttgggccagttataagttagttcgtaaaaagaaaaacaatgtattaaggtcatcgggcagctaagtaagtttcttgtcacctcaaactccagcccatgatgaggtgaaggagcgtaaggaaagccagagtggagggccctgggctgtttggggtgcccggagtctgcggtgaagcagtgaatgtccccaaaggggccatctgggtcaggcccatcttgccagactttggcaacaaatgatccggtcacagcaggggaccctcacacagcattagctgcagagagatgccaattccacagatgtttggctaaagccccttattaagaatgtgtggttcatcctccaaaccccttttctgtgggattctagatggtgtgtgtgagtgtggggtggggaattgctcagcaaggggtttttgtgtggctcattgttcctgctcaccccattctagagaacgccagacagaggcaggagggcattgtgagcaattccatcatgtacttcacggaggaaccccccgagctgccggccaacagcccacatcccctgaagctgcggcgcatcctgaacctcagcccgtttacagtgacagaccacactccgatggaaacggtggtggatatcttccggaaactggggcttcggcagtgcctggtgacgcggagcgggtgagtagccggacatgtggccagaatgacctagggagaaaaagatgagtgagacatggtctcagccctgaagaatgtggagggccatggggtggaatagtccttgacagagaatggcagtaagctgtggtgaatgtgttgaggaggaaatgtacagggagcttgggactgagggctgggcagccgtgcagccagagaagggggtggtccaggctggactgctgcctgggctgagggaggttgagtaaaaaggggtggagccacaggagaagggcttggtgttgcttttctaccaccccatgtgacacttggcttagggaggaggttctgctataacgtgatgtatgcggtcctcaaaatcacagcactacgcaaaaagtgctccatgcaaaccacaggacttgtgggaaaaatggggttaggtacacaacagtcaaaaacttcatcagtgatatatgacataaaagaggtggaagcctaataagaatggtagtaccgagccaggtgcagtgagtggctcgtgcctgtaatctcagcacttcgggaggctgaggtggaggatcacttgagcccaggagttcgagaccagcctgggtcgcaagaccctatctctacagataaatttttataaaatcagccaagtgtgcccatagtcccagctacttgggaggctgagacaggagcatcacttgagcccaggcttccaaggctgcagtggcccaggattgcaccactgcactccagccttggcagcagaatgagaccctgtcttgtaaaaagaatagtggtagtaccatgttacacattagttaaatggttaagaaatacagggatacaacagaaatatgtcacttcatcttaaaaaggcctgaagttggctgtggggtgggtttcacaagctgtgccacttccgaattaccgggaaggggtggaaggaggggagcctgaactcaaggggaagtggtcacagcaggtgtggatgggcatggctcttcacgcatgcatgaactgaggtcgcttgtggatgtttgggggccgggcatgtgcattttgtgtatgccgatcccactgggttcagctgggtacagtttcctgcatttgcctagagcttctcatggatgaaatcacacataagcaaaggtaaaattcatattatgctcagattgttcctgatatatcaatttgtttgaaacaactttgttttcgaaacaaacatgattggagaatggagagatttgatggccccatggcattgtccctgctgccacttttgttttgtgttgtcacaaatcaggaaaccaacaatgcaaagatcgagggtccactgtagtagcaccagagaagcagttccttaaaggtcattccttggcctctgagtgtcacaagttccatggtgtcagaagcttgtgtaagggaaggggtcggcttggtcagggtagcctggaacctagggttatctgcccattttattcctttatgggctgggagtaggaggcggggaatgggttctggagacattggtacctaataaagtttaggcctttatagactccagaggctcaactatctaatatagcttatatttccagagccagcacactctagtttaacacagcagttctcaactgggatgattttacctcccagagacattgggcaatgtctggagacaatttggggtgtcatgactggagggagggatgctattggcatctagtgagtagaggtcaggggcgctgctaaacatcctgcagtgaacaggacagctccacaacaaaacatctggcccaaaatgtcactagtcgtgcagttgagtgaccttggactggatgtgcctgtatagccaaatgagcaatcctattcattccactttcttcctgctgtcctggtagcaagcacacagggggacaggctttgcaatttgcagatttacccagagaactcctggccagcagagtgagcatcctccttagctctgactacagacagagcagtgtcttgcatgtgggaggtgcaatcaatagggaaaaataaatgagtccttgtgtttgacaaggctagggatcatttctgctgatgaattttaaaggagctcaagtggtttttcaaacttgagtgtggatcaaaataccctggaggattaaacctccaggttaaatccagatttctgggccctgccacagaggtactgatccctggaagtctagggtgaggcccaagaatattctttcctaacaagctcccaggtgatgctgcaactgccggtctggggaccccaccttgagaaccactgaagtcgatttatgcacttgagtttccagtactcttggtataaacaccactgtgattgcccatgctgtctcaagtgtgtagcagtttctcctttcctttaaaacaataatccaaagtcaattatcgttggaatttcagctcaggcaggaaactctgcccttaatgcccgctcacacctcatagagccccatgaggtcttcctgtgaagatctgggtgccgaaattggctctgaatgtgcttcaagaaagcaaaatcgcactctctctcgctctacatcttttacacaaacacagatgctgctgcgttagtgctggcaagggatgcttgtctgcggggcctttcatctccttgggcttcttgccagggcaggcacgtctctggccagctctcatgtttgatgtgctcgcccaccctgtaccttccctgctcgggatggccacgagcctgagctccaccgctggcctggatcacctgcagcatttctcaggcctggggttcaaggggcatcataaaactggaccaggaatcggaatgccgcaatctaggaagcctccagttgctaagagtgaatttgggtgagattttccctatgaaagttctagaaaggaaaagtgagtaagggagatggtgtcagattttccccaagccctgctaggtggtccacaggggcctggacaggatagctttcgcagaagagcccagctgctcgaatttgaattatgtccttggtcatagatctggccatttataattcgctgaattcgcttcaactgctactcaaaggggctggaagttcaaacacttgatttaaatcaaataggacatttcatgccactaacgaagcctgctggatttgatgttacctccttctgggttgatgttcagctttcttcttttgtgataattaccatcgcgggccagggcacaatttatgcacgaacccaaggcagctcctgaattcatatttccctagtgctgttataatcaacttaacttttagacattacagtcacagagctttaaaaggaggttttcagaactgcaaatgcttgatcttttgatactgtctccagggtgaagacaaggaaacaaaaaccaggatttatagatatgggagggttccgtgtgtgtgtgtgtgtgtgtgtgtgtgtgtgtgtgtgtgtatgtgagtgtgtgtgtgttatagttatcatcactttgcaaacactaacaagtcttatttttttcaaagcaacattggtttaatcaacattatattgagcatctattttagctgggaactgtagggggcacaaaaagtgtttaaaaaaaaaaaagccaaggagcttgttatctactaaagaacatggacataatccagtttaagtggtgctacccaaggcaggcgctccggggggactgttctgttttttcttttttaatttaatttaatttaaagttccgggatacatgtgcaggaagtgcagtcttgctacataggtaaacgtgtgccatggtggtttcctgcacctaccaacccatcacctaggtaggtagccccatatgcattagctatttatcctgatgctctccctccccacatccacgacaggccccagtatgtgctgttcctctccctgtgtccatgtgttctcattgttcagctcccacttgtaagtgagaacatacagtgtttggttttctgttcctgtgttattttgctcaggataatggcttccagctccatccatgtccctgcaaaggacatgatctcattcctttttatggctgcatcgtattccatggtatatatgtgccacattttctttatccagtctatcactgatgagcatttgggttggttccatgtctttgctattgtgaatggtgctgcagcgaacatacgtgtgtatgtatttttataatagagtgatttatattcctttgggtatatactcagtaatgggattgctgggtcaaatggtatttctggttctaggtctttggggaatcgccacactgtcctccataatggttgaactaatttacattcccaccaacagtgtaaaagcattcctgtttctccacactcttgctccacaccagcatctgttgtttcttgactttaataattgccattctgactgatgtgagatggcatctcattgtgggtttgatttgcatttccctaatgatcagtgatgtggagctttttctcatatgtttgttggctatataaatgtcttcttttgagaagtgtctgttcatgtcctttgcccactttttgatggggttgtttttttcttgtaaatttgtttaagttccttgtagattctgcatattagacctctgtcagatggatagattgcaaaatttctcccattctgtaggttgtccgttcactctgatgatagtttcttttgctgtgcagaagctctttagtttaattagatcccatttgtcaacttttgcttttgttgcaattgcttttgaggttttcgttatgaaatctttgcccatgactatgtcctgaatggtattgcctagattttttttctaggctttttatcgttttgggttttacatttaaatctttaatctatcttgagttaatttttgtgtaaggtataaggaaggggttcagtttcaattttctgcatatagctaaccaattctcccagcatcatttattaaatagggagtcctttccccattgattgttagctttgtcaaagatcaggtggttgtagatatgtggtcttatttttgagatctctattctgttccattgatctatgtaccagtactgtactgttttggatactgtggccatgtagtatagtttgaagttgggtggcatgatgcctccagctttgttctttttgcttaggattttctgggctatatggactctccacctcaaaacaacagaatatacattcttcttggcgccacatgacacttactctaaaatcaatcacataattggaagtgaaacactcctcagcaaatgcaaaacaactgaaatcataacaagcggtctctcagaccacagtgcaatcagattagaactcaagattaagaaactcactcaaaaccaccacacaactacatggaaattgaacaacctgctcctgaatgactcctgggtaaataataaaattaaggcagaactcaagaaattctttgaaaccaatgagaacaaagagacaacataccagaatctcttggacacagctacagcagtgttaagagggaaatttatagcactaaatgcccatatcaaaaagctagaaagatctcaagtcaacaccctaacatcataactaaaagaactagagaaccaagagcagacaaaccccaaagctagcagaagacaagaaataagcaagatcagagcagaactgaaggagacagagatacaaaaaacccttcgaaaaatcaacaaacccaacaaatccaggagttgtttttttgaaaaaattaataaaatagactgctagctagagtaataaagaagaaaagagagaagaatcgaatagacacaacaaaaaatgatacaggggatatcatcactgaccccacaggaatacaaacaaccatcagagaatactgtatcacctctatgtaaataaactagaaaatctagaagaaatagataaattcctggatgcatacaccctcccaagactgaaccaggaagaagttgaacccctgaatagaccaagttctgaaattgaggcagtaataaatagcctaccaaccaaaaaaatcccaggaccagacagatttacagctgaattctttgtaccagaggtacaaagaggaactggtaccatttcttcagaaactattccaaacaattgaaaaggagggactcctcccgaactcattttatgaggccagcatcatcctgataccaaaacctggcagagatacaacaaaaaaagaaaacttcaggccaatatccctaatgaacattgatgcaaaaatcctcaataaaaaaaaataatggcaaactgaacccggcagcatatcaaaaggcttattcaccacgatcaagtcagcttcatccctggggtgcaaggctggttcaacatacacaaatcaataaacgtaattcatcacacaagcagaatgaaagacaaaaaccacatggttatctcaatagatgcagaaaaggccttcgataaaaataacatcccttcatgttaaaaactctcaataaactaggtattgatggaacatacctcaaaataataagagccatttatgacaaacccacagccaatatcatactgagtgggcaaaacctggaagcattccccttgaaaaccagcacaaaacaaagatgctctctctcaccattcctatttaacatattgtacaattcacccatttaaaatgcatgattcagtggtttttagtagaaaatgggttgtgcattaatcaccacaattttagatcattttcatcaccccaaaaagaaaccccacaccccttagctgttacctcctataccacagtccttggcaaccactactctatattttctgtctctgtggacttgcctattctggacatttcatgtcaatacagtcatgcactatgtggccttttgtatttggcttctttcactgagcatcatgttttcaaggttcgtccacactgaagatgtgtctgtacttctttccttgttagggctgaatcatcttgcattgtgtggatagaccacattttgctgatcaattcattagttgatggacatttggtttccctttttttcttttttttaaattatttttaatttttgtgggtacataggagtatatatttatgggtatatggtatattttgatacaggcatgtaatgcataataatcatatcagggtaaatggggtctcccagcacctcaagcatttatccttcgggttacaaacattccaattcttttagttatttttaaatgtacagttaaattattgattgtagtcaccctgttgcactatcaaatactagatcgtattcattcttttaaactattttttgtacccattaaccatcctccatcccctcctcccccctcccccattccccttagttttcaaatgaggaggtgagactctaagaagcaaaacactgctcagggttaaagggaattggttgcagagccagtcccatctggattcttccaggtctcctatctcctgaggcacaatcagctgccaggtaccgggaggacctttgatggagaaccctgccagccgaccctgacccttgaggacatcaatcccctccgtacagcaccctctgggaccaacgacagtggggagtagacctgggcgtgatgggaagatatgtggcagcatccttaagtatccagattcctggaatggctgcattttgggatacctgttcagtaaaatacagaggatatggggccaggtaacgggattcctgtgtcccatgctgacggtgtattatagattcacccacagaggtctatttgtgtctgaaagcttctggctgggagtaatagtcaaagtgtttaagagctggtgccagataatgaactgatttgttatgaattgtggggagttcactgcagttctataaggtatgaggttggcagggtacatcccagggtgtctagctcagtggctataaaccaaccggtgtagaactattttagtactttttaatctggatggtggttctcaaccaggggctatcttgtcccccctccacaggagacatttggcattgtctggagacattttggttgccataatgggggatggggatgctgctgcatctagtgggtagaggcccaggatgctgctgtatgttctacagtgcacagaatggcctatctgcaacaaataattagccaacctaaatgtcactagtgccaaggtggagaaaccctgcgtaaagccttcccaggtggagggctggatgggtggaaggagtcctattggcccagcttgcattttgctgctaccgcatgggagggggcctcactggggattcctatctgcctgtaaatagaggcccttcccagtaacaaagccgcctttcctagctgtcactgctttcttgaaattaattagaattatcagagctagaacaaaatttcctgactctgggaggaaaccttgtttaaaaacatttatttaaatttttgtgggtacatagtagatgtgtatatttatggaacacatgagatttttaaaatatatatatatatatattttattatactttaagttctagggtacatgtgcacaacgtgcaggtttgttacatatgtatacatgtgccatgttggtgtgctgcacccattaactcatcatttacattaggtatatctcctaatgctatccctcccccgtccccccaccccactacaggccccggtgtgtgatgttccccttcctgtgtccatgtgttctcattgttcaattcccacctatgagtgagaacatgcggtgtttgtttttttgtccttgtgatagtttgctcagaatgatggtttccagcttcatccatgtccctacaaaggacatgaactcatccttttttatggctgcatagtattccatagtgtatatgtgccacattttcttaatctagtctatcattgttggacatttgggttggttccaagtctttgctattgtgaatagtgctgcaataaacatacatgtgcatgtgtctttatagcagcatgatttatattcctttgggtatggaacacatgagatgttttgatactggcatgcaatgcataataatcacatcatagagaatggggcatccaccccctcaagcatttaccctttgtgttacaaactatccagctgtactcttttcatacacctgtttgctatttgtatgtcttcttttgagaaatgtctatccaaatattttgcccgtttttttgatcagattattagatttttccctatagagttgtttgagctccttatatattctgcttattaatcccttgtcagatgggtagtttgctagtgttttctcccattctgtgggttgtctcttcactttgttgattgggaaacctttatttcttatgtgggcctctggctctgacatgcctcaagtctggaggcctggactgctcttctcagcagcaatacatggctgccaaagcaaaagggcaactctaatgagaccggggcccactaaagcttttgcaaccgtagaagcagggtgatttggcgaagtattgggtaacagtgcccttgagaaaatgtgtatctctggttgattgattgcaatgggccctcattatgacagttgagcccgaagcagctaaaacaaatcaggatggaaagaaatggtttcaggctctgccagctggacccagcaaccttcctgtgtgaggagaccagagcccttgttgggccttgaatctgtcaactgtgttcatactcacagatgggttttcccaggagaactcagcatctcaccgcaaagaagagtgctaacatttgtttcctttaggtagctcttgtttcaggattataacaacatttaggcttacagaacaattgagcaaaatatgcagagttctcatatatccccttcactcccctcagtttcccctattgtcaatatcttgcattactgttgtatttgttgtaattgatgaaccaatatcaatacattattattaactaacatccatagtttactttagagtgtactctgtgtcatatatttctgtggattttgacaaatatataatatcatgtgtccaccattacaggatgatacagagtagtttcactgccctaaaaatcccctgtgctctgcctatttatccctctcttccacccaccaaaccctgacaaccactgatctttttactgtctccatagtttagccttttccagaatgttgcatattatgtagttggaatcattcagtatgtagccttttcagactggcttctttcactcagcaatacacattttgatttttctccacgtcttttcatgacttgatagcacttttgtttttattgctgaagaatatccattgtctggatatgccatggttcagtttatccagtcacctactaaagaaaatgttggttgcttccaggttttggcaattatgaatgaagcagacgtcttctaagacgttttctttacataactaccaaaccatgatgatgtaaaattaacagtaactcaatatatcatccaatatccagttgatattcattcaaatatcaactcagaattccatcaaggtttgtgcattgcattcttttgcctttttagtctcttgtctagaacagtttcctgccttgttgttgtttttttaatgagagatttttaaacataattccaaattttattttagacacaggagatacatgtgcaggtttgttacttgcaaagatttcctttgaagagtccagaccagtagtctcacattctgggtctgattacttcctcatgattcagtttggcataagtcgtttttggcagcattccaacataggtaacgctatggagtctgcttttctgactttgttgatgataagctccattgctcggatgaggtggtgatggccagaaccctccattgtaaagtgacatttttctctttgttcataatctgtaggaaagtactttgagaccatgtgaattttctgttttccagcaaccattcgcccagtgattttggtatccattgacaattattgcctaagctaactattacattgggggttgcaaagtattaattatcaaattctgtcctgcttcctacgtttatcaagtattcctccccatttaagaaaaacaatccctgtagggtcatgatatattcttttaatgtttttgtaattcatattgtcattattctgtttgcttagcatgctctttcactattttcctctctcctaaagatgttgccatgagatggaggggaaggggtcttatttgctgtctctctcagtgtgatacatagggaaaccaacacaagaaacggataccttttccaagactgtttaaggtccagtgttgtcagagccaaaaaagtcagaattctggcctgacagtttgaataatcagtgtctatttcaccaggtgtaactgatttgaatactgcttagaatacttacatcccttcttcatattcactaagagataaatttgactaattttgccttaattaaataaatgacagtatattacagttaggttttctgatttcttttgtatattatcatattacacagagtagaaacccattattttaatagctataaagtattttaatgcaagactaccagagtttgcttctgcataccccttttttggggggtacagtggagatacagtgagtagtgttttgcaaacttatgtgggaatggagcttctttttttccaaagaagttgttcacttctccttctctcagacctttcattttacccaagggacatgatgtgttcctgcaggtggtcatttagtaaaataatgaaacaaggcttgctatgaatggttgtgcaaatgtgcactgtataatccagagggcacaatttctactgcagtgtttgtgagcagtgctccttggcactgtgtgatatacagtcttggtggtcccatacaatggactctgggaagtggcattctttttgtaagttgaaagcaatggaattttggaagagaaggcaatttacgtatatagtcagagataaatgtcaactttatcctcccagtaagaattacaaatagaatcactttttatcttgtacttaaaatttcttatacttaaaataccttacacttggcattcctgtggtgtggtcaagttttgacaatgcctttcataaacccttttaaaattgattatagtcttgaaatttaagaggatatagtagtcatcataggtttactgccgtaataaacaagcttgcaatctctgtggcctaatgcaataaaggtttatttttctcacatgttacatccactgtggattgcaggtgggctctggacctaggtgtttgaatctggtggctcctaagtcaatcctcagagcccttcactggctcctgtgcctctggctgccagatgagaagagagagtggggggaaatgcacaggagacctgggagcagcatctgtcacttccacccacaggcattggccagtgctccctccattggctctgcctaaccacaagggaggctgggaaatgttgtctgtctctgtgtccacatggaaaaggcactggggtttagggagagggatgagtcgtcgtttcaaggctgacctcttttctctattttgtttcttctccaggagacttcttggcatcatcacaaaaaaggatgttctgagacatatggcccagatggcaaaccaggaccccgaatccatcatgtttaattagcaacaaggtggcaattattttcagaaaaacactgactgtgtcatttaaaaagaaataaatgatatgttattatcccaatgaaagatcatgcattggggacagcagaaacaaaagcttttttggaaaggcggggaag

SEQ ID NO: 2985 - DNA, 75249 bp, human
cgcctcctggtgatgtcacggcgctcgcagccgtcgcgctgaagaaaggatgctcgaggatgctgtccaggtgggcggccgcgggcgcgatgcggcactgcaggtaaggggcgcgcggcgcctggatgccctccccggcgcccccggcagcgcggacgctgcaggtggagcccggcccgcgggcctgcagcccggctgcgcccccagaaacccaaagtggggcctctggctgctgcggcgcctgctgcccacagctgcctgctgcagctgcatgcacccggccggggatggcccgtggcaggcccacgcgtgacttgggtcttggcgtgcccgccccgagaaagcgggcaggggccagacagaaagacgggggagggaaaaaaccgctccggcgggggaacaaaatctgaagtgaccacactgcatgcattctaagtagacagaggggcttttaagaggtaactatcaagtgttttcctagtgtcattctgcttcttaaataacgacatgtttactaattacaggcctttgtcctcagtaattagcctcatttctttcaaagcaaaagcgggctggggagtggaaacttcttggttagcaatttaagagccagatgtgcaatctaaattgctttgcattattttgcaaggttccagcatttacagggcatacgtcagaaacgtattttttttttccttccaggtgttttaagtagattaaaaaagaacggtatccaatacaataaaaataaattgcagcttccaaagataacatgtgagcgtaagagacagctacatctctaagaaccaaatgatctttagcagagagtgggggtggagataacaccaaaacctaagaattcccagagttcttgttaattctctcgctgataattcgcttgctgaatggagaggcttgatgacagcgccagatggaggggtcaggtgacttcagttctagcatgacagtgggtgggggattttaatggactgtttctagagcgtttacatgcctttctcggggtcaggaagaaactacagccaggacgtgtgggggcacccttagggggagaatgtggcattattttcccctctaaaacctgacccttctggaagctttgttgtcactaaactgtattggaactcacatcatgaataatttgaccaaccagcaacgttggggggcctgtaaagcaatgctatttccatcaataattgaaggaggcatttctttcagaatttgggacacccagatgtgttgctgcagtaatttagtaacttgtttattgcaattttcttcctttggttcagtttggttacacaaattaagatccccgggtccccgccctcccttctcctccagcccaaccctagatagagcaaagcagatgatagaggtggatctaatacagacctagattccacttttggctttgtgactgtgcagccttggatatgtcatttagtgtctttgggcctcgactatctcgtcctcaaagtaacaaagggatttaggtcagggtgtctcaaccttggcactactggcatttggggccagataactccttgtggtgaggctgtcctgtgcattgtaggatgtttagcagaatctccgacctccacctactagatgctagtagcacttccccctcccagcccccagttgtgacaatcaaaaatgttgccagacattgccaaatgtcccctgagggctcccttgccccctgttgagaaccactgattgagatgatctcgaaatattcttcttcgggctccaagaattcattttcttatgattggtttgatgccaagcccttgatcagaaatctgattccctttcttaatatcacatatattggaaaacacaatgtgaaggcgtttttatgctgtgaatttccagaaatagcttctgtgaaaaggggaggagctgtttgtatgccatttgtagctgggaggcgagcttggcagaaaggagagtgttagggaaagaggaaaaaaacagagcactagatgaacgtgtgtggaaacctgccggggcttcgtgctcagcagacctggagcacgtccctggacgtagtctaaccctgggttagacctaacagctgagagtccatttccttgtctgcaaaaatgagaataacagtgtccactcggaggtgttgtgaggatgaaacgacacgacatctggtgctggtgggggacgtggtgaggacgagagggtggtaatgtctatgcagctaggaggaggcaaacacaaatggcccgcaccaccagcgacacggacactcgcttgggcagacatggtcgcatgctttaagcttcagtccaggactaaagatctggctttgacacctaggagggtgaccgtggctgcatcacttcaccctgcagagctgctgtcggatctgtaaagtggggccaaccgtgcttgctgactctgcttccttggctgttggggagggacggatggaagtgagagggtctgcaggctgggaaactcccaagagacaggaagcgggggtggcagcagcatagcaagggggggacatgtttactatgtgtgtgtatgtggtggtggtggggtgcttagaatggccagaaaacatttccttgtgccccaggctttggactttgatgtgtccctcccctgggttccctttccgttgccatcagcttgctctctctctctctctctctctctctctctctctctctgtctgtctcatctttcctggcaccatgaaaatggtctcctggggggagataggaaagccctggtgggggaggttggccttcggtgaggaagacccactgtgcagagggctagggtgagagcagctggctccatccactccccacgccactgtcctcacaggcttcagtccacggacatcccagggcaggcctgtcacgctcctgtgtgcctccagtgggcttggtgctctgtatgagccatctggccttgtctcttcaacaaggtaatatcatgaaagaaatttttaaaaagggaggtggggtattctccatcaaacgagacttaagagacggaatagccaaatatcacttgtggccctcgattggattcggcccaaacaaacgtgtaacaggcattttggggatgcctggagatgctttgatgtgactggctattaggtgacactaggagactgctgctgctttgattagatgtgacagtctgtgatgtgttcggcagcccctcggacagatgcagtgatccccacccctggcagctgcaacttggcatcaccctctcccctggggtttggtctggaccaagtaatgaacttccaatgaatacgtctagcaaggggtgggggagaggcacttccaccatgagggtgtaaaggggcttctgcctggggtgtgttttctctcttgggttgcttacactgaagctgccatgtcgtgatcagccctacaaaagggtccatctgccgtggtgaggacccgaggtccattccaacagcctgagaagaactgagacccgctgacggtgtgagggtgtgagcgggctcggaggcagacccttcaggcccagttgagtcttttttttttttttttttttttgagacagagtctcggtctgtcacccaggctgcagtgcagtggtagcgatctcagctcactgcaacctccgcctcctgggttcaagcgattgtcatgcttcagcctccctagtagctaggaatacagggacacgccaccacggctggctaatttttgtatttttagtagagatgggattttgccatgttggacaggctggtctcgaactcctgacctcaggtgatccgcccaccttggcctcccaaagtgctgggattacaggcatgagccaccacgcctggccgcagttgagtcttgagatgcttgcagccctgtgagacaccttgagctgaggcaccagctaagccactccagggttcctgacacagaaacagtgacatgatagatgtttgtgtcctgctgctatgctttggggtaagttgttaggcagcaatagatagctaatacatgtgtttatgtagaaaagtcttcttgtttagagatgtatactaaagtgtttagagatgaagtgtcatggtagcagtcatttactttttttctttttttgatgttttcttgagatctctttaatgtatgacttaataggagacagatgaattctcatacttggttctacattcaatctgtttcaatatcgcatgtcatgtagcctctggaaaattccattgtatgctcatgagagaatgaacttagaaaaaggcaaataacaatgtcagaatattgtgaaatgtttttgacatcatggactcccttaaagggacttggggagcccaaggagtccccagatgacactttgaagatcaggcttcaagatcaataatttacttttaaatggttcagttaaatgaagagagagaaagagataaagcagatagagccaaatgtgaacaactgttcagtctgattggtgttattcactggattcttctggatgatgttctgtgtaattgaaaatgttcataataaaaaattaagaaaaaaagaaaagaaatgtaaacccttagacacactggggattctgactgaataggtctgggggtgaagcccagggcttaacctgtgctccaggtgcccccatcacatgggccagaggccccagccactttgccccagaggtcctcgccttacctgcctcctctccacctgtcagccttgcagtagcagaccaaaggggtttagtgtgatgacgcatctcttctaccaacctgggggaagaggtgtgtggggacagtcccccctcctatcccttcccccatacacactttcccttggtaacaagacctttgtttaaccacattttcagtgggtggcttttttatgtgcaggaatttttttttttttgtgataagtatttttttaaatgactttcatttcttttctttttttttttgagatggaatctctctttgttgcccaggccggagtgcagtggcttgatctcggctcactgcaaccttcatctcccaggttcaagtgattctcctgcctcagcctccttgtagctgggattacaggcacgcaccaccacgcctggctaatttttgtatttttagtagagacgagtttcaccatgttatccaggctggtctcgaactcctgacctcaggggatgtgcccgcctcggcctcccaaagtgctgggattataggcttgagccactgctcccggccccttaattacttcttcattcagcaaatattccttgggtctgtgcgtctaggccagggtttctcaaccttgacactgtggacgttagggtccagatgattcatttttatggggggctgttctgggcaatgtagggtattgagccgcatccctggccaccatccactagatgccagtggcaccccatctcccagttgtaataacaaaaaatgtctctagacatggccaaatgtcccctgggggtcagtattgcccccagttggttgagtcctacaagtctaggcagtgggatacatgttaggaccaaatggacaaggttcctgccctcacgggactgatttgagctgagggaagaggaagtagctgttggataggctgtgtgttgagtgaaaggatggacagcaaaggatgcacagcactggactccaaacgctggtcagggagggcaagaaggcctctctgaggggtcgcacttgagcagagatccgaatggagagagagccacttgagcacggtgggctgagtgctcagggctgagggaacagccagtgcaaaggccctgaggcagggcaggacaggaagcgtttgcggaaagcagggagatcggcgtgtgcaaagtagagctacccagagagtaggggtggggacaggtgctcagaggggcgcagggggcaggccatcctggaactggcagttgtggtgtcaaccctggattgtcctcagtgtgatggaaagccactggatgctcctgtgtcggggagtgacatgttgagactgggttaaaaggactggctgctgtcaggagcagagtcagaggtgggtgagaaagaaagcagggcagccagcaaggaggctaggaggcgaggctggaggccagatggggagtggccagggtgaccaggtgagttggactgaggagctaacctctttagcagcaatgttgtcctaggtgccagagtgggcccttggtgatcaaagaagcctggcgtgggagggtagtgtgaactacagggcaggacatggaggctgcagacgtgtcctcatgcatccggctcagtcgcagcatcacctttgatgggcggtggcctcccagggacagcagaggaaatggccatgcacattcccacatgacacctgaaaagctctctttcccgcttcttgtcgtggctgaagtctcccaagctgtcaggctgccggtggctccggtgattctggctacacagcttgcttgctgtcctcgggcccagcacatttgttcctgccactgagtctctgaattggctgttctctgtggctggagggtcaacccccacacttgttcccttgttgccttctccaagtggccctggtcgccctgcaccgcctgtcacgtgcgcttctgcgggatgcagtggcctgcaatcgggggttcatggaagcccctgcctgctggcttgccatcttcacactgttcttgacgtggtcctgccctgccccagggcctttgcactggctattccctcagccctgagcactcagccccctcgtattcaacagagagcctgctgttggctgggttgaaagtagatgtgagaccggagccttcctcacagaggggacttgaacccctcttgaagctgcagaagaggagagtcctggaaggctggggtcaggcccttgacctgccctggggacgacacatgggaacagcagggtcatgaaggagaggctgtgggtgggcgctccccctgagggtggtgttcccctctttccatctgaggcagttggggcgcccaggatgggtttggggtttgctgatgtgagagctaccccaacgctgtgtttccttatgggggaggctgctcctggtcctgggtgctgggcctgcggctcctctctgtggctgccgctcccctgagccttgcccgcagtttcgcgatgcttcccgatgggctgactgtgtcctcctatctcttggctcttcacttcccttctgggttgatttggctaaatatgaaagttctttttcgccctccactctaacccctggaggtgctggttgggtgaaaaggcctctgtggttagcagatagccgagagattgttcctcttagcttagtcacgcatcacaccagctcgccttttaccccaaacatggaattggctcaaatgtcagcccgtgtgttggtcagagtggcctgcctctcttcaccgtggcgtcccgggccaccaggaacagcacatgaacgcggttttgggtgccttccagcatttaggctttacacacttgccagtcacgagtggctcctgaaattttctttttatccatgagggggtgtgaaccttggataagcagaaaataggttgttgtggagaaaacctgtcagaaaatggtgaagggaaggccaggctgtggaggtgccagaagagcgagggatttcccacctgcactgtcttcagcagctgtgatggcttgaactgtgtccccaacaaattcatagattcaagtcctaaccttcagtacttcaagacgtgaccttatttggagatagggccttgacagaggtcatcatggtgaaacgaaggcatcagcagcgcgcgtcccttcatctcagacttctggcctccggaactgggagaaaacccttttctgttatctgagccacccagtccgtggtgcttggttacggcagccctagcaagcacgtgcagcagcatttttttgtggatgcatgagagcgcgacccaggggcctttaattaagctattctcacacggtgtaggagaaacgtggcccccagtgccctctccatggaggcacatggctctgggtcctgaggtggcagaggcctgcctgctgttgtggagaaaggcccctgggacctgggctggatccagctgccccctcactgtgtgtgagacttaacctctgtgccgcagtttgcttatctgtaacttatctgtaacgtgggcctgagggaggcggtacttcatacacgggggaagtgcttagaatgaagccaggtacacggagccctgtacaaaggcgttgtgactattattatgggaagaagtctctggggaaattccaaacccttggctcttggcaccagcaacacaaacacctcacagcccagccctcctgtccctgggatgggggtgtgagaacactgaggccattgtgtcacccgaggccacatgtggttggcctcatcctatttccaacacgtgggctgggtttcaacgtggaacgaatggctgcatggccctgggtccataggaagcctgccatggtcacacaacagctgcctagtcctatggaagccagactgtgattgaaggaacacagggagtgctgggggcagggccggggccggggaggaagtgggaggaggaaaaaggaagtgtctccgctggttcgaggcagaattttgaaacaggcacagtttctttctgaacatccttttgctctgagcttccccctgtttgaaactccttggtcgtgtggccctccacccctcactgggggccaccacctggctcccgtcactgtcagtgccttcctgtcttctcccctctggtgtttggagggttagctagaaggggtggaatgagtcctggccacctcatcatcctaaaggtgcccgcattttaaaagcaagactcaaaatgattacaaatgaaaatgaaattcctggggtttcaggcaaggtggaataaggcagtgaaaagcttttgtattggagccagcctccaagatgggcctcgaccatcctacctccaggtgttcatgctcatgtgtggtcccctcccatatggaaccattcagggctgacctgtgtcaccaataggataccgtggaagcgacagtgtgtgacttccaaagctaggtcattagagaccctcctggttctcttggaccaccccctctagagaaagccaactgccatgtcgtggggacattcagggtatcctgtggggatgccagcgagcaagttggttgctatgtgagggagcccccgtccaactttcagatgacagcagccctggctgacatcctgaccacaacctcctgagagacgctgagccagaaagacccagccacactgctccccacttcctgacacatagaaaccgtgtgaatggtcagtgtaaatggtaattagtgatgcagcttcagataactgaaatgactagtaatggtccaaagctttcttggaggggaggcccagtgctggtctctccttgggtcagctccccaggctctggccatagctgccttcgttttgccccttctgaagctccacttttctctgatcgttccatatttgttcatggtattttctctctctttccttcctaggttggagaggagaggagcttcatgcaaagtttaggtctattgatgataaattagggcatattgaggatgagtttggatatatagatttttagtaaatgggcaacggtctgtatttcatgaaaatgtatatcctgtgtatctctttatagcctggaggcttcagtaaaatattccccaaatgccagtggggtttggctgtctgggcgttactttgggcattcggcctttgcagatgcgggatgtcatttttgatgcgagcagcccccttttcctccagcaccagggaaacacgccacagcctgtaatgcaatgtggagcccgtgtcctctgcccgctgcacaggggatttgccaactccagcgcctttgctttgtcagggctttcagacttctgacctcaattatttcagtgggaggtcatttttgcaagagaggatgcaatgggtgtttgaaaagagaaagtatttcacgggcacttcaaagaagtgttgcaagcatgccaatgaaaaacctcacttttgtaaagtgaagcagtgagatttaactccagctgatggcttgtttgggttgcctttggtcaacttttaattgaaatccatgtgcagaaaagtgcacaaaaggtaagcgtgcagcttgatgaattgtcacaaggtgaacacacctgggtaacagtgcccagatccagaaatggaacatgaccagttcccagaagccaccctcatgtccccttccaagggtaactgctatcctgaataacgccactggttccttctgcttgtttggaactttatagggatggaatctcggatccctttgtgtctgcttttctttgtgtctttcttttacttgacattaggcttgtgagcttcattcttattatgggatggagtggtacctctttcctcctcatagccctgtatagcctaatagctttctttgtatgtaaagtgtctcttttctgtcactgcttttaagagatcttctttttcacttgtttaacagttcgattatgctatgccttggtgtagttttcttcatttttttgtgtgtgcttggggtttgttgagcttcttctatctataggattatatagtctaatagtttaaatctttgtgtaaacaagatttcctatattgaatgttctggtcagtgtatctacatttatttccgagaaacttcttgagagagcttaaagggatttttaaggcagtttccctctcaagctgtcacctcctccacttggataaaaacagtgaaggatttgtcttgttgggctgataagaaaccgtcagcttgtggtgcttttagcctctgttatgggtccagagtccactccctcaggctccattgattctgtgtcgaatgcctgtggctggatatcaggaggacacctgtttttgtcagcccaactcttttcatgagtgaaaagtaacaagggaaacaagatgaattcagaaaaacaaacaaacaaacaaacaaaaccagtaaggaaaggcaaggtatgcccctcagacaggcattgctacaaattattatcatgtctttaaaaaaatattttctgtttttctttttaaaattttttaattttgctacaaattataaaactggtgggtgatggtggacgtttcaaaaccactcacgtgtgacatggcagtgacttcaggctggcctacatagccttttgttctctgtacatgtacagataaaaatctttcttgattctttttttttctttttcttttcttttctttttttttttttttgagatagagtctcgctctgttgtccaggctggagtgcagtggtgttatcttggctcactgcaagctccgcctcctggattcaagcgattctcctgcctcagcctcctaagtagctgggattacaggcatgcaccaccatgcctggctagttttgtatttttagtagagatggggtttcaccatgttggccaggctggtcttgaactcctgacctcaggtggtccacctgcctcggcctcccaaagtgctgggattacaggcatgagccaccacacccgccctcttatcttgattcttgagcatgtctgtgcagtgatgtccaaagcattcaatagctgactacttgatagggttttatatctattgatggatatagtattaataacactccctgtagaatagaggtagtatgtgtgcctggctaagctttttgtggcttagtggacactatttctatatagcaacattcagcaaacacttcattttatgcaggtccggatagtaaatagagatgagtaacataagcctttgccctcaaggagctcacagccaaatatgggaggaagcatgtttgtaaataatcacttgaacaaaatgcagtttctaaataagattgatgttaaaaatattaatataaacaatattaaaattttagtgattaaaacacaatggcaaggatgcaggtcatgaaatgagtggaaaataggaagggaacaaaaggttatactaggccagtggctcttaatgtgcgcccttggatcagctgcagcagcctcccttggaagcttgttagaaatgcagattccccggccccatccaagccttgccggatctgaagctctgagggtgggacctgacagtctgggtttccccagccctcctggtaatgctgatgcacgttcaagctgaagaaccactggtttagacggtgataagccaccagggttctgtcgggaagcctaggacaggccattttagtgcccacgttgtcccctaattgccagaagcctcagcacagcttggacccttttgttaggggactgatgtatgtcggcaatcaataaagtatattagggagtttttctgaattttttttgagacagcgtctcgctgtgtcacccaggctggagtgcagtggcgcgatctccgctcactgcaacctccgcctcccgggttcatgagattctcttgcgtcagcctccagagtagctgctgggattacaggtgcccaccaccatgcttggctaatttttgtatttttagtagagacggagttttaccatgttggtcaggctggtctcgagctcctgacctcaggtgatccacccacctcggcctctcaaagtgctggggttacaggtgtgagccaccgcgtccggctctgaattcttaaatgaagggaaagttttactttgcccaactagtacagcttactactttatttcttttatggattgtgtttttgatgtcatttctaataactgtttgcctagccctaggttttgctcatttgtgtaggagaggtaaagatcactcacatgggtttacacaggcaagggcataactggctgaagaaatataaaatgccatgtgatgctgccttcgtttgggtccttgcagaagtggaacttgaaattaggtttctggtgcaagttgatttgggaggggagtggggaagtgagaccaggaaaggaaggcagccattagggccgggctgttaatgtcacgcaatgggcgactggagcttaattccacactttggaaactctaggaaatggtgctcgctgtgtcatgggcccccaagatcacctctgggtctggtgatttcctaggagggctcataaaacttgacacatggcatatgcatggctatgatttagtaaagcaagaggacacagagaaaaatcaacaaagggaaaaggcttatggggtgaagtctggagaaaagcaggcacgtgcttccaagagtcctctcccagtggggtcacacagaacatgcctactcctgcccatggtgagttgagacaacatgtgtgaaatgtccaccagggaaggtccttagagactcagcgcctgggatttgtattgggggctgctcacataggcaccctctgcctagcacacatcaaaattccagactcccagagagaaagcaggcattcagcatagatcacagtatttggacaaagagtttaggcacagtgagccactcttaccagctctgggaatggtgggaaccctcccaaaatacaaattcccagatgccagccaagggccaaccttgcaaacaggcctttctaaggagagcagtctcaggtctgctatattacgtgttttctgcacaggtacaaagcacatgccttgaaataatctcattcaagggacaagggagtaggacatttgaagatgtctggttttctccagactttgccccgcaagccttttccctcgggagtcagttcttgagagtcatcgattaatacctattcccaataatgcacttcaggcatgccatgtaagcagagccaccttctgtgggtctcaaaacaatgacagtgaccttagactaagcgatatggttggaaattagctagagcttactggaaggttttgagtgatatgagtggggcgctggcagcatcagatacagtagttattctagaaattggatggggacaacagagccatgtgtatagggtagttcgcatgcctggggtcgtgtggcagtattgtaactgtgaatgaagagaccgaggtcaaggcttcgctctaacctccttaggtagatgcttccttcctgtgtctgctcattggaggaatgggaaagtgtgtgtgtttgtgtgtgtgtgtgtatgtgagagagagagagagggcatgcgtgtgtgtgtgtgtgtgagcattgtgggggcagaaaatcctggtacactagctgtattttaaacttccacttctaatctttcagttctgagcagcgtgaataggcagataaacaaatgtttgctatagcctcaaacattcatgccagaacatttttttccctccttccacacaagtaaattaagagaacagcggtctgttgtataatttgaagatggctattaatttgtgttggattgcatttcttaagcatgttatgttattcgaggagcaggagaccctggaggaggcgcttgtggggaagctttgaagctggagcaggaaggagtgaaatgacacagtctgatgacgatcacggtaatgcaggccttgcagcctggcgacattcttcaaaggcaactaactgcaagactgccctcttcccctcccctctcagacatctccaagaccctgccaaccgccagatgaaaccaatcttcctagagcctcgtgtggtggtctcaggcatcgcttgggagtgccttagaaattcggcgtctcaaatgcagtcttgggccacaccccagctctccaggatcagaatctgccgtttaataagaccctaagggatgcatggctcatccaagtcggagtcagatctcacccgaggccgcacattggcagcacctggggagcttttaaaaatgctgatgcctgggcgctgcctcagggaccccggtttaatgactctgggcggggcctgctccttgggctttctgaatgctcccacgtggttcggctgcgcaccccgggctgggaaccgtggggttccctggcagtacccttctggaattctccttccccagcctcccagtcacgtgactgcttaatctcctccctctgtggctctttctctgtcctctgctcctggctccccgatttctgaaggcagcccggtctcttttctttctttgttacctcctggccattctccaaagtgcctctgcgggggcgggagcttgtgagaaattcgagcctcagccatgccccagacctgctgaatcagcacctgcagtttaaccagaagcccaggggatgcgcatgtgcattgtcatatgagaagcgctggtctaggtgacgtaagctgggaaagaaacccagggaatctgctggaatgtagggagcctgggctcaggaactggaaggcgtctgtctgggtctctggcttgtttgttttctagctgtctcaacttgccactgtggtcatttggggctagatcactcttctctgtgcgggtcgtcctgtgcatttaggacgctgggcagcatctctggcttttacccacatcatgccatagcaatccccctccccagaggtgataaccaagaatgtctccaggcattgtcaagcatcccctgggggcagaatggtctctaggggacactttggtgtctgcctctggcctcattccctcccgccatacacccttggtagggttggtggttccaagttagccactaccgtggaaagagagacttcctttctccccctcgtccatgtgtgcggccctgcatgggtcccacgctcatccccatagccggtcattgtgcctggtggtcggggcactgtcattggccagattgggttctgtgccacatctggggccaggggccagctttgttagcaattgaaggagactgggagagttctgatggaggcacaaatggctattttggaccactctagcagccctttacggacccaagtcctccgctgacccttcacccaataacaagctcatttagcaaatatctgttatgtggcaacgaacagctgggccctgttccagggcgggcattttataaacagtcttcaggaccatcctaggaggtggtcttgttagcccatattgcaggtgagcagactgcagctcagcagggctggtgacacccatggcaacctgcggagcccagttgctccctaattccccccaccctgtgccctgctgtcagccctacctttctgtcacccccttgagctcttcctcccctccaggctgccctacactgccatatagctggacgaattgtaaaaggaacactgtgtcatcatgcctctgctcaagtcaggaaagactgttgctgctgtcatcttttgtcccctccccagtcccctcacctccctgcccctcagaatactctcctgacttctattgtgtttacgtctctacttttcattgtagatttaccaaagaattctggttcctgagctttgttaatttacttctgcccgtttttgaacatgatgtaaacgggatcacacagagtgtttggatgcatccggattcttttgctctgtattctgtgtttactcattgcaagcatactttgggaagtgcttgagtcaaagggtgggtagatgagaagccactgaaggtgacagaggaatggccgtgggtcagagagggaattaccttggcattacttgggcagagctggagtggtgggctacgcagttaggaggttgcggtgacctgggtaggagctccagcttagggtctgaaggccgtggggaggatggcaggtgaggcgtggtaggtttgggagggttgtcctgccttctctttctgacgaggtaggagttacaggttggaggagatggaaaaagggggaagcattcctcatacaggcttgttggaccagcaggagctgaaccagcagtcgtcttgggttgcagtgaagccccctctgagactaggggctcccagcaccaaggaactggcagccagcagccagcagccactgaggccagcacctctcgtaatccacaaggttggaagaaaagcagctcggtaaaggctgcttgtgatgagtcactggggctcctggaaaatctgtaagaaatgaagcttttgagatgtttatttttagctgccgtctgaccatggcctgtctctgaacttgatgttcttgggccctctcctctggctgtgtgttctagaatttctgttgtgtcctatgcttttcatggtgtcatgtgaacactacaggtaactgtgatgatcttgaacactttgttagcgctatggtatgatcatatttttattcatgagccgaggcacccggaatcttgaagcattcggatcactaattacttggagaaacttttctgattgtaggatctcacagaaacctctctctctctctctcccaccctctctctctctttctctctctctctccctccctccctctctctctctctccccctccctccctctccctctctctctctctctctctctctctgtgtgtgtgtgtatgtgtgtaataggaactcatctttattttcccaaagctttaaggttgaaatgttgatggtgacatcctttagttgcattgttgggtttctggaaactcattccttcccttaaataatcctaaggggaatgactgtggccacttgtctttatattatacttgtccccgtgggtcacgattatttgtttgctgggttttgttgggaggtgagggccgcaaatgtgctggtagctctggtgccttggacagtggcctggcaggtagcagatgcccaataaacacccatggtgtaaagcaggggccggcaaagcacagcctgcaggccagatccagcctgttcctgtttttgtaaataaagtgttgtcagcaggcagccacatcccttcatttccatattgtccgtggctgctctgctgtacaatggcacagtccagtaatcgcaatggagactatatggcatatggcccgcgaagctgaaaagatttcccacctggacctttctcagaaacatttgcaaactcctatcagttaagttactacgaggaaacaggaaggagcaaggggcaggaacagcttgtgggagaggctcatgagagccggaggtggttttagtagcagtttctaccctgcccacgctggcaggggaccctgccgggacttgcctctagggtggccttccttgcttgttggagactcttaatcttttaatctgagttatgactttccgttccatctgtccaagtcatctggggattagctaatagagcaagttggcaaataatctgacatggtctgatttgggaggggaatactggcataaacattggcaggtactgtggcacctggccactgctgggcagaggacagagggaacaggtggaagggcttcaaccacagcgttttatggacggtgtaaatactgatggcagcacaaagtgtaatggctccagatgggaaatcacccaagtgtcacccgcagtagaatggataactacattggggctgattcctcagtcaaatactgtgaaacaggagtcggccaagttcgtgatcctgtgggccaactccagctcactgcctgctttcgtacagcttatgagctaagaatggtttttgcatttttatatggttgagaaaaaaccaaaagaataatattttgccacacatgaagatgatatggaattcatatttcagtgtccgcgaataaagttttattgaaacacagcaccaggcattgatgtgtctatggtctctggctgctttgcaatgacagcggtggagctgagtcgtctagacagagactgcatggcccagaaatcttcaaatatttactctctggcccttcacagaaaaagtttggtggcccctgttacagtgcaaagagaatgaacagatagttacactgaacaacatgggtagatcttgcaacataatatagaatgaaagaagctggaaacaagatttcatttctttaaagttcagaagcaggcaacagtaatctatagtgtgagggttgggatagtggttaccctttggggtgggtcagggactagcgggggcttgaagtggtgtctaggggctggtcatgtttcgtcccatgatctgagcactccatacatgggtgagttccctttgtgaaaatgtgtggagctgttcatctatgatttttgcattttacgaatacatgtttacttcaataaaaagcttactcaagaaaagtgatttcagtctggcagctcctcagaaggttaaacagagttcccatctgacccagcaatccactcctgggcatatacccaagagaaatgaaaacatatgtccatgcaaagacttgtacacagatgttcctaacagccttattcataatagcccaaaagtagaaacaacccaaatggccgtcagctgatgagtggataaacaaaatgtgatacagccacacaatggaatcttattcagcaataaataaaaaggggtgaagcactgatacgcaccacagcctggatgacccttgaaagcattatgctaggtggaagaagccagatgcaagaggccacatactgcatgattccacttactgcatgattccacttatacgaaatgtccagaataggcaaacgcataggatggaaagtatattagtggctgcctaggctgggagaaggaagtgattgctaatgggtagggggtcatttttaggggggtgaaaatgttctggaattggatagtggtgatgattggacagccttgtgaatttcctgtaaaccactgaattgtacactttaaaagagtacatcttatggtatgtgaattacctctttaaaaatgctgtaagagattgctgctacagacctgtgtgtatctgtacaagtcagaaggaaaaggtctcaaggtgacagccacctcatccattcttcctgctactcctccaaatgcagatatcttgaaagttgacaggcagggggaatgcctgacttcccccaggtaatccagactcttcctctagatccaagccagttgagtagcacagagcagtttctagaatgtagctaacatgggcatgttaattttgctacttttgtttactaaaactgcagttctcagaaaaacaggataaactaaaagatcctagataacttgcttcctggacttttcctgtgattatgcctgacttcgcccccattttcctgatgtctgttttcctttggtctgattggagaggaatgggaatctatgtagtagccactggggcccattcccatagctgagcctgggctgtcggctccttgctggttcctccaagacttcattgcttcacagccaatgaaatggagcagtaaaaaaacaaacaaaaaacaacaaaaacaaaacaaaaaacaaaacaaaaacattaaaaaagacttcactgcttacctgtaggttgctttttatatatagttctcaatctcttctgaattaaacttcttggtccccacttctagatgttaagggccataatggttgcaaatattgtgataacttttgagaggatcccttttgagggtgcgagatgactacccagaggatctgaaggttttcattttgctgacactgaagagtgtatttcttaggattttctgctctgtaatgacagataatcacagctggcagtgaagatagcgctgaactttctgtaaagtcccagccctaaacattatctgtggcagagacaaacagttttaattaatgacaaaaggtttgcttgtccctgcgagggtgaaaggggccggtgctgtttcattccctgtgccatgtactgggctgaaggggcaggggagggagcatcccagggtcctggcttttgagagaggggcagagagggtcagctgtggtcacacacccatacttgggagtcgtacaagtctcttggttagtggtcttgccactttgaatagaggtatttcagatttgaaagaaaacagtctaaacagtctcctcaaagtaaatgctttgaggagtttttaggaaaagctatttcgaatgtcaggcatagattcatgttttaatggcctcactgattcttggtaagtggaatcccccagaaggtcccccagaagctcagttggaccaccacaatctccctgaacagaactggagtccatcaggtcccctctatcagttacagaaagcagaggagtgagcagatcaacctcagaaacaaggcgacatgcagggggataaggaaggggtgttttcatgaaacatgattttcattttaacaaacatttatgaagcgctaaccacatgccaggcacaaattgctttacaaatgtcagctcattccgtcttcttcacagcaccctgaggcaggtagtgctgcaattcctacttcatagatgggggagactgaggcacagtaagaaaggtccaacaacttgcttaaggtcacacgggtggtaagtggcagagctgagatctgaactcatgcagcgctgttctggagtctgtgttttaaccagtatgcgtgtgatgctgcctctcttgtgatgaacatcagaatatagagggacaaagtacaatattgaagatccaaatatctcatactgccaatttgttttaaaatacaactacgaagaaaacataccaacaggttatgggagttatcaagggcatgatgatgggtaatccttattttttttcttgatagttttctgtatttgtcaagaagttttgtaagttgggtggttggttgtgtgttttaaaaaaatagccacaataatatctctgacttcggaatgctcatctagaactttgccatttcctcatcaagaggtagagtctactttctctctccttgaacctgggtgggattttgtgactgcctcaatgaacagcaagtggcaaaagggacggtatctgacttctgaggctgagccacgcaaggtgatacagcttctgccgggtctctctctcttaacacacttgctttggggcccagagcctctgggtaggatatactgccacctggccgggcgcagtggctcacgcctgtaatcccagcactttgggatgccgaggtgggcggatcacctgaggtcgggagtttgaaaccagcctgaccaacatggagaaacaccatctctactaaaaatacaaaattagctgggcgtggtggtgcatgcctgtaatcccagctacttgggaggctgaggcaggagaatagcttgaacccaggaggcggaggttgcggtgagctgatattgcgccattgcactccagcctgggcaacaagagtgaaactccatctcaaaaaaaaaaaaaaaaaaaaaaaaaaagaaagaaagaaaagaaaagaaatactgccacccaaagtcacatgctgaagagaccacatggggatgccacatggaaagagagagaggcctgggaaccccagctgttctagtctccagctgttgagtctcttggcccaggcaccagatgtgtgagtgaacaagccttcggatgatgccagctccagcccctgtctgaccaagaccttgtgaaagaccctgggtgaggatggtcttgctgagtccaatgagaccccagtaccaggatagataaagatatgatgggctgcgtgcagtggctcacacctgtaatcccagcattttgggaggctgaggtaggaggattgtttgagcccaggagtttgagaccagcctgggcaacatagtgagaccccatctctacagataataaaaaaaaattagccagtgtggtggcatgcatctgtggtcccatcttctcaagaggctgaggcaggaggatcgcttgagtctgggaggttgaggctgtgttgagctgtgattgtgccactgcactctactgtgggtgacagagtgagaccctgaaaaaaaaaagaaagaaaagaaagaaaaagaaaagaaagaaaaagaaagaatcctttggaatggctaaagaagatgccccaactgtgtctggggaaattaatgcaagttccacagatagggtgaaacagaacagggttctgcagtgtgaataggagctttcaaggcagaggagaaggttcaaggtagaagagaaaagcacattcaaagatacgggtttctacctgacatttttggtcaaacatggataaccatgattcacctagggtagcatttttatattcagccaagccttgattctacttagaatctgtccttctagatcttgatctaggtgatttcctgctttctttcatcttctagaacctgttatgttattgctaatacccaaccataaaaagtccaggtttccttcgagtgttacagatccctgttctgagagcgagctgacccattcagagtcacttttaacatcagagctgtaaatgacatcattaatactattgtattaatacatgcttgtcttcgttgggtcctgggtgaagtgagttttactggacaggatctgctgttgaagaacttgagcctgattccttggggtcttcatgcttggagaccaaacctactgatacttttttgccttgaggcattggttgcaagatataggtgtcctgcattccttccacagttcctttggaggcaaataatggttgtgtaggagagatgttctcttgtcaggcaggatacttccagcctgaactgaggcaaattccactccaccctctcactattggtactgtcatgtatggctgctccagtcctccccagagttggtctgcattgctccagctaacttgacctgtcttccttccttcagagctcaagttcattctacctattaacccataattatcatgctgctgaataacaactccttcaaaggactcagtggcttaaaacaacaaccattcattattttcacaagtctacaggttggctgcatggttggatggggccaaagttggctgatcttggctggactcacacataaatctgtggtcggctggacctagatgattttttccccctttgagatggagtctcgctctgtcgcgcatgctggagtgcggtggcgcaatcttggctcactgcaacttccacctcccaggttcaagtgattctcctgcctcagcctcctgagtagctgggactacaggtgcctgccaccacacctggctaatttttgtatttttagtggagacggggtttcaccatgttggccaagctggtcttgaactcctgacctcaggtgatccacccgcctcggcctcccaaagtgctgggattacaggcgtgagccatcgggcctggcccctagatgatcttttaatcccaacctcacaatagacaccaacacctccttctgggtccccagggaagtcctctgaggctctgcagatcagagcctgtttattttcctcaggaccactgcatgttccgtcaaagtttaaagatatgattgctctctacagtgattttttgtttcaagcattattgcctgaagtagttgtttgactagagatgtagttaaattttaggtggtatcaactccttttgaatagactgtccaagtctctgcgattctatctgctggttgggtttttctgacaagggctctcttggagggtcaacagcctgtcgtcttgtttttcccatcagagattttctttcccacatatattaagaggttattttcatgttgtttttgtatacatgagaatgaaatctttgctttctaattttactctcttcctcatatcattggttgctactgacttctgcgatgtgattcttccctgggcactcatcagggggtattattttcaacttggcatggctcaaacctcaaacttttaaagttttaaagcagccgagttgcactgatgatcaataaatcaatcactgtgaccactttattgcttgtaaggtgattaccctactttgcccatagtgactcttcaatttgattaaaatgcagtttcattgggtcgtggttgagtcctctagatatataaatacatgagagaagcctgcactcaaatgtttttataaccacccttcagatttttaaccatctatgccagcacttttgtggtcctcatcctataattcaaatttccatgctctttgccaaagtaattcttatttatgcatattccaacctcttgtctctgtaagactgtattcttttttctgctaactggtggtgagccttggtcccactgcaaagcattttctacagctgaaatgagctcctgtgcaatctgtaaatcaggctctgatggtgggagaatatgggagatggtgttggttcactcgcgattgttttccaggtgaggagagctggaatagtgggagtagaattattatcttggataggaaaggaagacacattcaactgtgctactgccctggcagcaggagcccttttgactgcattttaagacattaaaaatgagcatctgtcctggagctccttgcccagggcagcgtgccaccagcttctcatggctcttggctcgcggcaggttgtcccacctcccttgtccagctccagggtggccccactcacatagagggctcctgccatctgcagattgcctgggctcccaccaactcattaaagtcttgccagcattttcactgtgccattggagtacattttgaatatccatgatgacaatcacataggctgcctgcctgagtggtccactttgtctcccataggaaccaattattgctttgattaccattattttcatttaaaccctatttgcccctccagccctgtcatttggacaccttgcttttgcagaatgtgaggttttccaggaatgtatataattaattaatcctcatttgcagattccatatttgcaaatttgcctactggctaaaatgttatgtgtagccccccagatcaatactcgtggagctttcgaggttgttcatagatacgtgtgtgtgtagagcgacaaaaagtgccagcagtgcccgttccttgctgaggtctgagaaggcgatgctctgccttcctgcttccactctcctcctgtcaacaagggtccttttcgtgttctatttagtgccatgtttttcacagttttgtgctttttttgttggtaattttgctgtttaaaatggccctgcaatgcagtgctgggaagctgtctggtgttcctgagtgtaggagggctgtgacatgttttatggagaagccttgttcaggcatgagtgatagtgctgctggctgtgaggtcaatgttaataactcaacaatatctattagagtgtctttaaacagaagtatataaacaaggtacatcttgattgtttgatgaaaatgtgaccaaagattttgcaggaacttaaccctgtattctcttgggaacagtagttcagtattcagtaattcagtgtttgaggtgactttatagagcataacctccacgaataatgataattgactgtgtatatatttcattacagcacagatgcctatgctgaaataatttttcttatataagaaaatagggcacatggactattcttcttgcatggccatggcatgtcctgctcatgtctttaacgaccggttttcttgcccaggtgtaattagcatggtcaatgcgggagcgatgagtggctctggaaacctgatggatttcctcgatgagccgttccctgatgtggggacgtatgaggacttccacaccatcgactggctaagggaaaagtcacgggacaccgacagacacaggaaggtaggtggcattccgaaaggacacactgcaaatggctaagccatgttttcattcaaaagttactgagctggggcttaggtccacgtacgtgtcatgtgctgggttagggtctaaagaagaaaagagccagtgggaggagcagatatattggcagatcattgtactagcaggagctttgggcaggacgttgtgtcatatggagggattgtggtgtggaggagagggaggggactttgcaggtgccatttctggaacctgttttctcatccatgaggatggaagtgattatgcctgaaaaggaaatgagattatgtgtatatgaaagcacatatgacagtgcctggtgtctagttggcaatcagtatatattttaatggaccacaatggttatctgtcaagtgctgtgggatcatttaggttcggttagggaagggtttttcagcaagggtaacatttcagttgggtcttgaaagatgactaagattttgctaggcagaggaacggtgaggattctaaacatcaggaatgccccccttttttaagtcacagaggcatgaaagaatctgatgtatctgggcaattcagggagctccgaggatctggtggaggattcctgcagagggagggatagggatgagtgtggaaatggaggcagcagggccacgtggggaacggccatgctggcggtggagaggagtttgcatttcatgctgaaagccacagaagacaataaagatgcgctgcaaagggagaaacaggaagcttggaaatgagtccaggagaccgaaggcagtgatgtgtaggtggagagaggggatcaggatggagaggtattttgaggcgccacggacgggattcaggggaggtgctggggccaggaggggaatggggtcacagaacaccaggctttggcctgatgaggatgatgcctttgatgcctagaggaagcaaggggggactggcagactgcggaggaggccattgagttctgtgtagatgcgttggtttgagctgcgctgcggatgggtgatcacaggtggcgagaactctgtggttcaagggtgagggaagggccggggggagaatgaggtccctgtgtgcaagtggaggctgaagctttagaaacagccacggtggcgtgggtgtgcagagacagaagggaagaggtagtcaaatccccaggcagtgcccagagttaccaggtccaggggaggcagatggggagcctgtgacaagaggggaccctgccaagagcagtcccctgtgaatggaaagggtgttgtgtaggggcctgctcacaaggtcaccctctatggagaggtcaggtaggaggcgagccagcggcatgggggctggcggtgaggggagagctgcttcagacgagggtgaggagtgacatggacagtgtgaccatgtcacatcgcctcacgagggctggcacgaaaggaggaggggaatgtgtagggagccaggctcagtcatgaagatgttgcagcctcttggctctgcagtgcaggaatgtggggtcgaggcagcattccctctagagcacagctcagcagactgcatcctgcgggccaaagccagctggcaccttgttttagaaataaagttttattggaactcagccatgcccatccatttccatatttttatgactccttttgtgctacagtggcagggttgaggagttgcaacggagaccatccggcccgcaaagcccaaaatatttactctctggtcctttacagaaaacatttgcccaccactgctctaaaaggccgtgagggaatgatgatctcagaggagcataggattctgttagcacagggaggtgtgtgtaggtagtccatctgctgtgggagacgtgatctgtgccagctaattctaagttcgtgctgctaaaatttaaccttgaaaacaaaaggaggagatgaagtctgtgtgaagaggctttttaatgaaacttagcaatgtaagttaagatagtaactcatattcagaatggagacaccgaaccaatgtcccccttcagcatagcttttaaatcatcaaagatcaaatcacatttagtatgttttttaattaagtgaattatttgagtgtgtgctcgaattctttggagacttttgtggcatctttatagctctgtgaactagaaagctcgtcgtaccgttgcggcacataactgaaagaatcacatcagtgggaatttagctgcttgatgacattcattttattttcttaattaccctgtttcccgaggaaacagtttcaaggaaaaaagcatgaattcgaaaatgcattcggatcagttgctgtatctgctttgttctagatcaccagcaagagcaaggagtccatatgggagttcatcaagagcctgctggatgcctggtcgggatgggtggtgatgctgctcatcggcctgctggcgggtacgtggatgggcatgcggcactcccgtgggaagctgcagaggccgaaacctcaaaacacgaaccctctgggagatttggaatatagcgcgtgtcgcttgtcgcttttacccctgtgggagggatttattacttgaaatatctaagggcaaaatgcatggctgtatatttaacctaaaatccatcatcaataaggcatgcccaaggcatgagctcaggcacaggcttctgaagagctgtgacgatagagctggtagcctttccacacagagcagagttttcttactataccggatttgactgaaaacacacattttttttggaaacggtcttgttccattgcccaggctggagggcagtggaatgatgccagttcactgcagcctccacctcccggggttgaacaatcctcccacctcagcctcctgagtagccaggaccacaggcatgcgccaccatgctcagctaatttttgttattttttcatagagatggggtctcactgtgttgctcaggctggtctcaaactcctgggctcaagccatcctcctgcctcagccaaagtgttgggattacaggtgtgagccactgagcccagccaagcacacattttatattcggttattcttgattatgtagatgacaacaaaatcagggactgttttatcttcaataacaaaatgtcatatgagattgccttttgctactactggtaggctctgggatgaactggaaacatcctgcaacagtcagcaccatgctagacacccacgggagctgaggcaggcccaggggcctccatcatcctgaccctcaggaactctgcatctttcctttttagaatcccaacaccgtgtttgcgagcagtagatgtttccagagtaaatggatgctatctggaggggaaacacgtctttttaatatcaaacgcaccagcccttccgggaaatagtttcctgaaacttatgtccttttaggagattgtgaaggttaatgtctaagaataaaaaatttggcatgacgaagaggtttccttaataaaaatcccctgcatataacaacataatagttatggttagagaacagatcagggaattgactagaacacaggcagaatatatgtagtaagtggtctaagaaggacagaacacaaatggggcacagatagagttttgtgattccaggggctttcagtttccaggtgatcttgatttattccctagctcatcggaggaggggcttggttgccagggaagggctctacctccctcacctgcctcagcattccgtaaagagctaagaggaatgctcagagggggagttctttcctactagtcacagatgctgtctgtccgtttctccaagcctgtccttcctttaccagtggcatttcccgtcatgtactggcagcagccagggcaggaaattagacttcattgtcacaagggattggacgaccaattttgcttgactgcttctataaaggcctttgaaggtgggccaggtgggagtttgctatgaattttgatgtccttatttagagtagattgataaaaccttatagtgtgtcatttttcttggctcgtaggaaggagaaataaatagggtaaatgaagaaactcagaacaggaatagatgttctgataacggcacagcttagattcattgactgacctaggagcccaactgggctgactttaatctgattttgaccagctggctttattatccacttgatttccatcagctctttcacgagggggaattaaaaacaatatgctgctgccctggcttcacttaaacagtatctctggagaggacctctagcttgaatacagcctgcccctcccctctgtgattgtaatgtgcagccaggggtgagcaccactggccaaaggagagcccatgcgcacgtcagcaggggaatacatgggagggtgagaatggggtgatgctgaaaatgaagggactacagtgttcttttgatttggatgcactttgaagggacagccagagagccacgtcccactcacttcccccttcctcgctggactaacagtggagaggacctggggtctcactgcctggccggctgtcccctcagtggctgttgtcttcggactcccctcatgggtaggcccacagcatctccgcatgtgcttatcagaagtcaccgctaggtgtcactgttggaccacgaaagaaagctgaggcctgctgaagcgcagtcagaaccagaatcagcaaggaagattgggtgtgcagtaggggggttgtgaatgaatgaataatgatgaaacttggggtgatcatcctgtttgcccctggatatctgcaggaccctcccatcttcttcaccttcttcttcaaatactgcacgatgtcacttatctgtggagtccaaaaaaataaaaccagtgtcatagaaacagagtagaaaggtggctgctagagggaggggtggggacaggatggggaaagagatgttgatcagagggcgtaagtttcagttagactggaggaataagctttagtgagcggtcgcactgcatggtgaccacaattaatgatcatgtattgtatatttcaaaattgctaaaagagtagactttaataatctcaccacaaaaataaactggggaggtgattcggttggtgcgaaggtaattgtggtttttgccattaaaataacggcatgatcggatctttaattagctcgatcaagtctttctataatgtatacatagatcaaaacatgacattgatatacacaattattatgtgtcagttttaaaaagttaaaaaatcaagataatgagctctttgcctttgtttttcctgtggaaaaacaaagaactgtggatagttctaaatttgacattaccggaccctgtggaaagacctcatgaaatactaaatattatggttcttgcgtgctgttgctagggggcagtgtttacttagctgactctgcaaactagcattaagcggaaccaagcttgcatccaggatttcatgatctagagaaaatactttgagcatgtaggatttcttttcactgggtttcagtttccaactttaaatcaggaaatagttttcaccattccacaaggtatatgtacttcaaaacatcatgttgtatatgattacaacatacaatcttatgtgtccattttaaaatgaaagaataaatcaggaaatagctaatgatatctctaacttaattagactaattatatatatttgtatatttggaatcaagtctttcattattgaattgcatgtttaaaaatttcaaacctgtctgatatttaaaatttaaaaaacaataaaattacatccctctctctgtaagcctcacctccctcacctgctctatggatgtatatatgtatgtatgtaaagctttattgaaatataactcacattccatataattcacccatttaaagtatacaattcagtggtttttaatgtatcacagagttgtacaaccatcaccgtggtcgattttagaataattttatcatgcccaaaagaatcattataccctgtagctatcaagcccctgctccccaaccatcccccttccagccctaggccactgttaacctgctttctgtctctatggatttgcctattctgggcatttcatataaatggaatcatacaatatgtggtctttgtgattaacttattctactcagcataatatgttcaaagtttgtccatgttgtagcacgtgtcagtacttcattccttttcactaccaagtacaattccattgtatggatagaccacacgttgtttatccacttatccattgatggatatttgagttctttctactttgtgactattttgaagaatgctgctatgaacatttttgttcaagtgtttgtgtgcatggatgttttcatttctcttgggtatatgcctaggaatagaattggtttttttgagacagggtctggttctggcgcgatcatggttcgttacagactgggcttgagcaatctgcctgcctcagcctcctgagtagctgggactataggcgcgtgccaccatatctggttaattttttttttttttttttttttttttttgtagagacaggatcttgtcatgctgttcaggctagtcctgaactcctggcctcaaacgatttgtccacctcggccttccaaagtgctgggactactggcataagccactgcgcctggcccttatactttttaacagagcctttaatatacttattttctcctgtcccaggtacagttacacaaaggcaggggcctgggtctactctttgcactgctgtattcccaagacatggatgagtaactgccgtgtagtaggtacatgttcagtaactatcccttgaatgaatgaatggacctgagttttctgattttttcattcatttatttattgcaatattttattcaacatggatatatagtgccaaccatgcacctgacatggatataacaatggacaagacagatagggtccttgcccacttagagtggacacagggtctggatgccaggcctgaccccccactgtggtatgaaaaccaaacaatgaaaccttttttacccaccacttatagactagtggaagtacacacacacacacacacacacacacacggagaaaaagagaaagagagctaattgtgatattaggatgcgagaggtgtggtgatggggaaggacaggcagccacaggaatgccagggaagtacacctaacccaggcttaggaaatcaggaaagacttcccagaggaggtgatataaatgctggaatctggatgataagtaggagtctgatgggaggggagggcagtgcttgctgagatggtgcaggtaggagagcgtggcacattccaggaacatggagtgggcagggtgtggggagttagtgagggaaagagatgaagctggagagatctgaggggccagctgtcagggtgggtgacctgttgaggatttgggtgttctcccaagaataatgggtaaccatggcagggctttccacaggggagtggcacaggtcagtctggcatttggaaagcctatttgaccacagtgtggagaggccatgaatggggcaggactgaggctggagaccagagaggaagctcctgcagcagtccagccagcaatgacttcaacacggtgatctgaaagacagcccgagtggggatgggggaaactgcagtgattcaagagagatttcagaggtggagctgctgggatatggggattgcctggaagggggttgctttcccagatttctagtttgcacagtagtgtgcctggatggtgggttcctctcccagttgggacgaagctgaggctgggaggaggatgctttagttcggtgtcggatggtggtggactgaagtggagatatctagtagacccaagaaggcaaatagacttgtgttctttgacaatgcccattcattggctttgactgcctggggctttgctacaaagatttgggagggtaggtccacaagtgtgtgtcatgattgattagtgatgtctgtcatgggcatgtcaaaagaattgtgaaggggaatccaatagagtgtgctattattgattggtgatgtctgctgtgggcatcggaagctgacggctgggctatgtagtgattggctctgtaatagccagtgggctctatgtgcttggaaaagcatagcttgagatgtacatttatacctaatggtaaatagtaggatatgaataaggttgccagggttgagagcatagtataaaaagagaaaagggtttagggtcaagctttgaggaaatggcctttagaagttgggtggaggagtcagaaagatcagaggagtcagagcaaaccagagagtgaggaggaaagcaggagagcatgatgtggaagccacgggaagaggtgtttctggaagggtggagtggtcaacagagtcagatgatgctgagagctctggaactggggtcagcaaactttttctgcaagaggccagagagtaaatattttcaggtttgtggcccatgtggtttctatctcagctcttcagttctgccactgtagcatgaaggcagccacagagtgcatgtaattgaatggtgtagctgtgctccaataaaactttatttacaaaaacaggctgtgggccagatttggcccatgggctgtagtttgtggatcctgttctagaggaatgagctaaggccattgccttagctgcatgggaatctcctggtagattgaggggatggactgggccaagggaaggaaagagattggatggtgactagagggaaagtggaaacagggagggttttttttttttaatgtttaaatgctgatggcaaggagaggaagaggttgaagatacaggagaaggaaaggggaatgggaagaacgaggccccatggaggaaggagatgtagagctgaggtgggcggtgtccgatgcaacaccaggagaagagaagggaggggtgagtgctgatgccaggtgtggatgcttttggtgaggatgtggatgcagaaccgatcctgtaataatgatgcagtgaaaaggctgaaaaatgaagatgcttgaaagcattctctgcctttgtgagagatgagaatgcattattctggaaagagacccaaggccgccttttgtgatccattcaactgcacattccgttttctcccatttctattggcttttaaaatacttatttagttttatagacccataattctttataatttaaataatgcagagagttttaataaacaggatcttcccgaatttggttctcatttggtggcaaaaccttactcatttatgatgtgaggccgtcgtagttgttatgagtccattttgtctgaattatcatgtttccctgagaaatattaatgtgtgtgattctaggatcctgccccagaagccattgagagagttctgtcttttacactataaatacccaatgtcaaaaacttggaaagggaaaaattgcaaaagttgcttgtctctcctacccagttcaagctactgaaccctttgtatttctcattgggcttgtgctgccttgcccataacataaatgttcaagtgctgcaagtttaatgaaagaagcttcctatgtaagtgacagccccattgcaagtttattgcctgctctggaatctgggccatcattgctgatgtgcccctgtctggccgccgtgttggtctcattcttgtcgcatcatggggcgattcctcttagtggctcgtgttacttcttccaggcaccttggctggggtcatcgatctcgccgtggactggatgacggacctgaaggagggggtctgcctgtctgccttctggtatagccatgagcagtgttgctggacttctaacgagaccacttttgaggacagagacaagtgtcccctgtggcagaaatggtcggagctgctggtgaatcagtcagaggtgggtatttgggcagggtcctggctggggacccctgccgttccatgcgtgcttgggaatgctgctgggagatttgtgaatgtctgtgatttcaccttcaagtgcctgctctgaagttcgtggcttaacactagatgacgggctttttccagctctaatgctaccactcaaacttcacttgcaaaacccttccccactgtttcatgtgcacaatgcatatatatatatatatacactttaagcctcatatttggctttatcttgttatatttggctttattttttcttaccgaaggtggtttgctgatcatgctgaagaaacaaggttgactttgatatcttctaattgagaagaacataactttttaagttatcctttaaaaaaaacagctttagtgagataaattcacagttcacattgttcacccgtttaaagtgtacgatttaatgcttgtagtatattcagttttgcagccgttaccacaatctaattttagaacattttcgtcatcctttccaaaactctgtctccattagcagtcactcccatgtcccccaacctgccagctctgagcaaccactaatctaccttttgtctctctagatttgcctcttctggatgtttcatgtaaatgaaatcatacaatgtgtggactttgtgtctggcttcttccacctagcatcatgtttccagacttcttcctattgtagcatgaaccattacttcatttttttatggccgaataatattctattgtatgaatggaccacattttatttatccatttgttggttgcttttgctttttggctatgatgaatgatgttgctatgaacatttctgtacaggtttttgtgaagacatatgtttcatttctctcaagtatatatctgggaatggagttgctgggtcagatggttactctatgtttaaccttttgagcagctgtcagactgttttccaaagtagctgtaccattttacattcccaccagcagtgtatgagacttccaatttgtccaccttcctgtcagcacttgttattatctgtttttgattatagccatcctagtggttatgaagtggcatctcattgtgctttcagtcatcttccattgcattttatgaccacattatagaggatgttctgggccttctataaagagaatgccctaggcacaggagataatagtggtgaaccacagacctatagcatttagagcttcagatctttattaaaatcttagttcaggaaagagttaacttctaacccatttcagtggttaccaccatgactatgagttattaaaggatcagaaagccacgtgaggaggaaccaggttgtcaagcttcacattaggggtaatgtgaggatctctcaagctagaactaatctttcaaggtatatgtaatctatttatacatctcctcccttccccactttttttttttttttttgcctgactgacttaccacagctgaagacatttggaatgcactttgccatttttgctaaacctctttctcagtggaattgaaaattaattccttcaaatctcagaaggagacagggatcttgaaatctcacatgttctcagtgctctccattacttccaaaaagaaattctctacttgggttgatgggagcgggcagacagaattggctgtgcgccatatttttattcttctctcctacttgcaatgtgtgttttggggaaatacagccatccatcttttcagctgtttttaagatttatactttgattcgaagaattacctttagtaagagtgagagttatttttagcctccaaaaaagtacatatttaagtgggtgaaaggtatttcttagtccgatttctcaccgcatagggtgtgaatatatgtgcttgtaaaggccagagcagtctcctggaacgtgtttttgcatttaataggcacacatgtggctgtccatggcctgacttgtaggtgacctctcttttctgccccctttacttaagtaatccagatggtggcaagaagctgaggtctagagagtgtggtctgtacccagcagaccaggcctttcacgcataggaccccagactgtgtttttggttcagaaaaccttctccatacatcagataatttggaataaatggttcaatgaattattctgaaagtgatcacgtttttcttctctgatagtgcctctcaaatgttagtgcgcatagaacctcctggagggcttgttaaaacatattgacctgggccccagccgggagtgtctggtgtctggttcagcagttctcgggtgaggcctgagagtctgcatgtctcataagccactgatgtggctggaccatggaccccaccctgagcagcagtattctaaaatacaggcccgacccgtattcattggcagtgcgggtgcttgctgtgcttgggcgtggccttaatgaaagctaagagagaccaagccaccacagacaagacaaaactaatctgccagggtctcggaggcaggattttctgcatcacacctttgattaactctatgcaagtggtgattaaaaccaagcatcatccacggtttccattactgctgagccttccctgtgtagaaggcgcgtgtaaacagctcccagagaaacacccgctgctctgtttgtgtgtactgactgtagcaatagcaacagctgataaacctacgctggccttttggtttatacaggactgggaccaaacctgcccaatcccgtcaaagcttttgttgtcaagacagatggggaggggttgagtctgttgctcaggtcagctgtggctaatgtttccttttgtgttttgtgtctgttgtctagggtgccagtgcttacattctgaattacttaatgtacatcctatgggcgctgctgtttgcatttttggctgtctccctggtgcgtgtatttgcaccatatgcctgtggctctggcataccagaggtgagttctggctgatttttttggtaccaataataagaatagcaaattcttctgtagcactgtcatgccaagcacagttccaagcgttttacttctactaactcattaagtttctcaataagactatgacgtaggtactattattctgcatttgatagttgacgaaactaaagcacagagaggttaagtgacttgccccaggtaaccaagctggtaagctgtgagttgaacccagtgttctgacttcaggatttacacactgtcttcaagatttctgtgctattgcttctcagatgataaaagccttgtctttgtaaaccaggcataactcttaaagcctgtggaatcagagttcattaaccacacacataaacacgctgtaataactcatcagtgcatctgtgatgtaatgtgagagacgatagtggaggtttgttgctgtgaaagttcactgatgatgaaatctctcttgccatgttttgctcttctggtggcaagctaatagcaatcttttaaaaacctgaattctgcctttaatacatgtactgtgaacgtacccccgtgaatttcgagttcttataaatagttttcagcactttcatgtaaccgaagcatgagggaagtgacctcaccgattaagaggagtgcctgagaccaaacttgaaacctatgaggacctactgggcagaatcatgataattgagctgattcccgaaaagcccagatggtggaaattttagccagaagtaattttaaaagttctggtattatcactgtaatccatgcagttcagttctcctttgggttgatgccttagcgatgcacacaggcagtgggctagagagtttgaagatgtagttgtgggctgagtatggcagtaaatccacaccctttgggaggaccctgcagccctgatggtggtccaggcagtttgcagaaagggctgaagtcatgaaaagacaatcagaggcaaaattcaacatggtcttgtttcaggaaagatagaaaaaagaagtcttaatatgtcatgctgaatttttgatggttgatgttaacatattgcttcaggaacctgaaaaataagctgtattaccaacctgttttctcagcgcagccagttctgctataatgcaacatacgcattcctaaaaatcaccatgccatgcaaaatcacacaacagaaaccacagggctttatggggaacatgaattaggggcacaatacacaaaacttcatcactgacacatatgacaaaaagaggaacctagtaaaaacaggagcacagctgtacacattaagtggctaagaaatatgtaaataccacaataaatatgtcacttcctgcaaagaacttgaagtttgcttgtggaagtgggtgtcgcaagggctgcaacttacgcgttgctgtgaagggcataaggaaggttatctgaagttgtaggggaagttgagacagcaggcgtagatgggtgtggcaccctggcatatgtgtgaaccggtagatgtttgactcgtgtattttgtgttttcctacatgactgggtgcaattttctgcatttacctggtatttctcctggaggaaatgcgcataaatagacataaaatttgagttatgctcaaattcctccctaacatgagtggcattggaacaaatttgcattttctttttttctttttccttttctttttctttctttcttttttttcttttttgagacagagtctcgctctgttgcccaggctggagtgcagtggcacaatctcggctcagtgcaacctccgtttcccaggttcaagcgattctcatgcctcagccccccaagtagctggggttgcggatgtgtaccaccatgcctggctaattttttttttggttttatttttaagtagagacggggtttcaccatgttggcctagcctcatgtgatccatccgcctcggcctcctaaagtgttgggattacaggcgtgagccgccacgcctggccttcttgtttttttattgttttatatagagacgaggtctcactctattgcccgggctggtctcaaattcctgggctcaagtgatcctcccgcctcagcctcctgtggagctgggactgcaggcacgtgccaccatgcccaactaatttttgtatttttttgtaggtttttgccatgttgcccaggctggtcttgaaatcctgggctcaagcaatcctcccgccttggcctcccaaagtgctaggattacaggagtgagccacagtgcttgaggcaaatttgcattttccaaccaagtgtcgtagcagagctgactgtattttatttgatgtctaaaacatctcagtttgtgatcccactgcccaacagtaggcatttttgactcaagcattttgcaaataaggagatggccgatggggaattggtggaaaatagaagcagtaagaggcacactgggtagtcccatctctcccttccaagaactgtagatgtgtggctcagctggtgtccttatagacagggagttcgaatatcagttctatctttgaagggctggctggactttgtcatcatctaaattgggcattttattggtgatagctgaactcagaaggagtaaaatactgagttgaggatttgtttcttttcttttctttttttgacaaggtctcactctgttgcccaggctggagtgcagtggcatgatcacagctcactgcagctttgaactcccagtttcaggcagtcctcctgcctcagcctcctgagtagctgagactataggtgtgcatcatcatacctggctaatttttgtactttttgtaaaggtgggctttcaccatgttgcccagactggtctctaactcctgggcttaagtgattcgcctgccttggcctcccaaagtgctgggattacaggtgtgagccactgtacctagctgagcatttgtttcttatgtgacaaaagtgcaagggatacatagacatggatgaaattaaaaaatgtgatgttaagtgaaaaagcaagttttacaaggagaaagtatgattgatagaacgtctataaacagctaaaatgaaaaaacgtatgtgctaaaactatagagaaaggggaagaaatggtaggaagtggtgaggggaaggaggaaggttcgactggggaggcaaacacgaggtagccactcttctgtttcttaaacttggtagtgggcacatgggtactcgcttttattagtattcttttaactctatataagtgcgtgatggattcatttctctatttcctaaatagttcataacaatcttttaaagaactttcaggaaccaaatggaggtttgacccagcagtagcaaagtcttcatgttactatagtagagctggaaattcttaacataaggatacagtatttttcccagttcttggaggagagggtcagagtaaaaagtaaatataaataaataaatcatgggtaaaaagaatctcctcccagtcagcacccaactaaatatggaaactgacttcagttgagacatgaagctgttcttcattcattctagcaaagatattgactgaactatttggaaaacatgtttatcattgtctgaggtgatctgccataagctgctatatggcacactgtgtaagaatgaactttgactgtgatgcacttatgtatatttaaaaaattgctcatcctccctagcatttgtttctaaaacattttgattacttagagtgaaaaattcctttggaaacattttttaaaatgcaaatttaggtcaggtacgggggctcatgcctgtaatcccagctacttaggaggctgaggtgggaggattgcttgaggccaggagttcgaggctgcagtaagctatgattgcaccactgcactccagcccggacaacagagcaagaccttgtttctaaaacagaaaaaagaagcaaatttaaagaaggttttttttattttatgtaataaatgctctctataaaagttctataaagcacatttaaaggtgaatgcttgcctgtaatcccagcactttcagaggccaaggtgggaagattgcttgagcccaggagttcaagaccagcctgggcaatgtagtgagacctcatctctacaaaaaaatgaaaataagcggcagagtgtggtggctcacacctgtaatcccagcactttgggaggctgagctgggtggatcacttgaggccagaaatttgagaccagcctggccaacatggcaaaaccccgtctctactaaaaatacaaaaattagccggcgtggtggcacgtgccagtaatcccagctacttgggaggttgaggcacgagaatcgcttgaacctgggagatagaggttgcagtgagctgagatcacaccactgcactccagtctgggtgacagagcaagattctgtctcataaaaaaaaaataaaaatagccaggtttggtggtgcactcctgtagtcccagctactctggggactgaggtgagaggatcacttgagcccaggaaattgagactgcagtgagctgtgattgtgccactgtactccagcctgggtgacagagccagaccctgcctcaaaaaaaaaaaaaaaaaaaaaaaaaaaaaaaagagtgaatactcagcttttgttgcacgtgggacttgagagagaactgggtaagggtgtcctctttctacttgcttccttttgtcagtagaaccactgtcgtgtcaactatatgagaaatcataccctctcagaacttactctgtgttgatgtttcagtttattaaaaaacataaaacataaacactcttacaaatatttatttatcggaaagagttctggttttcaggttaacaccagcaagtcacaaatccgctgcagtacatctcgttaaagccctgctcgcttcagtctctatgaattcaaattaaagcaagtgattggattttgccatctactgggaatgaatttgtcttatttagtccctaatttgatcatgagaattttataaaatcatgttagagaattacaaaatacctattacattgttcaattcaccacatgtcatggctggcaaaggctcaggtaatttagatgcttgtaattttctaaatggtattacgcttttaaactatacccttgggtccaaatccacattaactaactgacaaaaaattatagataattttatttgaggcaacacaaaagggcagaattgtggcaggcgtaataaaacatcccttaaataaagggatctgagatcccagagcacgggctcaattaagctaactaccactagttaaggacgggtctaaccaccactagtttgtctgccacgagttcaaggctagttcaggaaacaccatctgactgtatagctaggagaccttgcacatgttctgtaggaaggagctcactgagtccttcaggaacatacacactcttggatgagctcacttcatgaccctccccaaatcgcccaaggtgacatgatgctcagtagaaggacctggtgaaagaacaaagagtgtttcacggctctcccttaaatactgtattgagaaataaggaatctctgtgctgctcttttcaggaatcaagcagtgctctccacctgggctgcattttcgagtcacctacagaggctgtaaaaatcctcataccctggatgcacctcagaccaattatatcaaatctctggggtgagagccagccagcagtgttttctaattccccaggtgactctgatgagtgccacggttgagaacgactgtagtagctatttgagaaactgattacttggcagagcaatgcccacaaggaggtgttttgaagttacataaataacactgacaagagataaccttgtcccattatgtattacataatgggaaaaccagaaattgaccacagatttcattgactgattcacttggtgtctaattaatctgtgattacaggcttgtaagttgctaacccggcagtaaacattcagtccatttcagccaattgggggacgggttggaggtagaaaagttgtttgatcattgatgatgcttctatatctaagagaataccattttggcaggggagaggcccttggtgtatgaagttaatcactgtgataggcacccagttgaattctaaaagcattaggcaaagactcaagtgaacgtttaggaagaaagccattatttggtatttataaaatgcagcaggtctggaaatggagcaagataacactccctatagtcaaagtcctttacaataaaagagggtaggatttgatagaagagaaggggtcatgatggattcaaacatctttacatcccccaaacatatatcattggaatgttgagcgtcttcttcattttctactgttgtattaagaatattttcaaacatacagaaaagttgaaagaattggacagtaaaaattcattaattcattgcctccagcaggggttggcaaacttttcctataaaagaaagagagtcaatatattaggccttggaggccaatgggcaagatggagcaactattctcaccagaaagctagtagtcttttttttttttttttttttttttttttttttttttacatactacttttaaaaatgttaaaactacacttggctcgtgggtcatacaaaaataggtagtgggccagatttggaccacagtctgtagtttgtcaacccctgacctaaagttcaactgtcattttgctcttgtaggggcaaacacctttttaggggtttgcggctgggcctgcgaattaaattgacatataagacagatcaacaggagaaaagcatacatgtttatttaatgaattttacatgacatgggagccttcataaggagtgaagacccaaagatgaagttagggttgaatacttatgtgctgaattggacgagtagtaatctatgaaagtgtgacgaggcagaggagcctgggctggggggttagctgggtgaagtggccaggaggatgagggttagtctaacaaggttggttcatgcagatttccctcagcctcaacttcctgtctttgatgataagaatgatgcttccttctagtatcggaagggcatctttcacatgggaatttcatctccagcttttaagaaacaaaatgggccagttgcggtggctcatgcctgtaatcccagcactttgggaggccaaggcgggcggatcacaagatcaggagatggagtccatcctggctaacagggtgaaaccccatctctactaaaagtacaaaaaattagccgggcatgatggcgggtgactgtagtcccagctactcaggaggctgaggcaggagaatggcgtgaacccaggaggcagagcttgcagtgagccgagaccgcaccactgcactccagcctgggcaacagtgcaagactccatctcaaaaaaaaaaaaaaaaaagaaaaagaaacagaatggtcaggtgatgttcttgttcttgtacctgctgtttttcaagagcctttaacccaaaatagtcagtttgccagagtggcatattttggggtggcatattccttttttttttttttttttgaaacaggatcttgctctgtcacccaggctacagtgtagtggcacgatcacggctcactgcagccttgaccttccgggctcaagtgattctcctacctcagcctcccaagtagctaggaccacaggtgcatgtcatcatgccaagctaattttaatttctttttttttttctttgcagagatggggtctctctatgttgcccaggctggttttgaactcctgggctcaagcgatcctcccacctcggcctcccaaagtgctgggattacaggtgtgagccactgtgcccagcctggggtagcatattcttaactacttcactctccttgccttgtcacatagtcagccagctctccatctcttaatctaggatatatttcagagtcaaaagttaacagttaacatcaataggtacatgtctcttctcaacataacaaaaggtaatgtgaacaggataaaatgccataaatcaagtgagaccttgttaatgatttattcagtcctctttaggatcttttggtactctaggactccttacgatttaccatgcattgagtttttaatatttcagttaatataaaattatagttaaatcaaaaatgaaaatggtttctgttccatgctattgagtgaatctaaactttgaacgtgtctctcagaggaattatagctcttttcctagccatggattgaaggagttcattccctcttgttctccatcctctgtttcagataaagaccattttgagcggctttatcatcaggggctacttggggaagtggaccctgctaatcaagacagtcacgctggtgctggtagtgtcctccggtctgagccttgggaaggaagggccgctagtgcacgtggcttgttgctgtggcaacttcttcagcagccttttctccaagtacagcaagaatgagggcaagaggcgggaggtgagccagctcagcttccatctgcagcgaaactttcttctcaaagccccctcctgctgtctgacttgcaggtttgcacgtttgttttcatggaaggccttgaagcttatgtagaactatttgttttgtaggtgctttcagctgcagcggctgctggagtctctgttgcctttggtgcaccaattggaggcgtgcttttcagtctagaagaggtgagaatgggcagctgagggaattcgtgattttgagcagcaaggcccgttgagggttagaatcaaagaagtattggataagattccggcagttaattaaggagccacaatttccactgttttttttttgttttgtttttgtttttgtttttgttttttttgagactgagtctcactctgtcacccaggctgcagtgcaatggcgcaatcttggctcactacaacctccgcttcccgggttgaagcaattctcctgtcccagcctcctgagtagctgggactataggtgcacgccaccacgcctggctcatttttgtgtttttagtagagatgggggtttcaccatattggtcaggctggtcttgaactcctgacctcaggtgatccacctgcctcggcctcccaaagtactgggattacaggcgtgagccacaatacccggccaccagcgataaattcctgttttcaagtattgtttcaaaaattgccaaggtgattttttaaaaagatttacagtattctccctctcataaccaacttaattaagcatttttgattttggtaacccaaacgggttattccaggggttggcaaacgtttctgtaaaaggccaggtagtaaatgtttttggttttgtgggccatgcaatttctgttgtagctgctcagctctgctgtcatagcatgaaagcagctgtgaacaatacgtacacaaatgggcatgtctgcatttccatagatgtttccttatgggcactgaaatttgaattttatggttttcacatgtcacaaaatattgttcttcttttgaatatttcaaatcaaaagattttttcacctttttcaatcaattaaaaatgtaaaaaccattcttaactcatgtgccatacaaatgcattcactgggctgcacgtgacttgcagcccagagttttccaaaccctgatctactctgttttctgtagaatccaatccagaggtttatttgcttctaggggagtctctgtgccatgaacagaattatgattaaatacttttctcttaaaaatatagcccaaacccaccttgattagtgtccattccacttctagacatagttagattcctccaggtatctttgctgatgcgttttggtcacattaagtccaggctcatggaatgagtgtgtccactcttggacttagagtgtgactttcctgccaaccagagggcttggctctgagcagctctttctccggccagtctttaattttccactttttcatctcaggtcagttactactttcccctgaagaccttgtggaggtcatttttcgcagccctggtggcggcctttacgctgagatccatcaatccctttgggaatagccgtctcgttctcttttatgtggaataccacacgccctggtacatggctgaactcttccccttcatcctgcttggggtcttcgggggcttgtggggaaccctcttcatccgctgcaacatcgcctggtgcaggaggcgcaagaccaccaggctggggaagtacccggtgctggaggtcattgtggtgactgccatcactgccatcattgcctaccccaatccctacacacgccagagcaccagcgagctcatttctgagctgttcaatgactgtggagcccttgagtcttcccagctctgtgactacatcaatgaccccaacatgactcggcctgtggatgacattccagaccggccggctggtgtcggtgtttacacggccatgtggcagctggccctggcactgatcttcaaaatcgtcgttaccatatttacctttggcatgaaggtaagtgaaagggaaggaagatggggtggggacccatgtccttctggggacagcaccctactctctaaaataaaattgcggtgggaaaaaaaggggaactggcctttcttgaatgttctcatgtgccaggcacttgacattcctttaatcaataggaaataacttctaataaacaataagcttatgaaatagagattttaatcccattttacaactgaggaaactaaggctctgagatcttaagtggcttgatcagacccacagcttatgggagacagagctaggcatcaaacccacttcacacattcccagaacaggtggtggtgaccacaggtttcctgccgctggccaggtgatgccaggtggtggaaaaagcccaggtttggctcagtttggctcattaaacatgcattgagtatcagctgtatcttaggcatcgtgctaagtctgagggatacagaacccaaacagaaagctgcccttgcagagcacacagctctgggagaaagagatgcagacctggagttctgacattgtgatgagcaccacgctggtatgacgggagcacagagtgagtgtgtcccccgtctgggtagggctgggcatgacaggggctctttgcacacatcctctttgaagaacagagctgtggatgacagcacatgctttcttttcctcctccctccctccctccctccctcccttccttcccttccttcccttctcttccctccccttcccttcccttttcccttttccctttcctcttccccctttcccctttcccccttcccttcctttcgtcttgttcccaggctggaatacagtggcatgatcacagctcactgcagcctcaacctcctgggctcaaatgatcctcccatctcagcctcccaagtagctgggatcataggcgtgaaccaccacacttggtgatttaaaaaaattttttgtacagatgaggctcttgctgtgttgccctggctggtcccaaactcccaggctccagtgatcctcctgcctcagcctcccaaagtgctgggatcataggcatgagccaccacaccacacccaacagcacatgccttcattactcttgttcctaaagccagagaagagacagctggtttcctctttcattgtgttaaaatcatttgttaaaatcattatgttaaaatactttaaaagcccctcctaaagaactttcttttatggaacctgggattttgttattatagctttttttttttttttgaaatgaggtaaaacccataaaacataaatgatcattttaaagtatacagttcagtggcattacatacattcacaatattgtgcaattaacacctgtatttagctttagaacattttcatcccccaaacggaaatcccatctccattaacagtcattccccatttttccctcctgcagccccggcaaccactaatctgtctctagattcgcctattttggacacttcatataaatgatatcatataatatgtggcctttggtgactggcttttttcgtttagtgcaatgttttcaaggttcattcacattgtagcatgtgtcactacttcatttttatggctgaatagtattccattctatggagatcccacattttgtttatccactcatcctttgatggacatttgtgttgtttccaccttttggctattatgaataatgctatcattacttacttaaagaaacttttattagagtatatcgttcatatagagaagtgtacagcttgatggagtttcataaaacacacacacacacctgtgtaaccagcacccaggaccagaagcagaacattatccacctcccagagcccccttttgtgttccattactattgctttctgtgtggcatttctatgaattgtcttttaattttatttatttttattaaaaatataaaatagagaccaagctccctatgtttcccaggctggtcttaaacccctgagctccagtgatcctcctgctttggcctcccaaagtgctaggattacacacatgcgccattgtgccctgcctgaattgtcttttttttttttttttttttttggagacagggtctcactctgttgtccaggctggagtgcagtggcacaatcatgggtcactgcagcctcgaccttctgggctcaagtgatcctcctgcctcagcccactgggactacagacacgtgccaccatgcccagctgatttttgtattttttgtagagatggggtcttgccatgttgaccaggctggtctggaactcctgggctcaagtgatccgcctgccttggcctcccaaagcgttagaattacaggcgtgagccatcacacccagcctgaattgtcttttttttttttttttttaaatttaatggtcgggcatggtggctcatgcctgtaatccaagcactttgggaggccaaggtgggtggatcacttgaggtcaggagttcaagaccagcctggctaatatagtgaaaccccatttcttctaaaaatacaaaaattagctgggcgtggtgacacacgcctgtggtcccagctactcgggaggctgaggcataagaatcacttgaacgcaggaggcagaggctgcagtgagctgagatcacgccactgcacacgggcctgggcgacagagcgagattccgtctcaaaaaaaaaaaaaaaaaaaaaaagaaaaaaattctaagaagttgtttacttgagtgtgtcatagtggtcaaatacaaacctgaatttgggccttaagaacaaggatgagtaggccttattaaacagctggctgtctctgatctgtcatctcctagcaaagggatttgttttcatgtctcaggaagatgctggtaacattttatgatgcttgctgagaaaagtctcctttgatgttacagggatataaatgatgtagaataaggggaagctcagaaaggaatgatttcctaaggagtattctgactctagaaatcacacccaaggatccaaacttcacttgaattaggttaaagttctgcttccatcctcagatgggtaaccacctggggctggctggcatcattgcagctgctgcccatggtcagcggtcacgtgtcatttcagcgaacacagggagtcaggcttgttctatagtacatgtgtggtcattagataaactaaaatgtatcttcatccagcagggtagagaacacgctggtaccaagatctcttagtttacattctatttctttgctgcccctatcctggcttgaaaatattcagaatacttattagaaaatgtacttcattaggaagagggaattgcctccctcgtctctctctgacaggtattcagctaccacctactagagagggcagggagccattgaagtgctttctggaagatccagggtggctgcaatgatggacttagcttctttattttacctgggagcagtcgcaggcccttcttttccattttcatgctgtggcttgacatttaattttaaaagccattctgaatgacatggcaaggggcgagagaaagtggtgtctcaactgacagatgctcactttgaatgttatttgcagtggggcttatcattctttaatccacagcaggcaaacccagccagcttttgaaggagagggaatcaaagtataaaattgcgtcctctctaagttgcagtagatatgactgactaggcaggtcaaattatttgtcccacctttccccagctgacctattttgcagagttgcacctcctctgaagactgaagctaaatgcaagcccgtcgagggggaatgtgtttcttgggggtcgtgaagcggggacttggtctttttccctcatgttgcttttctctgtgtctcctcaagatcccgtcgggcctcttcatccccagcatggctgtgggcgcgatagcgggcaggatggtgggaattggcgtggagcagctggcctaccatcaccatgactggatcatcttcaggaactggtgcagacccggtgcagactgtgtcacgccagggctgtacgcaatggtgggagctgcggcctgcctcggtacgaccatgggtggggcagggagggggaccggggaactaatctggcttagaggactgccaagaaggaagacatggacttgaacattttctttactcaggataggctgggttgtgtggctataacaagtaaacccctaaatcacaatggcttaacgcaccaaggctatgtctcgctcactatgcagacacacacacacacacacaaacagatgccctcaacttatgatggggttaacatcctgataaatgcatcataaactgaaaatattataagttgaaaatgcattgaatacacctaacctaccaaacgttgtagcttagcttagcctaccttaaacatgttcagaacacttacatttgcctacatctgggcacaatcatctaacacaaagcctattttataatgaagttgaatatctcttgtaatttattgaatattgtactggaagtgagaaacagatggttgcctgtgtacttgaggcatggtttctactgaatgcctgttgcttttgtaccacggaaagtggcaaaattgtaagttaaaccatcgtaagtcagggactgtctgtaaataaaaatcttggtttagcagaaggcgcttctccacctaatcattcaggggcacaaaggtgggtctgtcccctgtctatagtccttaagaatttctgtgatattctgtttatggggttcttgaagagcaccatgcttgcttagtcagaagcttgcagagcccatgtaggatccactcaccaaaaagcttgtgtgggccacggtgaatagacaacccgggatccgtcattggagcagaggccccagtgagatgcaacttcaggctccccaacgcaaagccacatttgacagggcctggcctgggttccagaggcccagtgtaggaagcatgtaggagagtctgcttggaacaggtgtgaggggaatttacagcctgtctgtcattttccccaaatcatgcttccgtgagctgcccggcttgcactttggaatcttactcctcccctctgttgcaggtggagttaccaggatgacggtgtcattggtggtcatcatgtttgaattaaccgggggtctggagtacatcgtgcccctgatggcggcggctgtgaccagcaagtgggtagctgatgcatttgggaaagaaggcatctacgaggcccacatccacttaaatgggtaccctttccttgacgtgaaggacgagtttactcaccgcacactggccaccgacgtcatgcggccccggcggggagagccgccactgtcggtgctcacccaggacagcatgactgtcgaggacgtggagacgctcatcaaggagaccgactacaacggcttccccgtggtggtctccagagactccgagcgcctcattggatttgcccagaggagggaactgattctcgcaataagtgagtaaagagagggaagctcacattttaccaagagccgaatggcatcctttgtacccctaacattatccaagatttttgaggtgatgtgcattaagccaggggctctcaagctttcacatgtctctgggtcacccaggggtctggctcaaaagcagattctgattgagcaggtcttgggtgggatccgatactacatccctcacaagttccccattaacgccgatattgctggtccccacgtcacactgtaaggaaaaaggctttaaacccaagtcttgggtagacattcttggttgcaaagtgactgcatgtttgcaagcagccccctggccctgctccgctgctgcctttcagcaattgttggctaaagctgagaaggaagagaggcgacagcctggagtggcccgggctgagctgtctcagagactttcaggtgtaccaaccatccggctgagatcacgagttctctgccccagacaccccttgccaccacacaagtcttttgcttcactttgtgatatgatgtcagattccacagttagaggcccttgtgggtaaatgtgcagacatcgctgaaaccaattgcgtgagatgattttcctcttgtgtttgaatgacaatcagctgcactgaggggcaggctgttgagttgggggaggggagtatgggatgatgcccaggtcagggtgtcccaacgacaggtggatcagagaagcaagcccatgggccccatcagccgagggatggctccaacagaagggtaaacaggaggtaggagaattcctaagacagaggggcctagggctgcgggctgagggccagaggtctggttgtgagttgctgggaccccaggcaaggagaagctgtgagccttggaggggtagagtcctgctgggcctcaaggtggcaggggcaaggaccagcatagcacatccacgggcacgctcaccatccttgctctgtgatctgtacaacattccagcatctcatgatagaccagggcccatggcgtggctcccatgtgcacacgacagttttactatatatcttctagagtattcttgaagcttgtcaatgggactttccctggtctgatgttggaatggcccactgttaatacatctccaccaggcaactgcttacttctctccctgtcctttgtttcctgtttccaaggcacctcccttaaacctcttcccagtgttacatagctttaaaatatctttaaggcatcttcatcaaaggctttataacaataagttgagataagctatcctctcccattttagcttgacactcaaacatttttacctcccccaaagtaaaaattgattttgtattttagacaccgtagcaagtttgtgcttaagtgttcggcgatgcttctccttattataggtcctgttgcttaacgggtaggtaggtgcctttgtgtaaatattgccttataaataatgaggtttttttaaggttaagtaggattgggtttgtttaaaaatactgtaatcagcagcctttaaaaattttttcattccctaggatcttttaagcaaaggttgaaatttaaaaactaaggtaataaatgtcacagaatctattatctattgtatagctccaggcacacctgctaagaggcagcttactaattttgctgaaacccattactgtaatcaagtgggaagcagtaattgtcatcaaccagttagagaagaaatttaagcttaccaaccaagtactcttctcgaagctatgtttggaatgtctgaagaggcaccacacggtgtaaatactacctatatgctttcaatcagaccgataataatatagaaggtgctatttacatggtttgtgcagagggaaggagtgttttgctctgaggaatcagaaaagctgtttttctggcctgtggaaatagaagagcccctgtactctggtggagaaatacaggtgcatgacctgtatttgaggaatcttgtgccattttatgagtatagaaatatgacagcatttagctagacactatcccatgccaatttcacttcctagaggaattgggagcaaagattatagacagatccaagatagtatggatcagaaaagaaaggtaagtgaggtaaataaggatttttcttacatatcatgtttaaaaattgtagcaactgctcacatgaagctgaaaatgttttgttatgttttggaatgccaaagcatggcgttatctttgttagagagcacgtcgttagcaccacctaggcaacgtgactctcttcaccatcacatactagcacacggggctgtatgcgactcttgctcaagttcctggcaaatgggcctttacctctcattgctctgcaaatatgaggactcgcctgtacttagcagggctcaggtgcttcttgtcttgagttctgcagttaagtagaggttcaaagaggactcagcggggagttgcagagatgattaaagggtggaaagttagagtttcagggaagagttaaggaaactctcaggtttttttggtctggtggatgatttattaggctggtacaaaagtagttgcggtttttgccgttactttcaatggcaagaaccgcaattacttttgcaccaacctaatgattctccagcatgtggaagacgcttagttgcagaaaggggtctacatccagcactgaacaagaagctaagtgtcaggtctgtcagacaagggagaaagaggtttctgcccgggagggctgttagttactggactaggtcatggagaatagtggtgtcatctacacctttctgttggggatgtgtgtgtgtgtgtgtgtatatatatatatatatatatacacacacacacatagagggacttctccatgctttagtagacagacaataacttgtaaaacaatctgctttttcttctgtataatctttacttttttatcatatcatctttgtactacttctgtggttgctttcaattttccattttaacctatctcattaattatatctgtcttatggacgcatttaaaaaaattttttgagacagggtctcgctgtttcacccaggctggagtgcagtggcgcgatcatagctcactgcagcctctacccactgggctcaagcagtcttcctgcttcagcctccggagaagctaggactacaggcttgcaccaccatgcctggctaagcatttttaattaacaggatgatagactattacttccctaaaaacacagttcaagtgggagtactcctcctcagcactgctgacatttggggcttgatgattctctgtgctggggctgtcttgtgcactcttgggtgctgagcagcatcccagggctccacccactggatgtcagcagcacttgccctctcctattgtgataaccaaaaatgtctttagacattgccaaatgtcccctgagggtggaggcagaattgctcccagttgagaaccattgctctaaagccactcaatagcctaatgaatatgtgattatttccaattttgaaaaatttcttggcctatcacatagtttgtgaaatttctcttacccatactttattatttaccatctctacatctggcatatgaacatattgcttctaggaaatggaatgttgagtaaccttagcaggtgctcataaaatatacattccttcatttttttttttttttcactaagtcttgctctgtttcccaggctggagtgcagtggcgacatctcggctcaccccagcctccacctcccagattcaagcaattctcctgcctcagcctcccgagtagatgggactacaggcgcatgccaccaggcgtggctaatttttgtatttttagtagggacggagcttcaccatgttggtcaggctggtctcgaactcctgatcttaagtgatccgcccacctcagcctcccaaagtgctgggattacaggcatgagccactgtgcctggcctaaaatgtacattcttttttaagagctgtggccactgagactcattctagtagaatatatgacaaacctcctacattaaagacagttttaaaaacagtttaactatttttaaaacatttaaaaatgaagtttattacattttttcaaaatgaaagtaatacacactccaaatattggggaaatcagaagaaaaaggaaacatttaaaaagccacctacattcttatcaccaaagaagacatgattgatatttagtgcatttcctttttgtcttttaggtcttttaaaaagatgcattttcggttgtattgttttggtttctttttcaacacagactcccaagtgttcctagggtctgtgggtctcttttcttgtagcactggctcatcccctgggtgaggagttagttggtttatcctttcacacaggaaatatttcttaagtgtccaccatgtgctgataccatcctagaagctcagagtccagggatgacagcacactgcctctgccctctgtgaacttacatgcaggcattttggtgtctgatgatttctggtccaaactgagagcagatgtttcaccctggtagagaattgcaaagagctttcttgctggttgttcttccattcacaggcttttgcctgttcttagcacctctacccacaaagtttgaagcctcctgtaagtctgtaatagagttccaaagtggcctagcagaacctttctgaggagagtagcagttgccactgtgggaacagcaaggtgcatagctcaggcttctggctctgaccctagctgatgcctatatttttgcttggcagtaaataccttgtgtgctttccttcctgatgcctcctatgtgagataggttcagttttatgtggcaggcagaaccagatacactgacatttagtagacctactcatccgttcattcatatgtgcatttggcaaatatctgttttgtgtctactgtgtgttaggcattgtccaggcactgggagtgcactggtgagcaagagttcattgagctagtggctgttagaatcagggcttctaacccaatcagtaggttcaaaggagatataagcatgttatttattttattgtagcaagtggatcgaccatttattaaattgtatttggttttagaaggggttcagcaaatccatgtcatcaactcttgattggggtttgcaacttgatccaatcctgacattcactcagtggttgaaattgatggaaatcctgttagtgggactttaagagaatcggctggtctatgggaatgagcaaataagtgtgtgttgccagttgcctccctgccttagtgggtaaggacagaatcatcttggtttaggagagaagtacgtagtatatatcgaacagtctacatttgaaaacgcgttgtgcctcagagtcgtctggtatttgtggcagaatcataccccatttgatgtaacttgatttaacctgacccatgtaatgtgaaggcatttgcccagcaggccctctgttcctcttttaaacagagaccctttttcagactcagcctgaccccagatgctgccagttttccattagagtactctattgcactaaatggccttagaggaggcagttagaattttatttttgaaagaacaatataggtgaatagtagtctttgagaaggtaagaagtgtattatgggaaccaggatccattttaaagcaagccttgctgtacattttccctaaccttttcccatgaaccaaaagaaagattaaaattccaacagaaggaaaatcgccttggagaaatatcttgagaccgatggatttatttcatgtgtggcttaaaatagcctgggtttctagcaccgcgttaagctgtatttctaatgagttcctgttaccctacttttcttcagctttctttcacatggccttttctatagacagaaataggctaattgctaccataacagttttactatctttctttgagggatccacaaaatggcccatttttaagacaggagatccgaagggttgaggggggatgcagcttttctggggttgtttctttggacccaagggtcgcgtttgggattgagctgcatttctgggctgtgagcctgggctggccgtattggtttcttgttcctcccaggattcataatgccatttgggccagttataagttagttcgtaaaaagaaaaacaatgtattaaggtcatcgggcagctaagtaagtttcttgtcacctcaaactccagcccatgatgaggtgaaggagcgtaaggaaagccagagtggagggccctgggctgtttggggtgcccggagtctgcggtgaagcagtgaatgtccccaaaggggccatctgggtcaggcccatcttgccagactttggcaacaaatgatccggtcacagcaggggaccctcacacagcattagctgcagagagatgccaattccacagatgtttggctaaagccccttattaagaatgtgtggttcatcctccaaaccccttttctgtgggattctagatggtgtgtgtgagtgtggggtggggaattgctcagcaaggggtttttgtgtggctcattgttcctgctcaccccattctagagaacgccagacagaggcaggagggcattgtgagcaattccatcatgtacttcacggaggaaccccccgagctgccggccaacagcccacatcccctgaagctgcggcgcatcctgaacctcagcccgtttacagtgacagaccacactccgatggaaacggtggtggatatcttccggaaactggggcttcggcagtgcctggtgacgcggagcgggtgagtagccggacatgtggccagaatgacctagggagaaaaagatgagtgagacatggtctcagccctgaagaatgtggagggccatggggtggaatagtccttgacagagaatggcagtaagctgtggtgaatgtgttgaggaggaaatgtacagggagcttgggactgagggctgggcagccgtgcagccagagaagggggtggtccaggctggactgctgcctgggctgagggaggttgagtaaaaaggggtggagccacaggagaagggcttggtgttgcttttctaccaccccatgtgacacttggcttagggaggaggttctgctataacgtgatgtatgcggtcctcaaaatcacagcactacgcaaaaagtgctccatgcaaaccacaggacttgtgggaaaaatggggttaggtacacaacagtcaaaaacttcatcagtgatatatgacataaaagaggtggaagcctaataagaatggtagtaccgagccaggtgcagtgagtggctcgtgcctgtaatctcagcacttcgggaggctgaggtggaggatcacttgagcccaggagttcgagaccagcctgggtcgcaagaccctatctctacagataaatttttataaaatcagccaagtgtgcccatagtcccagctacttgggaggctgagacaggagcatcacttgagcccaggcttccaaggctgcagtggcccaggattgcaccactgcactccagccttggcagcagaatgagaccctgtcttgtaaaaagaatagtggtagtaccatgttacacattagttaaatggttaagaaatacagggatacaacagaaatatgtcacttcatcttaaaaaggcctgaagttggctgtggggtgggtttcacaagctgtgccacttccgaattaccgggaaggggtggaaggaggggagcctgaactcaaggggaagtggtcacagcaggtgtggatgggcatggctcttcacgcatgcatgaactgaggtcgcttgtggatgtttgggggccgggcatgtgcattttgtgtatgccgatcccactgggttcagctgggtacagtttcctgcatttgcctagagcttctcatggatgaaatcacacataagcaaaggtaaaattcatattatgctcagattgttcctgatatatcaatttgtttgaaacaactttgttttcgaaacaaacatgattggagaatggagagatttgatggccccatggcattgtccctgctgccacttttgttttgtgttgtcacaaatcaggaaaccaacaatgcaaagatcgagggtccactgtagtagcaccagagaagcagttccttaaaggtcattccttggcctctgagtgtcacaagttccatggtgtcagaagcttgtgtaagggaaggggtcggcttggtcagggtagcctggaacctagggttatctgcccattttattcctttatgggctgggagtaggaggcggggaatgggttctggagacattggtacctaataaagtttaggcctttatagactccagaggctcaactatctaatatagcttatatttccagagccagcacactctagtttaacacagcagttctcaactgggatgattttacctcccagagacattgggcaatgtctggagacaatttggggtgtcatgactggagggagggatgctattggcatctagtgagtagaggtcaggggcgctgctaaacatcctgcagtgaacaggacagctccacaacaaaacatctggcccaaaatgtcactagtcgtgcagttgagtgaccttggactggatgtgcctgtatagccaaatgagcaatcctattcattccactttcttcctgctgtcctggtagcaagcacacagggggacaggctttgcaatttgcagatttacccagagaactcctggccagcagagtgagcatcctccttagctctgactacagacagagcagtgtcttgcatgtgggaggtgcaatcaatagggaaaaataaatgagtccttgtgtttgacaaggctagggatcatttctgctgatgaattttaaaggagctcaagtggtttttcaaacttgagtgtggatcaaaataccctggaggattaaacctccaggttaaatccagatttctgggccctgccacagaggtactgatccctggaagtctagggtgaggcccaagaatattctttcctaacaagctcccaggtgatgctgcaactgccggtctggggaccccaccttgagaaccactgaagtcgatttatgcacttgagtttccagtactcttggtataaacaccactgtgattgcccatgctgtctcaagtgtgtagcagtttctcctttcctttaaaacaataatccaaagtcaattatcgttggaatttcagctcaggcaggaaactctgcccttaatgcccgctcacacctcatagagccccatgaggtcttcctgtgaagatctgggtgccgaaattggctctgaatgtgcttcaagaaagcaaaatcgcactctctctcgctctacatcttttacacaaacacagatgctgctgcgttagtgctggcaagggatgcttgtctgcggggcctttcatctccttgggcttcttgccagggcaggcacgtctctggccagctctcatgtttgatgtgctcgcccaccctgtaccttccctgctcgggatggccacgagcctgagctccaccgctggcctggatcacctgcagcatttctcaggcctggggttcaaggggcatcataaaactggaccaggaatcggaatgccgcaatctaggaagcctccagttgctaagagtgaatttgggtgagattttccctatgaaagttctagaaaggaaaagtgagtaagggagatggtgtcagattttccccaagccctgctaggtggtccacaggggcctggacaggatagctttcgcagaagagcccagctgctcgaatttgaattatgtccttggtcatagatctggccatttataattcgctgaattcgcttcaactgctactcaaaggggctggaagttcaaacacttgatttaaatcaaataggacatttcatgccactaacgaagcctgctggatttgatgttacctccttctgggttgatgttcagctttcttcttttgtgataattaccatcgcgggccagggcacaatttatgcacgaacccaaggcagctcctgaattcatatttccctagtgctgttataatcaacttaacttttagacattacagtcacagagctttaaaaggaggttttcagaactgcaaatgcttgatcttttgatactgtctccagggtgaagacaaggaaacaaaaaccaggatttatagatatgggagggttccgtgtgtgtgtgtgtgtgtgtgtgtgtgtgtgtgtgtgtgtatgtgagtgtgtgtgtgttatagttatcatcactttgcaaacactaacaagtcttatttttttcaaagcaacattggtttaatcaacattatattgagcatctattttagctgggaactgtagggggcacaaaaagtgtttaaaaaaaaaaaagccaaggagcttgttatctactaaagaacatggacataatccagtttaagtggtgctacccaaggcaggcgctccggggggactgttctgttttttcttttttaatttaatttaatttaaagttccgggatacatgtgcaggaagtgcagtcttgctacataggtaaacgtgtgccatggtggtttcctgcacctaccaacccatcacctaggtaggtagccccatatgcattagctatttatcctgatgctctccctccccacatccacgacaggccccagtatgtgctgttcctctccctgtgtccatgtgttctcattgttcagctcccacttgtaagtgagaacatacagtgtttggttttctgttcctgtgttattttgctcaggataatggcttccagctccatccatgtccctgcaaaggacatgatctcattcctttttatggctgcatcgtattccatggtatatatgtgccacattttctttatccagtctatcactgatgagcatttgggttggttccatgtctttgctattgtgaatggtgctgcagcgaacatacgtgtgtatgtatttttataatagagtgatttatattcctttgggtatatactcagtaatgggattgctgggtcaaatggtatttctggttctaggtctttggggaatcgccacactgtcctccataatggttgaactaatttacattcccaccaacagtgtaaaagcattcctgtttctccacactcttgctccacaccagcatctgttgtttcttgactttaataattgccattctgactgatgtgagatggcatctcattgtgggtttgatttgcatttccctaatgatcagtgatgtggagctttttctcatatgtttgttggctatataaatgtcttcttttgagaagtgtctgttcatgtcctttgcccactttttgatggggttgtttttttcttgtaaatttgtttaagttccttgtagattctgcatattagacctctgtcagatggatagattgcaaaatttctcccattctgtaggttgtccgttcactctgatgatagtttcttttgctgtgcagaagctctttagtttaattagatcccatttgtcaacttttgcttttgttgcaattgcttttgaggttttcgttatgaaatctttgcccatgactatgtcctgaatggtattgcctagattttttttctaggctttttatcgttttgggttttacatttaaatctttaatctatcttgagttaatttttgtgtaaggtataaggaaggggttcagtttcaattttctgcatatagctaaccaattctcccagcatcatttattaaatagggagtcctttccccattgattgttagctttgtcaaagatcaggtggttgtagatatgtggtcttatttttgagatctctattctgttccattgatctatgtaccagtactgtactgttttggatactgtggccatgtagtatagtttgaagttgggtggcatgatgcctccagctttgttctttttgcttaggattttctgggctatatggactctccacctcaaaacaacagaatatacattcttcttggcgccacatgacacttactctaaaatcaatcacataattggaagtgaaacactcctcagcaaatgcaaaacaactgaaatcataacaagcggtctctcagaccacagtgcaatcagattagaactcaagattaagaaactcactcaaaaccaccacacaactacatggaaattgaacaacctgctcctgaatgactcctgggtaaataataaaattaaggcagaactcaagaaattctttgaaaccaatgagaacaaagagacaacataccagaatctcttggacacagctacagcagtgttaagagggaaatttatagcactaaatgcccatatcaaaaagctagaaagatctcaagtcaacaccctaacatcataactaaaagaactagagaaccaagagcagacaaaccccaaagctagcagaagacaagaaataagcaagatcagagcagaactgaaggagacagagatacaaaaaacccttcgaaaaatcaacaaacccaacaaatccaggagttgtttttttgaaaaaattaataaaatagactgctagctagagtaataaagaagaaaagagagaagaatcgaatagacacaacaaaaaatgatacaggggatatcatcactgaccccacaggaatacaaacaaccatcagagaatactgtatcacctctatgtaaataaactagaaaatctagaagaaatagataaattcctggatgcatacaccctcccaagactgaaccaggaagaagttgaacccctgaatagaccaagttctgaaattgaggcagtaataaatagcctaccaaccaaaaaaatcccaggaccagacagatttacagctgaattctttgtaccagaggtacaaagaggaactggtaccatttcttcagaaactattccaaacaattgaaaaggagggactcctcccgaactcattttatgaggccagcatcatcctgataccaaaacctggcagagatacaacaaaaaaagaaaacttcaggccaatatccctaatgaacattgatgcaaaaatcctcaataaaaaaaaataatggcaaactgaacccggcagcatatcaaaaggcttattcaccacgatcaagtcagcttcatccctggggtgcaaggctggttcaacatacacaaatcaataaacgtaattcatcacacaagcagaatgaaagacaaaaaccacatggttatctcaatagatgcagaaaaggccttcgataaaaataacatcccttcatgttaaaaactctcaataaactaggtattgatggaacatacctcaaaataataagagccatttatgacaaacccacagccaatatcatactgagtgggcaaaacctggaagcattccccttgaaaaccagcacaaaacaaagatgctctctctcaccattcctatttaacatattgtacaattcacccatttaaaatgcatgattcagtggtttttagtagaaaatgggttgtgcattaatcaccacaattttagatcattttcatcaccccaaaaagaaaccccacaccccttagctgttacctcctataccacagtccttggcaaccactactctatattttctgtctctgtggacttgcctattctggacatttcatgtcaatacagtcatgcactatgtggccttttgtatttggcttctttcactgagcatcatgttttcaaggttcgtccacactgaagatgtgtctgtacttctttccttgttagggctgaatcatcttgcattgtgtggatagaccacattttgctgatcaattcattagttgatggacatttggtttccctttttttcttttttttaaattatttttaatttttgtgggtacataggagtatatatttatgggtatatggtatattttgatacaggcatgtaatgcataataatcatatcagggtaaatggggtctcccagcacctcaagcatttatccttcgggttacaaacattccaattcttttagttatttttaaatgtacagttaaattattgattgtagtcaccctgttgcactatcaaatactagatcgtattcattcttttaaactattttttgtacccattaaccatcctccatcccctcctcccccctcccccattccccttagttttcaaatgaggaggtgagactctaagaagcaaaacactgctcagggttaaagggaattggttgcagagccagtcccatctggattcttccaggtctcctatctcctgaggcacaatcagctgccaggtaccgggaggacctttgatggagaaccctgccagccgaccctgacccttgaggacatcaatcccctccgtacagcaccctctgggaccaacgacagtggggagtagacctgggcgtgatgggaagatatgtggcagcatccttaagtatccagattcctggaatggctgcattttgggatacctgttcagtaaaatacagaggatatggggccaggtaacgggattcctgtgtcccatgctgacggtgtattatagattcacccacagaggtctatttgtgtctgaaagcttctggctgggagtaatagtcaaagtgtttaagagctggtgccagataatgaactgatttgttatgaattgtggggagttcactgcagttctataaggtatgaggttggcagggtacatcccagggtgtctagctcagtggctataaaccaaccggtgtagaactattttagtactttttaatctggatggtggttctcaaccaggggctatcttgtcccccctccacaggagacatttggcattgtctggagacattttggttgccataatgggggatggggatgctgctgcatctagtgggtagaggcccaggatgctgctgtatgttctacagtgcacagaatggcctatctgcaacaaataattagccaacctaaatgtcactagtgccaaggtggagaaaccctgcgtaaagccttcccaggtggagggctggatgggtggaaggagtcctattggcccagcttgcattttgctgctaccgcatgggagggggcctcactggggattcctatctgcctgtaaatagaggcccttcccagtaacaaagccgcctttcctagctgtcactgctttcttgaaattaattagaattatcagagctagaacaaaatttcctgactctgggaggaaaccttgtttaaaaacatttatttaaatttttgtgggtacatagtagatgtgtatatttatggaacacatgagatttttaaaatatatatatatatatattttattatactttaagttctagggtacatgtgcacaacgtgcaggtttgttacatatgtatacatgtgccatgttggtgtgctgcacccattaactcatcatttacattaggtatatctcctaatgctatccctcccccgtccccccaccccactacaggccccggtgtgtgatgttccccttcctgtgtccatgtgttctcattgttcaattcccacctatgagtgagaacatgcggtgtttgtttttttgtccttgtgatagtttgctcagaatgatggtttccagcttcatccatgtccctacaaaggacatgaactcatccttttttatggctgcatagtattccatagtgtatatgtgccacattttcttaatctagtctatcattgttggacatttgggttggttccaagtctttgctattgtgaatagtgctgcaataaacatacatgtgcatgtgtctttatagcagcatgatttatattcctttgggtatggaacacatgagatgttttgatactggcatgcaatgcataataatcacatcatagagaatggggcatccaccccctcaagcatttaccctttgtgttacaaactatccagctgtactcttttcatacacctgtttgctatttgtatgtcttcttttgagaaatgtctatccaaatattttgcccgtttttttgatcagattattagatttttccctatagagttgtttgagctccttatatattctgcttattaatcccttgtcagatgggtagtttgctagtgttttctcccattctgtgggttgtctcttcactttgttgattgggaaacctttatttcttatgtgggcctctggctctgacatgcctcaagtctggaggcctggactgctcttctcagcagcaatacatggctgccaaagcaaaagggcaactctaatgagaccggggcccactaaagcttttgcaaccgtagaagcagggtgatttggcgaagtattgggtaacagtgcccttgagaaaatgtgtatctctggttgattgattgcaatgggccctcattatgacagttgagcccgaagcagctaaaacaaatcaggatggaaagaaatggtttcaggctctgccagctggacccagcaaccttcctgtgtgaggagaccagagcccttgttgggccttgaatctgtcaactgtgttcatactcacagatgggttttcccaggagaactcagcatctcaccgcaaagaagagtgctaacatttgtttcctttaggtagctcttgtttcaggattataacaacatttaggcttacagaacaattgagcaaaatatgcagagttctcatatatccccttcactcccctcagtttcccctattgtcaatatcttgcattactgttgtatttgttgtaattgatgaaccaatatcaatacattattattaactaacatccatagtttactttagagtgtactctgtgtcatatatttctgtggattttgacaaatatataatatcatgtgtccaccattacaggatgatacagagtagtttcactgccctaaaaatcccctgtgctctgcctatttatccctctcttccacccaccaaaccctgacaaccactgatctttttactgtctccatagtttagccttttccagaatgttgcatattatgtagttggaatcattcagtatgtagccttttcagactggcttctttcactcagcaatacacattttgatttttctccacgtcttttcatgacttgatagcacttttgtttttattgctgaagaatatccattgtctggatatgccatggttcagtttatccagtcacctactaaagaaaatgttggttgcttccaggttttggcaattatgaatgaagcagacgtcttctaagacgttttctttacataactaccaaaccatgatgatgtaaaattaacagtaactcaatatatcatccaatatccagttgatattcattcaaatatcaactcagaattccatcaaggtttgtgcattgcattcttttgcctttttagtctcttgtctagaacagtttcctgccttgttgttgtttttttaatgagagatttttaaacataattccaaattttattttagacacaggagatacatgtgcaggtttgttacttgcaaagatttcctttgaagagtccagaccagtagtctcacattctgggtctgattacttcctcatgattcagtttggcataagtcgtttttggcagcattccaacataggtaacgctatggagtctgcttttctgactttgttgatgataagctccattgctcggatgaggtggtgatggccagaaccctccattgtaaagtgacatttttctctttgttcataatctgtaggaaagtactttgagaccatgtgaattttctgttttccagcaaccattcgcccagtgattttggtatccattgacaattattgcctaagctaactattacattgggggttgcaaagtattaattatcaaattctgtcctgcttcctacgtttatcaagtattcctccccatttaagaaaaacaatccctgtagggtcatgatatattcttttaatgtttttgtaattcatattgtcattattctgtttgcttagcatgctctttcactattttcctctctcctaaagatgttgccatgagatggaggggaaggggtcttatttgctgtctctctcagtgtgatacatagggaaaccaacacaagaaacggataccttttccaagactgtttaaggtccagtgttgtcagagccaaaaaagtcagaattctggcctgacagtttgaataatcagtgtctatttcaccaggtgtaactgatttgaatactgcttagaatacttacatcccttcttcatattcactaagagataaatttgactaattttgccttaattaaataaatgacagtatattacagttaggttttctgatttcttttgtatattatcatattacacagagtagaaacccattattttaatagctataaagtattttaatgcaagactaccagagtttgcttctgcataccccttttttggggggtacagtggagatacagtgagtagtgttttgcaaacttatgtgggaatggagcttctttttttccaaagaagttgttcacttctccttctctcagacctttcattttacccaagggacatgatgtgttcctgcaggtggtcatttagtaaaataatgaaacaaggcttgctatgaatggttgtgcaaatgtgcactgtataatccagagggcacaatttctactgcagtgtttgtgagcagtgctccttggcactgtgtgatatacagtcttggtggtcccatacaatggactctgggaagtggcattctttttgtaagttgaaagcaatggaattttggaagagaaggcaatttacgtatatagtcagagataaatgtcaactttatcctcccagtaagaattacaaatagaatcactttttatcttgtacttaaaatttcttatacttaaaataccttacacttggcattcctgtggtgtggtcaagttttgacaatgcctttcataaacccttttaaaattgattatagtcttgaaatttaagaggatatagtagtcatcataggtttactgccgtaataaacaagcttgcaatctctgtggcctaatgcaataaaggtttatttttctcacatgttacatccactgtggattgcaggtgggctctggacctaggtgtttgaatctggtggctcctaagtcaatcctcagagcccttcactggctcctgtgcctctggctgccagatgagaagagagagtggggggaaatgcacaggagacctgggagcagcatctgtcacttccacccacaggcattggccagtgctccctccattggctctgcctaaccacaagggaggctgggaaatgttgtctgtctctgtgtccacatggaaaaggcactggggtttagggagagggatgagtcgtcgtttcaaggctgacctcttttctctattttgtttcttctccaggagacttcttggcatcatcacaaaaaaggatgttctgagacatatggcccagatggcaaaccaggaccccgaatccatcatgtttaattagcaacaaggtggcaattattttcagaaaaacactgactgtgtcatttaaaaagaaataaatgatatgttattatcccaatgaaagatcatgcattggggacagcagaaacaaaa

SEQ ID NO: 2986 - DNA, 80676 bp, human
tttgcctctggcaggaaaatgagcttgtcagtttctgcctccattagaccctcaacccaaaggagcaggagatttcggtagcgttttaactttatctcagaatctgaaagcggaaggtaagctgcttatcactcagaaaaacaaatttgagaggagtgacctagtaaagtacactgcgactttgttgatttttaaaatctggtgttgaaaataattgatcgctgtgagagtcaagggctgtatttatccccaaattagagattaaccttctgaacagaaatttggttaatttggagggaatcacggtataagggccagggttaaatatagaaggacacgaaagctgatggaataaactgcaagtaaacttaactctagcctgcttgtaaaacaatctatttcatgtctccttcagggctgtgagcaaagggaatgttaaaattgtgatttttaactcaagtgaaagtaaatgaatctatttgcaattggaatacaaataaaagcagtctttgcttttgtccttttacatttcaaaaacgcttgtgtattttggcaaaagaaaagtttatatgtgcactgcttaagtttgaaatacgctatttcaaatttacaaaattatcacagttgtaattttctaaagtctttctaggcaaggctgtttcagttgtgaatgagaaatgttgacattgtacatattttctgtgatagtaaaatgactcacttcttcagaatgtgataaagattagaaaatgtgaaataatgagttattgtgaattaagtcatgtctcagagattaaatgccttgccagaagatgtaagaaaacagagacacaaatacaaccatgctcacgtagcagtgctttattttaaatcatcacatatttaagtaagtagtagaaatacgtggtgtcaccattttttcctttggcaaatacaaattaatattggaatgcagctattcagagtaattaaagcattattcatccgtgcaattagtataatgttccataatgaattgctttgaactaaagtgtttggtataatactcgatatacggcttgaaacatagaaactctaggcaaagtatgtccatgctatattttgtgtcattttgatttgcacaaaatgtttatttctccactgcatttgataaatactagttttaaaataaaacatgaaattgtatttcctttcactgtaatccctttattgctaattcttttgaaatcctattactcgcttggagcctgtaataatttggatttctcctcctgtgtgttgtttttcataattcttcgcgaaaggccaggcaagctgcacacatcaagcgaaacgcctgaggggcggccagcgcgagggtttctggccatcgaccctcacctcccgggacttccagggtcttccccccaccccgcgcacacctccctgcctcgccccgagggcgtcacgtggcagcgtggggcccgcctcctggtgatgtcacggcgctcgcagccgtcgcgctgaagaaaggatgctcgaggatgctgtccaggtgggcggccgcgggcgcgatgcggcactgcaggtaaggggcgcgcggcgcctggatgccctccccggcgcccccggcagcgcggacgctgcaggtggagcccggcccgcgggcctgcagcccggctgcgcccccagaaacccaaagtggggcctctggctgctgcggcgcctgctgcccacagctgcctgctgcagctgcatgcacccggccggggatggcccgtggcaggcccacgcgtgacttgggtcttggcgtgcccgccccgagaaagcgggcaggggccagacagaaagacgggggagggaaaaaaccgctccggcgggggaacaaaatctgaagtgaccacactgcatgcattctaagtagacagaggggcttttaagaggtaactatcaagtgttttcctagtgtcattctgcttcttaaataacgacatgtttactaattacaggcctttgtcctcagtaattagcctcatttctttcaaagcaaaagcgggctggggagtggaaacttcttggttagcaatttaagagccagatgtgcaatctaaattgctttgcattattttgcaaggttccagcatttacagggcatacgtcagaaacgtattttttttttccttccaggtgttttaagtagattaaaaaagaacggtatccaatacaataaaaataaattgcagcttccaaagataacatgtgagcgtaagagacagctacatctctaagaaccaaatgatctttagcagagagtgggggtggagataacaccaaaacctaagaattcccagagttcttgttaattctctcgctgataattcgcttgctgaatggagaggcttgatgacagcgccagatggaggggtcaggtgacttcagttctagcatgacagtgggtgggggattttaatggactgtttctagagcgtttacatgcctttctcggggtcaggaagaaactacagccaggacgtgtgggggcacccttagggggagaatgtggcattattttcccctctaaaacctgacccttctggaagctttgttgtcactaaactgtattggaactcacatcatgaataatttgaccaaccagcaacgttggggggcctgtaaagcaatgctatttccatcaataattgaaggaggcatttctttcagaatttgggacacccagatgtgttgctgcagtaatttagtaacttgtttattgcaattttcttcctttggttcagtttggttacacaaattaagatccccgggtccccgccctcccttctcctccagcccaaccctagatagagcaaagcagatgatagaggtggatctaatacagacctagattccacttttggctttgtgactgtgcagccttggatatgtcatttagtgtctttgggcctcgactatctcgtcctcaaagtaacaaagggatttaggtcagggtgtctcaaccttggcactactggcatttggggccagataactccttgtggtgaggctgtcctgtgcattgtaggatgtttagcagaatctccgacctccacctactagatgctagtagcacttccccctcccagcccccagttgtgacaatcaaaaatgttgccagacattgccaaatgtcccctgagggctcccttgccccctgttgagaaccactgattgagatgatctcgaaatattcttcttcgggctccaagaattcattttcttatgattggtttgatgccaagcccttgatcagaaatctgattccctttcttaatatcacatatattggaaaacacaatgtgaaggcgtttttatgctgtgaatttccagaaatagcttctgtgaaaaggggaggagctgtttgtatgccatttgtagctgggaggcgagcttggcagaaaggagagtgttagggaaagaggaaaaaaacagagcactagatgaacgtgtgtggaaacctgccggggcttcgtgctcagcagacctggagcacgtccctggacgtagtctaaccctgggttagacctaacagctgagagtccatttccttgtctgcaaaaatgagaataacagtgtccactcggaggtgttgtgaggatgaaacgacacgacatctggtgctggtgggggacgtggtgaggacgagagggtggtaatgtctatgcagctaggaggaggcaaacacaaatggcccgcaccaccagcgacacggacactcgcttgggcagacatggtcgcatgctttaagcttcagtccaggactaaagatctggctttgacacctaggagggtgaccgtggctgcatcacttcaccctgcagagctgctgtcggatctgtaaagtggggccaaccgtgcttgctgactctgcttccttggctgttggggagggacggatggaagtgagagggtctgcaggctgggaaactcccaagagacaggaagcgggggtggcagcagcatagcaagggggggacatgtttactatgtgtgtgtatgtggtggtggtggggtgcttagaatggccagaaaacatttccttgtgccccaggctttggactttgatgtgtccctcccctgggttccctttccgttgccatcagcttgctctctctctctctctctctctctctctctctctctctgtctgtctcatctttcctggcaccatgaaaatggtctcctggggggagataggaaagccctggtgggggaggttggccttcggtgaggaagacccactgtgcagagggctagggtgagagcagctggctccatccactccccacgccactgtcctcacaggcttcagtccacggacatcccagggcaggcctgtcacgctcctgtgtgcctccagtgggcttggtgctctgtatgagccatctggccttgtctcttcaacaaggtaatatcatgaaagaaatttttaaaaagggaggtggggtattctccatcaaacgagacttaagagacggaatagccaaatatcacttgtggccctcgattggattcggcccaaacaaacgtgtaacaggcattttggggatgcctggagatgctttgatgtgactggctattaggtgacactaggagactgctgctgctttgattagatgtgacagtctgtgatgtgttcggcagcccctcggacagatgcagtgatccccacccctggcagctgcaacttggcatcaccctctcccctggggtttggtctggaccaagtaatgaacttccaatgaatacgtctagcaaggggtgggggagaggcacttccaccatgagggtgtaaaggggcttctgcctggggtgtgttttctctcttgggttgcttacactgaagctgccatgtcgtgatcagccctacaaaagggtccatctgccgtggtgaggacccgaggtccattccaacagcctgagaagaactgagacccgctgacggtgtgagggtgtgagcgggctcggaggcagacccttcaggcccagttgagtcttttttttttttttttttttttgagacagagtctcggtctgtcacccaggctgcagtgcagtggtagcgatctcagctcactgcaacctccgcctcctgggttcaagcgattgtcatgcttcagcctccctagtagctaggaatacagggacacgccaccacggctggctaatttttgtatttttagtagagatgggattttgccatgttggacaggctggtctcgaactcctgacctcaggtgatccgcccaccttggcctcccaaagtgctgggattacaggcatgagccaccacgcctggccgcagttgagtcttgagatgcttgcagccctgtgagacaccttgagctgaggcaccagctaagccactccagggttcctgacacagaaacagtgacatgatagatgtttgtgtcctgctgctatgctttggggtaagttgttaggcagcaatagatagctaatacatgtgtttatgtagaaaagtcttcttgtttagagatgtatactaaagtgtttagagatgaagtgtcatggtagcagtcatttactttttttctttttttgatgttttcttgagatctctttaatgtatgacttaataggagacagatgaattctcatacttggttctacattcaatctgtttcaatatcgcatgtcatgtagcctctggaaaattccattgtatgctcatgagagaatgaacttagaaaaaggcaaataacaatgtcagaatattgtgaaatgtttttgacatcatggactcccttaaagggacttggggagcccaaggagtccccagatgacactttgaagatcaggcttcaagatcaataatttacttttaaatggttcagttaaatgaagagagagaaagagataaagcagatagagccaaatgtgaacaactgttcagtctgattggtgttattcactggattcttctggatgatgttctgtgtaattgaaaatgttcataataaaaaattaagaaaaaaagaaaagaaatgtaaacccttagacacactggggattctgactgaataggtctgggggtgaagcccagggcttaacctgtgctccaggtgcccccatcacatgggccagaggccccagccactttgccccagaggtcctcgccttacctgcctcctctccacctgtcagccttgcagtagcagaccaaaggggtttagtgtgatgacgcatctcttctaccaacctgggggaagaggtgtgtggggacagtcccccctcctatcccttcccccatacacactttcccttggtaacaagacctttgtttaaccacattttcagtgggtggcttttttatgtgcaggaatttttttttttttgtgataagtatttttttaaatgactttcatttcttttctttttttttttgagatggaatctctctttgttgcccaggccggagtgcagtggcttgatctcggctcactgcaaccttcatctcccaggttcaagtgattctcctgcctcagcctccttgtagctgggattacaggcacgcaccaccacgcctggctaatttttgtatttttagtagagacgagtttcaccatgttatccaggctggtctcgaactcctgacctcaggggatgtgcccgcctcggcctcccaaagtgctgggattataggcttgagccactgctcccggccccttaattacttcttcattcagcaaatattccttgggtctgtgcgtctaggccagggtttctcaaccttgacactgtggacgttagggtccagatgattcatttttatggggggctgttctgggcaatgtagggtattgagccgcatccctggccaccatccactagatgccagtggcaccccatctcccagttgtaataacaaaaaatgtctctagacatggccaaatgtcccctgggggtcagtattgcccccagttggttgagtcctacaagtctaggcagtgggatacatgttaggaccaaatggacaaggttcctgccctcacgggactgatttgagctgagggaagaggaagtagctgttggataggctgtgtgttgagtgaaaggatggacagcaaaggatgcacagcactggactccaaacgctggtcagggagggcaagaaggcctctctgaggggtcgcacttgagcagagatccgaatggagagagagccacttgagcacggtgggctgagtgctcagggctgagggaacagccagtgcaaaggccctgaggcagggcaggacaggaagcgtttgcggaaagcagggagatcggcgtgtgcaaagtagagctacccagagagtaggggtggggacaggtgctcagaggggcgcagggggcaggccatcctggaactggcagttgtggtgtcaaccctggattgtcctcagtgtgatggaaagccactggatgctcctgtgtcggggagtgacatgttgagactgggttaaaaggactggctgctgtcaggagcagagtcagaggtgggtgagaaagaaagcagggcagccagcaaggaggctaggaggcgaggctggaggccagatggggagtggccagggtgaccaggtgagttggactgaggagctaacctctttagcagcaatgttgtcctaggtgccagagtgggcccttggtgatcaaagaagcctggcgtgggagggtagtgtgaactacagggcaggacatggaggctgcagacgtgtcctcatgcatccggctcagtcgcagcatcacctttgatgggcggtggcctcccagggacagcagaggaaatggccatgcacattcccacatgacacctgaaaagctctctttcccgcttcttgtcgtggctgaagtctcccaagctgtcaggctgccggtggctccggtgattctggctacacagcttgcttgctgtcctcgggcccagcacatttgttcctgccactgagtctctgaattggctgttctctgtggctggagggtcaacccccacacttgttcccttgttgccttctccaagtggccctggtcgccctgcaccgcctgtcacgtgcgcttctgcgggatgcagtggcctgcaatcgggggttcatggaagcccctgcctgctggcttgccatcttcacactgttcttgacgtggtcctgccctgccccagggcctttgcactggctattccctcagccctgagcactcagccccctcgtattcaacagagagcctgctgttggctgggttgaaagtagatgtgagaccggagccttcctcacagaggggacttgaacccctcttgaagctgcagaagaggagagtcctggaaggctggggtcaggcccttgacctgccctggggacgacacatgggaacagcagggtcatgaaggagaggctgtgggtgggcgctccccctgagggtggtgttcccctctttccatctgaggcagttggggcgcccaggatgggtttggggtttgctgatgtgagagctaccccaacgctgtgtttccttatgggggaggctgctcctggtcctgggtgctgggcctgcggctcctctctgtggctgccgctcccctgagccttgcccgcagtttcgcgatgcttcccgatgggctgactgtgtcctcctatctcttggctcttcacttcccttctgggttgatttggctaaatatgaaagttctttttcgccctccactctaacccctggaggtgctggttgggtgaaaaggcctctgtggttagcagatagccgagagattgttcctcttagcttagtcacgcatcacaccagctcgccttttaccccaaacatggaattggctcaaatgtcagcccgtgtgttggtcagagtggcctgcctctcttcaccgtggcgtcccgggccaccaggaacagcacatgaacgcggttttgggtgccttccagcatttaggctttacacacttgccagtcacgagtggctcctgaaattttctttttatccatgagggggtgtgaaccttggataagcagaaaataggttgttgtggagaaaacctgtcagaaaatggtgaagggaaggccaggctgtggaggtgccagaagagcgagggatttcccacctgcactgtcttcagcagctgtgatggcttgaactgtgtccccaacaaattcatagattcaagtcctaaccttcagtacttcaagacgtgaccttatttggagatagggccttgacagaggtcatcatggtgaaacgaaggcatcagcagcgcgcgtcccttcatctcagacttctggcctccggaactgggagaaaacccttttctgttatctgagccacccagtccgtggtgcttggttacggcagccctagcaagcacgtgcagcagcatttttttgtggatgcatgagagcgcgacccaggggcctttaattaagctattctcacacggtgtaggagaaacgtggcccccagtgccctctccatggaggcacatggctctgggtcctgaggtggcagaggcctgcctgctgttgtggagaaaggcccctgggacctgggctggatccagctgccccctcactgtgtgtgagacttaacctctgtgccgcagtttgcttatctgtaacttatctgtaacgtgggcctgagggaggcggtacttcatacacgggggaagtgcttagaatgaagccaggtacacggagccctgtacaaaggcgttgtgactattattatgggaagaagtctctggggaaattccaaacccttggctcttggcaccagcaacacaaacacctcacagcccagccctcctgtccctgggatgggggtgtgagaacactgaggccattgtgtcacccgaggccacatgtggttggcctcatcctatttccaacacgtgggctgggtttcaacgtggaacgaatggctgcatggccctgggtccataggaagcctgccatggtcacacaacagctgcctagtcctatggaagccagactgtgattgaaggaacacagggagtgctgggggcagggccggggccggggaggaagtgggaggaggaaaaaggaagtgtctccgctggttcgaggcagaattttgaaacaggcacagtttctttctgaacatccttttgctctgagcttccccctgtttgaaactccttggtcgtgtggccctccacccctcactgggggccaccacctggctcccgtcactgtcagtgccttcctgtcttctcccctctggtgtttggagggttagctagaaggggtggaatgagtcctggccacctcatcatcctaaaggtgcccgcattttaaaagcaagactcaaaatgattacaaatgaaaatgaaattcctggggtttcaggcaaggtggaataaggcagtgaaaagcttttgtattggagccagcctccaagatgggcctcgaccatcctacctccaggtgttcatgctcatgtgtggtcccctcccatatggaaccattcagggctgacctgtgtcaccaataggataccgtggaagcgacagtgtgtgacttccaaagctaggtcattagagaccctcctggttctcttggaccaccccctctagagaaagccaactgccatgtcgtggggacattcagggtatcctgtggggatgccagcgagcaagttggttgctatgtgagggagcccccgtccaactttcagatgacagcagccctggctgacatcctgaccacaacctcctgagagacgctgagccagaaagacccagccacactgctccccacttcctgacacatagaaaccgtgtgaatggtcagtgtaaatggtaattagtgatgcagcttcagataactgaaatgactagtaatggtccaaagctttcttggaggggaggcccagtgctggtctctccttgggtcagctccccaggctctggccatagctgccttcgttttgccccttctgaagctccacttttctctgatcgttccatatttgttcatggtattttctctctctttccttcctaggttggagaggagaggagcttcatgcaaagtttaggtctattgatgataaattagggcatattgaggatgagtttggatatatagatttttagtaaatgggcaacggtctgtatttcatgaaaatgtatatcctgtgtatctctttatagcctggaggcttcagtaaaatattccccaaatgccagtggggtttggctgtctgggcgttactttgggcattcggcctttgcagatgcgggatgtcatttttgatgcgagcagcccccttttcctccagcaccagggaaacacgccacagcctgtaatgcaatgtggagcccgtgtcctctgcccgctgcacaggggatttgccaactccagcgcctttgctttgtcagggctttcagacttctgacctcaattatttcagtgggaggtcatttttgcaagagaggatgcaatgggtgtttgaaaagagaaagtatttcacgggcacttcaaagaagtgttgcaagcatgccaatgaaaaacctcacttttgtaaagtgaagcagtgagatttaactccagctgatggcttgtttgggttgcctttggtcaacttttaattgaaatccatgtgcagaaaagtgcacaaaaggtaagcgtgcagcttgatgaattgtcacaaggtgaacacacctgggtaacagtgcccagatccagaaatggaacatgaccagttcccagaagccaccctcatgtccccttccaagggtaactgctatcctgaataacgccactggttccttctgcttgtttggaactttatagggatggaatctcggatccctttgtgtctgcttttctttgtgtctttcttttacttgacattaggcttgtgagcttcattcttattatgggatggagtggtacctctttcctcctcatagccctgtatagcctaatagctttctttgtatgtaaagtgtctcttttctgtcactgcttttaagagatcttctttttcacttgtttaacagttcgattatgctatgccttggtgtagttttcttcatttttttgtgtgtgcttggggtttgttgagcttcttctatctataggattatatagtctaatagtttaaatctttgtgtaaacaagatttcctatattgaatgttctggtcagtgtatctacatttatttccgagaaacttcttgagagagcttaaagggatttttaaggcagtttccctctcaagctgtcacctcctccacttggataaaaacagtgaaggatttgtcttgttgggctgataagaaaccgtcagcttgtggtgcttttagcctctgttatgggtccagagtccactccctcaggctccattgattctgtgtcgaatgcctgtggctggatatcaggaggacacctgtttttgtcagcccaactcttttcatgagtgaaaagtaacaagggaaacaagatgaattcagaaaaacaaacaaacaaacaaacaaaaccagtaaggaaaggcaaggtatgcccctcagacaggcattgctacaaattattatcatgtctttaaaaaaatattttctgtttttctttttaaaattttttaattttgctacaaattataaaactggtgggtgatggtggacgtttcaaaaccactcacgtgtgacatggcagtgacttcaggctggcctacatagccttttgttctctgtacatgtacagataaaaatctttcttgattctttttttttctttttcttttcttttctttttttttttttttgagatagagtctcgctctgttgtccaggctggagtgcagtggtgttatcttggctcactgcaagctccgcctcctggattcaagcgattctcctgcctcagcctcctaagtagctgggattacaggcatgcaccaccatgcctggctagttttgtatttttagtagagatggggtttcaccatgttggccaggctggtcttgaactcctgacctcaggtggtccacctgcctcggcctcccaaagtgctgggattacaggcatgagccaccacacccgccctcttatcttgattcttgagcatgtctgtgcagtgatgtccaaagcattcaatagctgactacttgatagggttttatatctattgatggatatagtattaataacactccctgtagaatagaggtagtatgtgtgcctggctaagctttttgtggcttagtggacactatttctatatagcaacattcagcaaacacttcattttatgcaggtccggatagtaaatagagatgagtaacataagcctttgccctcaaggagctcacagccaaatatgggaggaagcatgtttgtaaataatcacttgaacaaaatgcagtttctaaataagattgatgttaaaaatattaatataaacaatattaaaattttagtgattaaaacacaatggcaaggatgcaggtcatgaaatgagtggaaaataggaagggaacaaaaggttatactaggccagtggctcttaatgtgcgcccttggatcagctgcagcagcctcccttggaagcttgttagaaatgcagattccccggccccatccaagccttgccggatctgaagctctgagggtgggacctgacagtctgggtttccccagccctcctggtaatgctgatgcacgttcaagctgaagaaccactggtttagacggtgataagccaccagggttctgtcgggaagcctaggacaggccattttagtgcccacgttgtcccctaattgccagaagcctcagcacagcttggacccttttgttaggggactgatgtatgtcggcaatcaataaagtatattagggagtttttctgaattttttttgagacagcgtctcgctgtgtcacccaggctggagtgcagtggcgcgatctccgctcactgcaacctccgcctcccgggttcatgagattctcttgcgtcagcctccagagtagctgctgggattacaggtgcccaccaccatgcttggctaatttttgtatttttagtagagacggagttttaccatgttggtcaggctggtctcgagctcctgacctcaggtgatccacccacctcggcctctcaaagtgctggggttacaggtgtgagccaccgcgtccggctctgaattcttaaatgaagggaaagttttactttgcccaactagtacagcttactactttatttcttttatggattgtgtttttgatgtcatttctaataactgtttgcctagccctaggttttgctcatttgtgtaggagaggtaaagatcactcacatgggtttacacaggcaagggcataactggctgaagaaatataaaatgccatgtgatgctgccttcgtttgggtccttgcagaagtggaacttgaaattaggtttctggtgcaagttgatttgggaggggagtggggaagtgagaccaggaaaggaaggcagccattagggccgggctgttaatgtcacgcaatgggcgactggagcttaattccacactttggaaactctaggaaatggtgctcgctgtgtcatgggcccccaagatcacctctgggtctggtgatttcctaggagggctcataaaacttgacacatggcatatgcatggctatgatttagtaaagcaagaggacacagagaaaaatcaacaaagggaaaaggcttatggggtgaagtctggagaaaagcaggcacgtgcttccaagagtcctctcccagtggggtcacacagaacatgcctactcctgcccatggtgagttgagacaacatgtgtgaaatgtccaccagggaaggtccttagagactcagcgcctgggatttgtattgggggctgctcacataggcaccctctgcctagcacacatcaaaattccagactcccagagagaaagcaggcattcagcatagatcacagtatttggacaaagagtttaggcacagtgagccactcttaccagctctgggaatggtgggaaccctcccaaaatacaaattcccagatgccagccaagggccaaccttgcaaacaggcctttctaaggagagcagtctcaggtctgctatattacgtgttttctgcacaggtacaaagcacatgccttgaaataatctcattcaagggacaagggagtaggacatttgaagatgtctggttttctccagactttgccccgcaagccttttccctcgggagtcagttcttgagagtcatcgattaatacctattcccaataatgcacttcaggcatgccatgtaagcagagccaccttctgtgggtctcaaaacaatgacagtgaccttagactaagcgatatggttggaaattagctagagcttactggaaggttttgagtgatatgagtggggcgctggcagcatcagatacagtagttattctagaaattggatggggacaacagagccatgtgtatagggtagttcgcatgcctggggtcgtgtggcagtattgtaactgtgaatgaagagaccgaggtcaaggcttcgctctaacctccttaggtagatgcttccttcctgtgtctgctcattggaggaatgggaaagtgtgtgtgtttgtgtgtgtgtgtgtatgtgagagagagagagagggcatgcgtgtgtgtgtgtgtgtgagcattgtgggggcagaaaatcctggtacactagctgtattttaaacttccacttctaatctttcagttctgagcagcgtgaataggcagataaacaaatgtttgctatagcctcaaacattcatgccagaacatttttttccctccttccacacaagtaaattaagagaacagcggtctgttgtataatttgaagatggctattaatttgtgttggattgcatttcttaagcatgttatgttattcgaggagcaggagaccctggaggaggcgcttgtggggaagctttgaagctggagcaggaaggagtgaaatgacacagtctgatgacgatcacggtaatgcaggccttgcagcctggcgacattcttcaaaggcaactaactgcaagactgccctcttcccctcccctctcagacatctccaagaccctgccaaccgccagatgaaaccaatcttcctagagcctcgtgtggtggtctcaggcatcgcttgggagtgccttagaaattcggcgtctcaaatgcagtcttgggccacaccccagctctccaggatcagaatctgccgtttaataagaccctaagggatgcatggctcatccaagtcggagtcagatctcacccgaggccgcacattggcagcacctggggagcttttaaaaatgctgatgcctgggcgctgcctcagggaccccggtttaatgactctgggcggggcctgctccttgggctttctgaatgctcccacgtggttcggctgcgcaccccgggctgggaaccgtggggttccctggcagtacccttctggaattctccttccccagcctcccagtcacgtgactgcttaatctcctccctctgtggctctttctctgtcctctgctcctggctccccgatttctgaaggcagcccggtctcttttctttctttgttacctcctggccattctccaaagtgcctctgcgggggcgggagcttgtgagaaattcgagcctcagccatgccccagacctgctgaatcagcacctgcagtttaaccagaagcccaggggatgcgcatgtgcattgtcatatgagaagcgctggtctaggtgacgtaagctgggaaagaaacccagggaatctgctggaatgtagggagcctgggctcaggaactggaaggcgtctgtctgggtctctggcttgtttgttttctagctgtctcaacttgccactgtggtcatttggggctagatcactcttctctgtgcgggtcgtcctgtgcatttaggacgctgggcagcatctctggcttttacccacatcatgccatagcaatccccctccccagaggtgataaccaagaatgtctccaggcattgtcaagcatcccctgggggcagaatggtctctaggggacactttggtgtctgcctctggcctcattccctcccgccatacacccttggtagggttggtggttccaagttagccactaccgtggaaagagagacttcctttctccccctcgtccatgtgtgcggccctgcatgggtcccacgctcatccccatagccggtcattgtgcctggtggtcggggcactgtcattggccagattgggttctgtgccacatctggggccaggggccagctttgttagcaattgaaggagactgggagagttctgatggaggcacaaatggctattttggaccactctagcagccctttacggacccaagtcctccgctgacccttcacccaataacaagctcatttagcaaatatctgttatgtggcaacgaacagctgggccctgttccagggcgggcattttataaacagtcttcaggaccatcctaggaggtggtcttgttagcccatattgcaggtgagcagactgcagctcagcagggctggtgacacccatggcaacctgcggagcccagttgctccctaattccccccaccctgtgccctgctgtcagccctacctttctgtcacccccttgagctcttcctcccctccaggctgccctacactgccatatagctggacgaattgtaaaaggaacactgtgtcatcatgcctctgctcaagtcaggaaagactgttgctgctgtcatcttttgtcccctccccagtcccctcacctccctgcccctcagaatactctcctgacttctattgtgtttacgtctctacttttcattgtagatttaccaaagaattctggttcctgagctttgttaatttacttctgcccgtttttgaacatgatgtaaacgggatcacacagagtgtttggatgcatccggattcttttgctctgtattctgtgtttactcattgcaagcatactttgggaagtgcttgagtcaaagggtgggtagatgagaagccactgaaggtgacagaggaatggccgtgggtcagagagggaattaccttggcattacttgggcagagctggagtggtgggctacgcagttaggaggttgcggtgacctgggtaggagctccagcttagggtctgaaggccgtggggaggatggcaggtgaggcgtggtaggtttgggagggttgtcctgccttctctttctgacgaggtaggagttacaggttggaggagatggaaaaagggggaagcattcctcatacaggcttgttggaccagcaggagctgaaccagcagtcgtcttgggttgcagtgaagccccctctgagactaggggctcccagcaccaaggaactggcagccagcagccagcagccactgaggccagcacctctcgtaatccacaaggttggaagaaaagcagctcggtaaaggctgcttgtgatgagtcactggggctcctggaaaatctgtaagaaatgaagcttttgagatgtttatttttagctgccgtctgaccatggcctgtctctgaacttgatgttcttgggccctctcctctggctgtgtgttctagaatttctgttgtgtcctatgcttttcatggtgtcatgtgaacactacaggtaactgtgatgatcttgaacactttgttagcgctatggtatgatcatatttttattcatgagccgaggcacccggaatcttgaagcattcggatcactaattacttggagaaacttttctgattgtaggatctcacagaaacctctctctctctctctcccaccctctctctctctttctctctctctctccctccctccctctctctctctctccccctccctccctctccctctctctctctctctctctctctctgtgtgtgtgtgtatgtgtgtaataggaactcatctttattttcccaaagctttaaggttgaaatgttgatggtgacatcctttagttgcattgttgggtttctggaaactcattccttcccttaaataatcctaaggggaatgactgtggccacttgtctttatattatacttgtccccgtgggtcacgattatttgtttgctgggttttgttgggaggtgagggccgcaaatgtgctggtagctctggtgccttggacagtggcctggcaggtagcagatgcccaataaacacccatggtgtaaagcaggggccggcaaagcacagcctgcaggccagatccagcctgttcctgtttttgtaaataaagtgttgtcagcaggcagccacatcccttcatttccatattgtccgtggctgctctgctgtacaatggcacagtccagtaatcgcaatggagactatatggcatatggcccgcgaagctgaaaagatttcccacctggacctttctcagaaacatttgcaaactcctatcagttaagttactacgaggaaacaggaaggagcaaggggcaggaacagcttgtgggagaggctcatgagagccggaggtggttttagtagcagtttctaccctgcccacgctggcaggggaccctgccgggacttgcctctagggtggccttccttgcttgttggagactcttaatcttttaatctgagttatgactttccgttccatctgtccaagtcatctggggattagctaatagagcaagttggcaaataatctgacatggtctgatttgggaggggaatactggcataaacattggcaggtactgtggcacctggccactgctgggcagaggacagagggaacaggtggaagggcttcaaccacagcgttttatggacggtgtaaatactgatggcagcacaaagtgtaatggctccagatgggaaatcacccaagtgtcacccgcagtagaatggataactacattggggctgattcctcagtcaaatactgtgaaacaggagtcggccaagttcgtgatcctgtgggccaactccagctcactgcctgctttcgtacagcttatgagctaagaatggtttttgcatttttatatggttgagaaaaaaccaaaagaataatattttgccacacatgaagatgatatggaattcatatttcagtgtccgcgaataaagttttattgaaacacagcaccaggcattgatgtgtctatggtctctggctgctttgcaatgacagcggtggagctgagtcgtctagacagagactgcatggcccagaaatcttcaaatatttactctctggcccttcacagaaaaagtttggtggcccctgttacagtgcaaagagaatgaacagatagttacactgaacaacatgggtagatcttgcaacataatatagaatgaaagaagctggaaacaagatttcatttctttaaagttcagaagcaggcaacagtaatctatagtgtgagggttgggatagtggttaccctttggggtgggtcagggactagcgggggcttgaagtggtgtctaggggctggtcatgtttcgtcccatgatctgagcactccatacatgggtgagttccctttgtgaaaatgtgtggagctgttcatctatgatttttgcattttacgaatacatgtttacttcaataaaaagcttactcaagaaaagtgatttcagtctggcagctcctcagaaggttaaacagagttcccatctgacccagcaatccactcctgggcatatacccaagagaaatgaaaacatatgtccatgcaaagacttgtacacagatgttcctaacagccttattcataatagcccaaaagtagaaacaacccaaatggccgtcagctgatgagtggataaacaaaatgtgatacagccacacaatggaatcttattcagcaataaataaaaaggggtgaagcactgatacgcaccacagcctggatgacccttgaaagcattatgctaggtggaagaagccagatgcaagaggccacatactgcatgattccacttactgcatgattccacttatacgaaatgtccagaataggcaaacgcataggatggaaagtatattagtggctgcctaggctgggagaaggaagtgattgctaatgggtagggggtcatttttaggggggtgaaaatgttctggaattggatagtggtgatgattggacagccttgtgaatttcctgtaaaccactgaattgtacactttaaaagagtacatcttatggtatgtgaattacctctttaaaaatgctgtaagagattgctgctacagacctgtgtgtatctgtacaagtcagaaggaaaaggtctcaaggtgacagccacctcatccattcttcctgctactcctccaaatgcagatatcttgaaagttgacaggcagggggaatgcctgacttcccccaggtaatccagactcttcctctagatccaagccagttgagtagcacagagcagtttctagaatgtagctaacatgggcatgttaattttgctacttttgtttactaaaactgcagttctcagaaaaacaggataaactaaaagatcctagataacttgcttcctggacttttcctgtgattatgcctgacttcgcccccattttcctgatgtctgttttcctttggtctgattggagaggaatgggaatctatgtagtagccactggggcccattcccatagctgagcctgggctgtcggctccttgctggttcctccaagacttcattgcttcacagccaatgaaatggagcagtaaaaaaacaaacaaaaaacaacaaaaacaaaacaaaaaacaaaacaaaaacattaaaaaagacttcactgcttacctgtaggttgctttttatatatagttctcaatctcttctgaattaaacttcttggtccccacttctagatgttaagggccataatggttgcaaatattgtgataacttttgagaggatcccttttgagggtgcgagatgactacccagaggatctgaaggttttcattttgctgacactgaagagtgtatttcttaggattttctgctctgtaatgacagataatcacagctggcagtgaagatagcgctgaactttctgtaaagtcccagccctaaacattatctgtggcagagacaaacagttttaattaatgacaaaaggtttgcttgtccctgcgagggtgaaaggggccggtgctgtttcattccctgtgccatgtactgggctgaaggggcaggggagggagcatcccagggtcctggcttttgagagaggggcagagagggtcagctgtggtcacacacccatacttgggagtcgtacaagtctcttggttagtggtcttgccactttgaatagaggtatttcagatttgaaagaaaacagtctaaacagtctcctcaaagtaaatgctttgaggagtttttaggaaaagctatttcgaatgtcaggcatagattcatgttttaatggcctcactgattcttggtaagtggaatcccccagaaggtcccccagaagctcagttggaccaccacaatctccctgaacagaactggagtccatcaggtcccctctatcagttacagaaagcagaggagtgagcagatcaacctcagaaacaaggcgacatgcagggggataaggaaggggtgttttcatgaaacatgattttcattttaacaaacatttatgaagcgctaaccacatgccaggcacaaattgctttacaaatgtcagctcattccgtcttcttcacagcaccctgaggcaggtagtgctgcaattcctacttcatagatgggggagactgaggcacagtaagaaaggtccaacaacttgcttaaggtcacacgggtggtaagtggcagagctgagatctgaactcatgcagcgctgttctggagtctgtgttttaaccagtatgcgtgtgatgctgcctctcttgtgatgaacatcagaatatagagggacaaagtacaatattgaagatccaaatatctcatactgccaatttgttttaaaatacaactacgaagaaaacataccaacaggttatgggagttatcaagggcatgatgatgggtaatccttattttttttcttgatagttttctgtatttgtcaagaagttttgtaagttgggtggttggttgtgtgttttaaaaaaatagccacaataatatctctgacttcggaatgctcatctagaactttgccatttcctcatcaagaggtagagtctactttctctctccttgaacctgggtgggattttgtgactgcctcaatgaacagcaagtggcaaaagggacggtatctgacttctgaggctgagccacgcaaggtgatacagcttctgccgggtctctctctcttaacacacttgctttggggcccagagcctctgggtaggatatactgccacctggccgggcgcagtggctcacgcctgtaatcccagcactttgggatgccgaggtgggcggatcacctgaggtcgggagtttgaaaccagcctgaccaacatggagaaacaccatctctactaaaaatacaaaattagctgggcgtggtggtgcatgcctgtaatcccagctacttgggaggctgaggcaggagaatagcttgaacccaggaggcggaggttgcggtgagctgatattgcgccattgcactccagcctgggcaacaagagtgaaactccatctcaaaaaaaaaaaaaaaaaaaaaaaaaaagaaagaaagaaaagaaaagaaatactgccacccaaagtcacatgctgaagagaccacatggggatgccacatggaaagagagagaggcctgggaaccccagctgttctagtctccagctgttgagtctcttggcccaggcaccagatgtgtgagtgaacaagccttcggatgatgccagctccagcccctgtctgaccaagaccttgtgaaagaccctgggtgaggatggtcttgctgagtccaatgagaccccagtaccaggatagataaagatatgatgggctgcgtgcagtggctcacacctgtaatcccagcattttgggaggctgaggtaggaggattgtttgagcccaggagtttgagaccagcctgggcaacatagtgagaccccatctctacagataataaaaaaaaattagccagtgtggtggcatgcatctgtggtcccatcttctcaagaggctgaggcaggaggatcgcttgagtctgggaggttgaggctgtgttgagctgtgattgtgccactgcactctactgtgggtgacagagtgagaccctgaaaaaaaaaagaaagaaaagaaagaaaaagaaaagaaagaaaaagaaagaatcctttggaatggctaaagaagatgccccaactgtgtctggggaaattaatgcaagttccacagatagggtgaaacagaacagggttctgcagtgtgaataggagctttcaaggcagaggagaaggttcaaggtagaagagaaaagcacattcaaagatacgggtttctacctgacatttttggtcaaacatggataaccatgattcacctagggtagcatttttatattcagccaagccttgattctacttagaatctgtccttctagatcttgatctaggtgatttcctgctttctttcatcttctagaacctgttatgttattgctaatacccaaccataaaaagtccaggtttccttcgagtgttacagatccctgttctgagagcgagctgacccattcagagtcacttttaacatcagagctgtaaatgacatcattaatactattgtattaatacatgcttgtcttcgttgggtcctgggtgaagtgagttttactggacaggatctgctgttgaagaacttgagcctgattccttggggtcttcatgcttggagaccaaacctactgatacttttttgccttgaggcattggttgcaagatataggtgtcctgcattccttccacagttcctttggaggcaaataatggttgtgtaggagagatgttctcttgtcaggcaggatacttccagcctgaactgaggcaaattccactccaccctctcactattggtactgtcatgtatggctgctccagtcctccccagagttggtctgcattgctccagctaacttgacctgtcttccttccttcagagctcaagttcattctacctattaacccataattatcatgctgctgaataacaactccttcaaaggactcagtggcttaaaacaacaaccattcattattttcacaagtctacaggttggctgcatggttggatggggccaaagttggctgatcttggctggactcacacataaatctgtggtcggctggacctagatgattttttccccctttgagatggagtctcgctctgtcgcgcatgctggagtgcggtggcgcaatcttggctcactgcaacttccacctcccaggttcaagtgattctcctgcctcagcctcctgagtagctgggactacaggtgcctgccaccacacctggctaatttttgtatttttagtggagacggggtttcaccatgttggccaagctggtcttgaactcctgacctcaggtgatccacccgcctcggcctcccaaagtgctgggattacaggcgtgagccatcgggcctggcccctagatgatcttttaatcccaacctcacaatagacaccaacacctccttctgggtccccagggaagtcctctgaggctctgcagatcagagcctgtttattttcctcaggaccactgcatgttccgtcaaagtttaaagatatgattgctctctacagtgattttttgtttcaagcattattgcctgaagtagttgtttgactagagatgtagttaaattttaggtggtatcaactccttttgaatagactgtccaagtctctgcgattctatctgctggttgggtttttctgacaagggctctcttggagggtcaacagcctgtcgtcttgtttttcccatcagagattttctttcccacatatattaagaggttattttcatgttgtttttgtatacatgagaatgaaatctttgctttctaattttactctcttcctcatatcattggttgctactgacttctgcgatgtgattcttccctgggcactcatcagggggtattattttcaacttggcatggctcaaacctcaaacttttaaagttttaaagcagccgagttgcactgatgatcaataaatcaatcactgtgaccactttattgcttgtaaggtgattaccctactttgcccatagtgactcttcaatttgattaaaatgcagtttcattgggtcgtggttgagtcctctagatatataaatacatgagagaagcctgcactcaaatgtttttataaccacccttcagatttttaaccatctatgccagcacttttgtggtcctcatcctataattcaaatttccatgctctttgccaaagtaattcttatttatgcatattccaacctcttgtctctgtaagactgtattcttttttctgctaactggtggtgagccttggtcccactgcaaagcattttctacagctgaaatgagctcctgtgcaatctgtaaatcaggctctgatggtgggagaatatgggagatggtgttggttcactcgcgattgttttccaggtgaggagagctggaatagtgggagtagaattattatcttggataggaaaggaagacacattcaactgtgctactgccctggcagcaggagcccttttgactgcattttaagacattaaaaatgagcatctgtcctggagctccttgcccagggcagcgtgccaccagcttctcatggctcttggctcgcggcaggttgtcccacctcccttgtccagctccagggtggccccactcacatagagggctcctgccatctgcagattgcctgggctcccaccaactcattaaagtcttgccagcattttcactgtgccattggagtacattttgaatatccatgatgacaatcacataggctgcctgcctgagtggtccactttgtctcccataggaaccaattattgctttgattaccattattttcatttaaaccctatttgcccctccagccctgtcatttggacaccttgcttttgcagaatgtgaggttttccaggaatgtatataattaattaatcctcatttgcagattccatatttgcaaatttgcctactggctaaaatgttatgtgtagccccccagatcaatactcgtggagctttcgaggttgttcatagatacgtgtgtgtgtagagcgacaaaaagtgccagcagtgcccgttccttgctgaggtctgagaaggcgatgctctgccttcctgcttccactctcctcctgtcaacaagggtccttttcgtgttctatttagtgccatgtttttcacagttttgtgctttttttgttggtaattttgctgtttaaaatggccctgcaatgcagtgctgggaagctgtctggtgttcctgagtgtaggagggctgtgacatgttttatggagaagccttgttcaggcatgagtgatagtgctgctggctgtgaggtcaatgttaataactcaacaatatctattagagtgtctttaaacagaagtatataaacaaggtacatcttgattgtttgatgaaaatgtgaccaaagattttgcaggaacttaaccctgtattctcttgggaacagtagttcagtattcagtaattcagtgtttgaggtgactttatagagcataacctccacgaataatgataattgactgtgtatatatttcattacagcacagatgcctatgctgaaataatttttcttatataagaaaatagggcacatggactattcttcttgcatggccatggcatgtcctgctcatgtctttaacgaccggttttcttgcccaggtgtaattagcatggtcaatgcgggagcgatgagtggctctggaaacctgatggatttcctcgatgagccgttccctgatgtggggacgtatgaggacttccacaccatcgactggctaagggaaaagtcacgggacaccgacagacacaggaaggtaggtggcattccgaaaggacacactgcaaatggctaagccatgttttcattcaaaagttactgagctggggcttaggtccacgtacgtgtcatgtgctgggttagggtctaaagaagaaaagagccagtgggaggagcagatatattggcagatcattgtactagcaggagctttgggcaggacgttgtgtcatatggagggattgtggtgtggaggagagggaggggactttgcaggtgccatttctggaacctgttttctcatccatgaggatggaagtgattatgcctgaaaaggaaatgagattatgtgtatatgaaagcacatatgacagtgcctggtgtctagttggcaatcagtatatattttaatggaccacaatggttatctgtcaagtgctgtgggatcatttaggttcggttagggaagggtttttcagcaagggtaacatttcagttgggtcttgaaagatgactaagattttgctaggcagaggaacggtgaggattctaaacatcaggaatgccccccttttttaagtcacagaggcatgaaagaatctgatgtatctgggcaattcagggagctccgaggatctggtggaggattcctgcagagggagggatagggatgagtgtggaaatggaggcagcagggccacgtggggaacggccatgctggcggtggagaggagtttgcatttcatgctgaaagccacagaagacaataaagatgcgctgcaaagggagaaacaggaagcttggaaatgagtccaggagaccgaaggcagtgatgtgtaggtggagagaggggatcaggatggagaggtattttgaggcgccacggacgggattcaggggaggtgctggggccaggaggggaatggggtcacagaacaccaggctttggcctgatgaggatgatgcctttgatgcctagaggaagcaaggggggactggcagactgcggaggaggccattgagttctgtgtagatgcgttggtttgagctgcgctgcggatgggtgatcacaggtggcgagaactctgtggttcaagggtgagggaagggccggggggagaatgaggtccctgtgtgcaagtggaggctgaagctttagaaacagccacggtggcgtgggtgtgcagagacagaagggaagaggtagtcaaatccccaggcagtgcccagagttaccaggtccaggggaggcagatggggagcctgtgacaagaggggaccctgccaagagcagtcccctgtgaatggaaagggtgttgtgtaggggcctgctcacaaggtcaccctctatggagaggtcaggtaggaggcgagccagcggcatgggggctggcggtgaggggagagctgcttcagacgagggtgaggagtgacatggacagtgtgaccatgtcacatcgcctcacgagggctggcacgaaaggaggaggggaatgtgtagggagccaggctcagtcatgaagatgttgcagcctcttggctctgcagtgcaggaatgtggggtcgaggcagcattccctctagagcacagctcagcagactgcatcctgcgggccaaagccagctggcaccttgttttagaaataaagttttattggaactcagccatgcccatccatttccatatttttatgactccttttgtgctacagtggcagggttgaggagttgcaacggagaccatccggcccgcaaagcccaaaatatttactctctggtcctttacagaaaacatttgcccaccactgctctaaaaggccgtgagggaatgatgatctcagaggagcataggattctgttagcacagggaggtgtgtgtaggtagtccatctgctgtgggagacgtgatctgtgccagctaattctaagttcgtgctgctaaaatttaaccttgaaaacaaaaggaggagatgaagtctgtgtgaagaggctttttaatgaaacttagcaatgtaagttaagatagtaactcatattcagaatggagacaccgaaccaatgtcccccttcagcatagcttttaaatcatcaaagatcaaatcacatttagtatgttttttaattaagtgaattatttgagtgtgtgctcgaattctttggagacttttgtggcatctttatagctctgtgaactagaaagctcgtcgtaccgttgcggcacataactgaaagaatcacatcagtgggaatttagctgcttgatgacattcattttattttcttaattaccctgtttcccgaggaaacagtttcaaggaaaaaagcatgaattcgaaaatgcattcggatcagttgctgtatctgctttgttctagatcaccagcaagagcaaggagtccatatgggagttcatcaagagcctgctggatgcctggtcgggatgggtggtgatgctgctcatcggcctgctggcgggtacgtggatgggcatgcggcactcccgtgggaagctgcagaggccgaaacctcaaaacacgaaccctctgggagatttggaatatagcgcgtgtcgcttgtcgcttttacccctgtgggagggatttattacttgaaatatctaagggcaaaatgcatggctgtatatttaacctaaaatccatcatcaataaggcatgcccaaggcatgagctcaggcacaggcttctgaagagctgtgacgatagagctggtagcctttccacacagagcagagttttcttactataccggatttgactgaaaacacacattttttttggaaacggtcttgttccattgcccaggctggagggcagtggaatgatgccagttcactgcagcctccacctcccggggttgaacaatcctcccacctcagcctcctgagtagccaggaccacaggcatgcgccaccatgctcagctaatttttgttattttttcatagagatggggtctcactgtgttgctcaggctggtctcaaactcctgggctcaagccatcctcctgcctcagccaaagtgttgggattacaggtgtgagccactgagcccagccaagcacacattttatattcggttattcttgattatgtagatgacaacaaaatcagggactgttttatcttcaataacaaaatgtcatatgagattgccttttgctactactggtaggctctgggatgaactggaaacatcctgcaacagtcagcaccatgctagacacccacgggagctgaggcaggcccaggggcctccatcatcctgaccctcaggaactctgcatctttcctttttagaatcccaacaccgtgtttgcgagcagtagatgtttccagagtaaatggatgctatctggaggggaaacacgtctttttaatatcaaacgcaccagcccttccgggaaatagtttcctgaaacttatgtccttttaggagattgtgaaggttaatgtctaagaataaaaaatttggcatgacgaagaggtttccttaataaaaatcccctgcatataacaacataatagttatggttagagaacagatcagggaattgactagaacacaggcagaatatatgtagtaagtggtctaagaaggacagaacacaaatggggcacagatagagttttgtgattccaggggctttcagtttccaggtgatcttgatttattccctagctcatcggaggaggggcttggttgccagggaagggctctacctccctcacctgcctcagcattccgtaaagagctaagaggaatgctcagagggggagttctttcctactagtcacagatgctgtctgtccgtttctccaagcctgtccttcctttaccagtggcatttcccgtcatgtactggcagcagccagggcaggaaattagacttcattgtcacaagggattggacgaccaattttgcttgactgcttctataaaggcctttgaaggtgggccaggtgggagtttgctatgaattttgatgtccttatttagagtagattgataaaaccttatagtgtgtcatttttcttggctcgtaggaaggagaaataaatagggtaaatgaagaaactcagaacaggaatagatgttctgataacggcacagcttagattcattgactgacctaggagcccaactgggctgactttaatctgattttgaccagctggctttattatccacttgatttccatcagctctttcacgagggggaattaaaaacaatatgctgctgccctggcttcacttaaacagtatctctggagaggacctctagcttgaatacagcctgcccctcccctctgtgattgtaatgtgcagccaggggtgagcaccactggccaaaggagagcccatgcgcacgtcagcaggggaatacatgggagggtgagaatggggtgatgctgaaaatgaagggactacagtgttcttttgatttggatgcactttgaagggacagccagagagccacgtcccactcacttcccccttcctcgctggactaacagtggagaggacctggggtctcactgcctggccggctgtcccctcagtggctgttgtcttcggactcccctcatgggtaggcccacagcatctccgcatgtgcttatcagaagtcaccgctaggtgtcactgttggaccacgaaagaaagctgaggcctgctgaagcgcagtcagaaccagaatcagcaaggaagattgggtgtgcagtaggggggttgtgaatgaatgaataatgatgaaacttggggtgatcatcctgtttgcccctggatatctgcaggaccctcccatcttcttcaccttcttcttcaaatactgcacgatgtcacttatctgtggagtccaaaaaaataaaaccagtgtcatagaaacagagtagaaaggtggctgctagagggaggggtggggacaggatggggaaagagatgttgatcagagggcgtaagtttcagttagactggaggaataagctttagtgagcggtcgcactgcatggtgaccacaattaatgatcatgtattgtatatttcaaaattgctaaaagagtagactttaataatctcaccacaaaaataaactggggaggtgattcggttggtgcgaaggtaattgtggtttttgccattaaaataacggcatgatcggatctttaattagctcgatcaagtctttctataatgtatacatagatcaaaacatgacattgatatacacaattattatgtgtcagttttaaaaagttaaaaaatcaagataatgagctctttgcctttgtttttcctgtggaaaaacaaagaactgtggatagttctaaatttgacattaccggaccctgtggaaagacctcatgaaatactaaatattatggttcttgcgtgctgttgctagggggcagtgtttacttagctgactctgcaaactagcattaagcggaaccaagcttgcatccaggatttcatgatctagagaaaatactttgagcatgtaggatttcttttcactgggtttcagtttccaactttaaatcaggaaatagttttcaccattccacaaggtatatgtacttcaaaacatcatgttgtatatgattacaacatacaatcttatgtgtccattttaaaatgaaagaataaatcaggaaatagctaatgatatctctaacttaattagactaattatatatatttgtatatttggaatcaagtctttcattattgaattgcatgtttaaaaatttcaaacctgtctgatatttaaaatttaaaaaacaataaaattacatccctctctctgtaagcctcacctccctcacctgctctatggatgtatatatgtatgtatgtaaagctttattgaaatataactcacattccatataattcacccatttaaagtatacaattcagtggtttttaatgtatcacagagttgtacaaccatcaccgtggtcgattttagaataattttatcatgcccaaaagaatcattataccctgtagctatcaagcccctgctccccaaccatcccccttccagccctaggccactgttaacctgctttctgtctctatggatttgcctattctgggcatttcatataaatggaatcatacaatatgtggtctttgtgattaacttattctactcagcataatatgttcaaagtttgtccatgttgtagcacgtgtcagtacttcattccttttcactaccaagtacaattccattgtatggatagaccacacgttgtttatccacttatccattgatggatatttgagttctttctactttgtgactattttgaagaatgctgctatgaacatttttgttcaagtgtttgtgtgcatggatgttttcatttctcttgggtatatgcctaggaatagaattggtttttttgagacagggtctggttctggcgcgatcatggttcgttacagactgggcttgagcaatctgcctgcctcagcctcctgagtagctgggactataggcgcgtgccaccatatctggttaattttttttttttttttttttttttttttgtagagacaggatcttgtcatgctgttcaggctagtcctgaactcctggcctcaaacgatttgtccacctcggccttccaaagtgctgggactactggcataagccactgcgcctggcccttatactttttaacagagcctttaatatacttattttctcctgtcccaggtacagttacacaaaggcaggggcctgggtctactctttgcactgctgtattcccaagacatggatgagtaactgccgtgtagtaggtacatgttcagtaactatcccttgaatgaatgaatggacctgagttttctgattttttcattcatttatttattgcaatattttattcaacatggatatatagtgccaaccatgcacctgacatggatataacaatggacaagacagatagggtccttgcccacttagagtggacacagggtctggatgccaggcctgaccccccactgtggtatgaaaaccaaacaatgaaaccttttttacccaccacttatagactagtggaagtacacacacacacacacacacacacacacggagaaaaagagaaagagagctaattgtgatattaggatgcgagaggtgtggtgatggggaaggacaggcagccacaggaatgccagggaagtacacctaacccaggcttaggaaatcaggaaagacttcccagaggaggtgatataaatgctggaatctggatgataagtaggagtctgatgggaggggagggcagtgcttgctgagatggtgcaggtaggagagcgtggcacattccaggaacatggagtgggcagggtgtggggagttagtgagggaaagagatgaagctggagagatctgaggggccagctgtcagggtgggtgacctgttgaggatttgggtgttctcccaagaataatgggtaaccatggcagggctttccacaggggagtggcacaggtcagtctggcatttggaaagcctatttgaccacagtgtggagaggccatgaatggggcaggactgaggctggagaccagagaggaagctcctgcagcagtccagccagcaatgacttcaacacggtgatctgaaagacagcccgagtggggatgggggaaactgcagtgattcaagagagatttcagaggtggagctgctgggatatggggattgcctggaagggggttgctttcccagatttctagtttgcacagtagtgtgcctggatggtgggttcctctcccagttgggacgaagctgaggctgggaggaggatgctttagttcggtgtcggatggtggtggactgaagtggagatatctagtagacccaagaaggcaaatagacttgtgttctttgacaatgcccattcattggctttgactgcctggggctttgctacaaagatttgggagggtaggtccacaagtgtgtgtcatgattgattagtgatgtctgtcatgggcatgtcaaaagaattgtgaaggggaatccaatagagtgtgctattattgattggtgatgtctgctgtgggcatcggaagctgacggctgggctatgtagtgattggctctgtaatagccagtgggctctatgtgcttggaaaagcatagcttgagatgtacatttatacctaatggtaaatagtaggatatgaataaggttgccagggttgagagcatagtataaaaagagaaaagggtttagggtcaagctttgaggaaatggcctttagaagttgggtggaggagtcagaaagatcagaggagtcagagcaaaccagagagtgaggaggaaagcaggagagcatgatgtggaagccacgggaagaggtgtttctggaagggtggagtggtcaacagagtcagatgatgctgagagctctggaactggggtcagcaaactttttctgcaagaggccagagagtaaatattttcaggtttgtggcccatgtggtttctatctcagctcttcagttctgccactgtagcatgaaggcagccacagagtgcatgtaattgaatggtgtagctgtgctccaataaaactttatttacaaaaacaggctgtgggccagatttggcccatgggctgtagtttgtggatcctgttctagaggaatgagctaaggccattgccttagctgcatgggaatctcctggtagattgaggggatggactgggccaagggaaggaaagagattggatggtgactagagggaaagtggaaacagggagggttttttttttttaatgtttaaatgctgatggcaaggagaggaagaggttgaagatacaggagaaggaaaggggaatgggaagaacgaggccccatggaggaaggagatgtagagctgaggtgggcggtgtccgatgcaacaccaggagaagagaagggaggggtgagtgctgatgccaggtgtggatgcttttggtgaggatgtggatgcagaaccgatcctgtaataatgatgcagtgaaaaggctgaaaaatgaagatgcttgaaagcattctctgcctttgtgagagatgagaatgcattattctggaaagagacccaaggccgccttttgtgatccattcaactgcacattccgttttctcccatttctattggcttttaaaatacttatttagttttatagacccataattctttataatttaaataatgcagagagttttaataaacaggatcttcccgaatttggttctcatttggtggcaaaaccttactcatttatgatgtgaggccgtcgtagttgttatgagtccattttgtctgaattatcatgtttccctgagaaatattaatgtgtgtgattctaggatcctgccccagaagccattgagagagttctgtcttttacactataaatacccaatgtcaaaaacttggaaagggaaaaattgcaaaagttgcttgtctctcctacccagttcaagctactgaaccctttgtatttctcattgggcttgtgctgccttgcccataacataaatgttcaagtgctgcaagtttaatgaaagaagcttcctatgtaagtgacagccccattgcaagtttattgcctgctctggaatctgggccatcattgctgatgtgcccctgtctggccgccgtgttggtctcattcttgtcgcatcatggggcgattcctcttagtggctcgtgttacttcttccaggcaccttggctggggtcatcgatctcgccgtggactggatgacggacctgaaggagggggtctgcctgtctgccttctggtatagccatgagcagtgttgctggacttctaacgagaccacttttgaggacagagacaagtgtcccctgtggcagaaatggtcggagctgctggtgaatcagtcagaggtgggtatttgggcagggtcctggctggggacccctgccgttccatgcgtgcttgggaatgctgctgggagatttgtgaatgtctgtgatttcaccttcaagtgcctgctctgaagttcgtggcttaacactagatgacgggctttttccagctctaatgctaccactcaaacttcacttgcaaaacccttccccactgtttcatgtgcacaatgcatatatatatatatatacactttaagcctcatatttggctttatcttgttatatttggctttattttttcttaccgaaggtggtttgctgatcatgctgaagaaacaaggttgactttgatatcttctaattgagaagaacataactttttaagttatcctttaaaaaaaacagctttagtgagataaattcacagttcacattgttcacccgtttaaagtgtacgatttaatgcttgtagtatattcagttttgcagccgttaccacaatctaattttagaacattttcgtcatcctttccaaaactctgtctccattagcagtcactcccatgtcccccaacctgccagctctgagcaaccactaatctaccttttgtctctctagatttgcctcttctggatgtttcatgtaaatgaaatcatacaatgtgtggactttgtgtctggcttcttccacctagcatcatgtttccagacttcttcctattgtagcatgaaccattacttcatttttttatggccgaataatattctattgtatgaatggaccacattttatttatccatttgttggttgcttttgctttttggctatgatgaatgatgttgctatgaacatttctgtacaggtttttgtgaagacatatgtttcatttctctcaagtatatatctgggaatggagttgctgggtcagatggttactctatgtttaaccttttgagcagctgtcagactgttttccaaagtagctgtaccattttacattcccaccagcagtgtatgagacttccaatttgtccaccttcctgtcagcacttgttattatctgtttttgattatagccatcctagtggttatgaagtggcatctcattgtgctttcagtcatcttccattgcattttatgaccacattatagaggatgttctgggccttctataaagagaatgccctaggcacaggagataatagtggtgaaccacagacctatagcatttagagcttcagatctttattaaaatcttagttcaggaaagagttaacttctaacccatttcagtggttaccaccatgactatgagttattaaaggatcagaaagccacgtgaggaggaaccaggttgtcaagcttcacattaggggtaatgtgaggatctctcaagctagaactaatctttcaaggtatatgtaatctatttatacatctcctcccttccccactttttttttttttttttgcctgactgacttaccacagctgaagacatttggaatgcactttgccatttttgctaaacctctttctcagtggaattgaaaattaattccttcaaatctcagaaggagacagggatcttgaaatctcacatgttctcagtgctctccattacttccaaaaagaaattctctacttgggttgatgggagcgggcagacagaattggctgtgcgccatatttttattcttctctcctacttgcaatgtgtgttttggggaaatacagccatccatcttttcagctgtttttaagatttatactttgattcgaagaattacctttagtaagagtgagagttatttttagcctccaaaaaagtacatatttaagtgggtgaaaggtatttcttagtccgatttctcaccgcatagggtgtgaatatatgtgcttgtaaaggccagagcagtctcctggaacgtgtttttgcatttaataggcacacatgtggctgtccatggcctgacttgtaggtgacctctcttttctgccccctttacttaagtaatccagatggtggcaagaagctgaggtctagagagtgtggtctgtacccagcagaccaggcctttcacgcataggaccccagactgtgtttttggttcagaaaaccttctccatacatcagataatttggaataaatggttcaatgaattattctgaaagtgatcacgtttttcttctctgatagtgcctctcaaatgttagtgcgcatagaacctcctggagggcttgttaaaacatattgacctgggccccagccgggagtgtctggtgtctggttcagcagttctcgggtgaggcctgagagtctgcatgtctcataagccactgatgtggctggaccatggaccccaccctgagcagcagtattctaaaatacaggcccgacccgtattcattggcagtgcgggtgcttgctgtgcttgggcgtggccttaatgaaagctaagagagaccaagccaccacagacaagacaaaactaatctgccagggtctcggaggcaggattttctgcatcacacctttgattaactctatgcaagtggtgattaaaaccaagcatcatccacggtttccattactgctgagccttccctgtgtagaaggcgcgtgtaaacagctcccagagaaacacccgctgctctgtttgtgtgtactgactgtagcaatagcaacagctgataaacctacgctggccttttggtttatacaggactgggaccaaacctgcccaatcccgtcaaagcttttgttgtcaagacagatggggaggggttgagtctgttgctcaggtcagctgtggctaatgtttccttttgtgttttgtgtctgttgtctagggtgccagtgcttacattctgaattacttaatgtacatcctatgggcgctgctgtttgcatttttggctgtctccctggtgcgtgtatttgcaccatatgcctgtggctctggcataccagaggtgagttctggctgatttttttggtaccaataataagaatagcaaattcttctgtagcactgtcatgccaagcacagttccaagcgttttacttctactaactcattaagtttctcaataagactatgacgtaggtactattattctgcatttgatagttgacgaaactaaagcacagagaggttaagtgacttgccccaggtaaccaagctggtaagctgtgagttgaacccagtgttctgacttcaggatttacacactgtcttcaagatttctgtgctattgcttctcagatgataaaagccttgtctttgtaaaccaggcataactcttaaagcctgtggaatcagagttcattaaccacacacataaacacgctgtaataactcatcagtgcatctgtgatgtaatgtgagagacgatagtggaggtttgttgctgtgaaagttcactgatgatgaaatctctcttgccatgttttgctcttctggtggcaagctaatagcaatcttttaaaaacctgaattctgcctttaatacatgtactgtgaacgtacccccgtgaatttcgagttcttataaatagttttcagcactttcatgtaaccgaagcatgagggaagtgacctcaccgattaagaggagtgcctgagaccaaacttgaaacctatgaggacctactgggcagaatcatgataattgagctgattcccgaaaagcccagatggtggaaattttagccagaagtaattttaaaagttctggtattatcactgtaatccatgcagttcagttctcctttgggttgatgccttagcgatgcacacaggcagtgggctagagagtttgaagatgtagttgtgggctgagtatggcagtaaatccacaccctttgggaggaccctgcagccctgatggtggtccaggcagtttgcagaaagggctgaagtcatgaaaagacaatcagaggcaaaattcaacatggtcttgtttcaggaaagatagaaaaaagaagtcttaatatgtcatgctgaatttttgatggttgatgttaacatattgcttcaggaacctgaaaaataagctgtattaccaacctgttttctcagcgcagccagttctgctataatgcaacatacgcattcctaaaaatcaccatgccatgcaaaatcacacaacagaaaccacagggctttatggggaacatgaattaggggcacaatacacaaaacttcatcactgacacatatgacaaaaagaggaacctagtaaaaacaggagcacagctgtacacattaagtggctaagaaatatgtaaataccacaataaatatgtcacttcctgcaaagaacttgaagtttgcttgtggaagtgggtgtcgcaagggctgcaacttacgcgttgctgtgaagggcataaggaaggttatctgaagttgtaggggaagttgagacagcaggcgtagatgggtgtggcaccctggcatatgtgtgaaccggtagatgtttgactcgtgtattttgtgttttcctacatgactgggtgcaattttctgcatttacctggtatttctcctggaggaaatgcgcataaatagacataaaatttgagttatgctcaaattcctccctaacatgagtggcattggaacaaatttgcattttctttttttctttttccttttctttttctttctttcttttttttcttttttgagacagagtctcgctctgttgcccaggctggagtgcagtggcacaatctcggctcagtgcaacctccgtttcccaggttcaagcgattctcatgcctcagccccccaagtagctggggttgcggatgtgtaccaccatgcctggctaattttttttttggttttatttttaagtagagacggggtttcaccatgttggcctagcctcatgtgatccatccgcctcggcctcctaaagtgttgggattacaggcgtgagccgccacgcctggccttcttgtttttttattgttttatatagagacgaggtctcactctattgcccgggctggtctcaaattcctgggctcaagtgatcctcccgcctcagcctcctgtggagctgggactgcaggcacgtgccaccatgcccaactaatttttgtatttttttgtaggtttttgccatgttgcccaggctggtcttgaaatcctgggctcaagcaatcctcccgccttggcctcccaaagtgctaggattacaggagtgagccacagtgcttgaggcaaatttgcattttccaaccaagtgtcgtagcagagctgactgtattttatttgatgtctaaaacatctcagtttgtgatcccactgcccaacagtaggcatttttgactcaagcattttgcaaataaggagatggccgatggggaattggtggaaaatagaagcagtaagaggcacactgggtagtcccatctctcccttccaagaactgtagatgtgtggctcagctggtgtccttatagacagggagttcgaatatcagttctatctttgaagggctggctggactttgtcatcatctaaattgggcattttattggtgatagctgaactcagaaggagtaaaatactgagttgaggatttgtttcttttcttttctttttttgacaaggtctcactctgttgcccaggctggagtgcagtggcatgatcacagctcactgcagctttgaactcccagtttcaggcagtcctcctgcctcagcctcctgagtagctgagactataggtgtgcatcatcatacctggctaatttttgtactttttgtaaaggtgggctttcaccatgttgcccagactggtctctaactcctgggcttaagtgattcgcctgccttggcctcccaaagtgctgggattacaggtgtgagccactgtacctagctgagcatttgtttcttatgtgacaaaagtgcaagggatacatagacatggatgaaattaaaaaatgtgatgttaagtgaaaaagcaagttttacaaggagaaagtatgattgatagaacgtctataaacagctaaaatgaaaaaacgtatgtgctaaaactatagagaaaggggaagaaatggtaggaagtggtgaggggaaggaggaaggttcgactggggaggcaaacacgaggtagccactcttctgtttcttaaacttggtagtgggcacatgggtactcgcttttattagtattcttttaactctatataagtgcgtgatggattcatttctctatttcctaaatagttcataacaatcttttaaagaactttcaggaaccaaatggaggtttgacccagcagtagcaaagtcttcatgttactatagtagagctggaaattcttaacataaggatacagtatttttcccagttcttggaggagagggtcagagtaaaaagtaaatataaataaataaatcatgggtaaaaagaatctcctcccagtcagcacccaactaaatatggaaactgacttcagttgagacatgaagctgttcttcattcattctagcaaagatattgactgaactatttggaaaacatgtttatcattgtctgaggtgatctgccataagctgctatatggcacactgtgtaagaatgaactttgactgtgatgcacttatgtatatttaaaaaattgctcatcctccctagcatttgtttctaaaacattttgattacttagagtgaaaaattcctttggaaacattttttaaaatgcaaatttaggtcaggtacgggggctcatgcctgtaatcccagctacttaggaggctgaggtgggaggattgcttgaggccaggagttcgaggctgcagtaagctatgattgcaccactgcactccagcccggacaacagagcaagaccttgtttctaaaacagaaaaaagaagcaaatttaaagaaggttttttttattttatgtaataaatgctctctataaaagttctataaagcacatttaaaggtgaatgcttgcctgtaatcccagcactttcagaggccaaggtgggaagattgcttgagcccaggagttcaagaccagcctgggcaatgtagtgagacctcatctctacaaaaaaatgaaaataagcggcagagtgtggtggctcacacctgtaatcccagcactttgggaggctgagctgggtggatcacttgaggccagaaatttgagaccagcctggccaacatggcaaaaccccgtctctactaaaaatacaaaaattagccggcgtggtggcacgtgccagtaatcccagctacttgggaggttgaggcacgagaatcgcttgaacctgggagatagaggttgcagtgagctgagatcacaccactgcactccagtctgggtgacagagcaagattctgtctcataaaaaaaaaataaaaatagccaggtttggtggtgcactcctgtagtcccagctactctggggactgaggtgagaggatcacttgagcccaggaaattgagactgcagtgagctgtgattgtgccactgtactccagcctgggtgacagagccagaccctgcctcaaaaaaaaaaaaaaaaaaaaaaaaaaaaaaaagagtgaatactcagcttttgttgcacgtgggacttgagagagaactgggtaagggtgtcctctttctacttgcttccttttgtcagtagaaccactgtcgtgtcaactatatgagaaatcataccctctcagaacttactctgtgttgatgtttcagtttattaaaaaacataaaacataaacactcttacaaatatttatttatcggaaagagttctggttttcaggttaacaccagcaagtcacaaatccgctgcagtacatctcgttaaagccctgctcgcttcagtctctatgaattcaaattaaagcaagtgattggattttgccatctactgggaatgaatttgtcttatttagtccctaatttgatcatgagaattttataaaatcatgttagagaattacaaaatacctattacattgttcaattcaccacatgtcatggctggcaaaggctcaggtaatttagatgcttgtaattttctaaatggtattacgcttttaaactatacccttgggtccaaatccacattaactaactgacaaaaaattatagataattttatttgaggcaacacaaaagggcagaattgtggcaggcgtaataaaacatcccttaaataaagggatctgagatcccagagcacgggctcaattaagctaactaccactagttaaggacgggtctaaccaccactagtttgtctgccacgagttcaaggctagttcaggaaacaccatctgactgtatagctaggagaccttgcacatgttctgtaggaaggagctcactgagtccttcaggaacatacacactcttggatgagctcacttcatgaccctccccaaatcgcccaaggtgacatgatgctcagtagaaggacctggtgaaagaacaaagagtgtttcacggctctcccttaaatactgtattgagaaataaggaatctctgtgctgctcttttcaggaatcaagcagtgctctccacctgggctgcattttcgagtcacctacagaggctgtaaaaatcctcataccctggatgcacctcagaccaattatatcaaatctctggggtgagagccagccagcagtgttttctaattccccaggtgactctgatgagtgccacggttgagaacgactgtagtagctatttgagaaactgattacttggcagagcaatgcccacaaggaggtgttttgaagttacataaataacactgacaagagataaccttgtcccattatgtattacataatgggaaaaccagaaattgaccacagatttcattgactgattcacttggtgtctaattaatctgtgattacaggcttgtaagttgctaacccggcagtaaacattcagtccatttcagccaattgggggacgggttggaggtagaaaagttgtttgatcattgatgatgcttctatatctaagagaataccattttggcaggggagaggcccttggtgtatgaagttaatcactgtgataggcacccagttgaattctaaaagcattaggcaaagactcaagtgaacgtttaggaagaaagccattatttggtatttataaaatgcagcaggtctggaaatggagcaagataacactccctatagtcaaagtcctttacaataaaagagggtaggatttgatagaagagaaggggtcatgatggattcaaacatctttacatcccccaaacatatatcattggaatgttgagcgtcttcttcattttctactgttgtattaagaatattttcaaacatacagaaaagttgaaagaattggacagtaaaaattcattaattcattgcctccagcaggggttggcaaacttttcctataaaagaaagagagtcaatatattaggccttggaggccaatgggcaagatggagcaactattctcaccagaaagctagtagtcttttttttttttttttttttttttttttttttttttacatactacttttaaaaatgttaaaactacacttggctcgtgggtcatacaaaaataggtagtgggccagatttggaccacagtctgtagtttgtcaacccctgacctaaagttcaactgtcattttgctcttgtaggggcaaacacctttttaggggtttgcggctgggcctgcgaattaaattgacatataagacagatcaacaggagaaaagcatacatgtttatttaatgaattttacatgacatgggagccttcataaggagtgaagacccaaagatgaagttagggttgaatacttatgtgctgaattggacgagtagtaatctatgaaagtgtgacgaggcagaggagcctgggctggggggttagctgggtgaagtggccaggaggatgagggttagtctaacaaggttggttcatgcagatttccctcagcctcaacttcctgtctttgatgataagaatgatgcttccttctagtatcggaagggcatctttcacatgggaatttcatctccagcttttaagaaacaaaatgggccagttgcggtggctcatgcctgtaatcccagcactttgggaggccaaggcgggcggatcacaagatcaggagatggagtccatcctggctaacagggtgaaaccccatctctactaaaagtacaaaaaattagccgggcatgatggcgggtgactgtagtcccagctactcaggaggctgaggcaggagaatggcgtgaacccaggaggcagagcttgcagtgagccgagaccgcaccactgcactccagcctgggcaacagtgcaagactccatctcaaaaaaaaaaaaaaaaaagaaaaagaaacagaatggtcaggtgatgttcttgttcttgtacctgctgtttttcaagagcctttaacccaaaatagtcagtttgccagagtggcatattttggggtggcatattccttttttttttttttttttgaaacaggatcttgctctgtcacccaggctacagtgtagtggcacgatcacggctcactgcagccttgaccttccgggctcaagtgattctcctacctcagcctcccaagtagctaggaccacaggtgcatgtcatcatgccaagctaattttaatttctttttttttttctttgcagagatggggtctctctatgttgcccaggctggttttgaactcctgggctcaagcgatcctcccacctcggcctcccaaagtgctgggattacaggtgtgagccactgtgcccagcctggggtagcatattcttaactacttcactctccttgccttgtcacatagtcagccagctctccatctcttaatctaggatatatttcagagtcaaaagttaacagttaacatcaataggtacatgtctcttctcaacataacaaaaggtaatgtgaacaggataaaatgccataaatcaagtgagaccttgttaatgatttattcagtcctctttaggatcttttggtactctaggactccttacgatttaccatgcattgagtttttaatatttcagttaatataaaattatagttaaatcaaaaatgaaaatggtttctgttccatgctattgagtgaatctaaactttgaacgtgtctctcagaggaattatagctcttttcctagccatggattgaaggagttcattccctcttgttctccatcctctgtttcagataaagaccattttgagcggctttatcatcaggggctacttggggaagtggaccctgctaatcaagacagtcacgctggtgctggtagtgtcctccggtctgagccttgggaaggaagggccgctagtgcacgtggcttgttgctgtggcaacttcttcagcagccttttctccaagtacagcaagaatgagggcaagaggcgggaggtgagccagctcagcttccatctgcagcgaaactttcttctcaaagccccctcctgctgtctgacttgcaggtttgcacgtttgttttcatggaaggccttgaagcttatgtagaactatttgttttgtaggtgctttcagctgcagcggctgctggagtctctgttgcctttggtgcaccaattggaggcgtgcttttcagtctagaagaggtgagaatgggcagctgagggaattcgtgattttgagcagcaaggcccgttgagggttagaatcaaagaagtattggataagattccggcagttaattaaggagccacaatttccactgttttttttttgttttgtttttgtttttgtttttgttttttttgagactgagtctcactctgtcacccaggctgcagtgcaatggcgcaatcttggctcactacaacctccgcttcccgggttgaagcaattctcctgtcccagcctcctgagtagctgggactataggtgcacgccaccacgcctggctcatttttgtgtttttagtagagatgggggtttcaccatattggtcaggctggtcttgaactcctgacctcaggtgatccacctgcctcggcctcccaaagtactgggattacaggcgtgagccacaatacccggccaccagcgataaattcctgttttcaagtattgtttcaaaaattgccaaggtgattttttaaaaagatttacagtattctccctctcataaccaacttaattaagcatttttgattttggtaacccaaacgggttattccaggggttggcaaacgtttctgtaaaaggccaggtagtaaatgtttttggttttgtgggccatgcaatttctgttgtagctgctcagctctgctgtcatagcatgaaagcagctgtgaacaatacgtacacaaatgggcatgtctgcatttccatagatgtttccttatgggcactgaaatttgaattttatggttttcacatgtcacaaaatattgttcttcttttgaatatttcaaatcaaaagattttttcacctttttcaatcaattaaaaatgtaaaaaccattcttaactcatgtgccatacaaatgcattcactgggctgcacgtgacttgcagcccagagttttccaaaccctgatctactctgttttctgtagaatccaatccagaggtttatttgcttctaggggagtctctgtgccatgaacagaattatgattaaatacttttctcttaaaaatatagcccaaacccaccttgattagtgtccattccacttctagacatagttagattcctccaggtatctttgctgatgcgttttggtcacattaagtccaggctcatggaatgagtgtgtccactcttggacttagagtgtgactttcctgccaaccagagggcttggctctgagcagctctttctccggccagtctttaattttccactttttcatctcaggtcagttactactttcccctgaagaccttgtggaggtcatttttcgcagccctggtggcggcctttacgctgagatccatcaatccctttgggaatagccgtctcgttctcttttatgtggaataccacacgccctggtacatggctgaactcttccccttcatcctgcttggggtcttcgggggcttgtggggaaccctcttcatccgctgcaacatcgcctggtgcaggaggcgcaagaccaccaggctggggaagtacccggtgctggaggtcattgtggtgactgccatcactgccatcattgcctaccccaatccctacacacgccagagcaccagcgagctcatttctgagctgttcaatgactgtggagcccttgagtcttcccagctctgtgactacatcaatgaccccaacatgactcggcctgtggatgacattccagaccggccggctggtgtcggtgtttacacggccatgtggcagctggccctggcactgatcttcaaaatcgtcgttaccatatttacctttggcatgaaggtaagtgaaagggaaggaagatggggtggggacccatgtccttctggggacagcaccctactctctaaaataaaattgcggtgggaaaaaaaggggaactggcctttcttgaatgttctcatgtgccaggcacttgacattcctttaatcaataggaaataacttctaataaacaataagcttatgaaatagagattttaatcccattttacaactgaggaaactaaggctctgagatcttaagtggcttgatcagacccacagcttatgggagacagagctaggcatcaaacccacttcacacattcccagaacaggtggtggtgaccacaggtttcctgccgctggccaggtgatgccaggtggtggaaaaagcccaggtttggctcagtttggctcattaaacatgcattgagtatcagctgtatcttaggcatcgtgctaagtctgagggatacagaacccaaacagaaagctgcccttgcagagcacacagctctgggagaaagagatgcagacctggagttctgacattgtgatgagcaccacgctggtatgacgggagcacagagtgagtgtgtcccccgtctgggtagggctgggcatgacaggggctctttgcacacatcctctttgaagaacagagctgtggatgacagcacatgctttcttttcctcctccctccctccctccctccctcccttccttcccttccttcccttctcttccctccccttcccttcccttttcccttttccctttcctcttccccctttcccctttcccccttcccttcctttcgtcttgttcccaggctggaatacagtggcatgatcacagctcactgcagcctcaacctcctgggctcaaatgatcctcccatctcagcctcccaagtagctgggatcataggcgtgaaccaccacacttggtgatttaaaaaaattttttgtacagatgaggctcttgctgtgttgccctggctggtcccaaactcccaggctccagtgatcctcctgcctcagcctcccaaagtgctgggatcataggcatgagccaccacaccacacccaacagcacatgccttcattactcttgttcctaaagccagagaagagacagctggtttcctctttcattgtgttaaaatcatttgttaaaatcattatgttaaaatactttaaaagcccctcctaaagaactttcttttatggaacctgggattttgttattatagctttttttttttttttgaaatgaggtaaaacccataaaacataaatgatcattttaaagtatacagttcagtggcattacatacattcacaatattgtgcaattaacacctgtatttagctttagaacattttcatcccccaaacggaaatcccatctccattaacagtcattccccatttttccctcctgcagccccggcaaccactaatctgtctctagattcgcctattttggacacttcatataaatgatatcatataatatgtggcctttggtgactggcttttttcgtttagtgcaatgttttcaaggttcattcacattgtagcatgtgtcactacttcatttttatggctgaatagtattccattctatggagatcccacattttgtttatccactcatcctttgatggacatttgtgttgtttccaccttttggctattatgaataatgctatcattacttacttaaagaaacttttattagagtatatcgttcatatagagaagtgtacagcttgatggagtttcataaaacacacacacacacctgtgtaaccagcacccaggaccagaagcagaacattatccacctcccagagcccccttttgtgttccattactattgctttctgtgtggcatttctatgaattgtcttttaattttatttatttttattaaaaatataaaatagagaccaagctccctatgtttcccaggctggtcttaaacccctgagctccagtgatcctcctgctttggcctcccaaagtgctaggattacacacatgcgccattgtgccctgcctgaattgtcttttttttttttttttttttttggagacagggtctcactctgttgtccaggctggagtgcagtggcacaatcatgggtcactgcagcctcgaccttctgggctcaagtgatcctcctgcctcagcccactgggactacagacacgtgccaccatgcccagctgatttttgtattttttgtagagatggggtcttgccatgttgaccaggctggtctggaactcctgggctcaagtgatccgcctgccttggcctcccaaagcgttagaattacaggcgtgagccatcacacccagcctgaattgtcttttttttttttttttttaaatttaatggtcgggcatggtggctcatgcctgtaatccaagcactttgggaggccaaggtgggtggatcacttgaggtcaggagttcaagaccagcctggctaatatagtgaaaccccatttcttctaaaaatacaaaaattagctgggcgtggtgacacacgcctgtggtcccagctactcgggaggctgaggcataagaatcacttgaacgcaggaggcagaggctgcagtgagctgagatcacgccactgcacacgggcctgggcgacagagcgagattccgtctcaaaaaaaaaaaaaaaaaaaaaaagaaaaaaattctaagaagttgtttacttgagtgtgtcatagtggtcaaatacaaacctgaatttgggccttaagaacaaggatgagtaggccttattaaacagctggctgtctctgatctgtcatctcctagcaaagggatttgttttcatgtctcaggaagatgctggtaacattttatgatgcttgctgagaaaagtctcctttgatgttacagggatataaatgatgtagaataaggggaagctcagaaaggaatgatttcctaaggagtattctgactctagaaatcacacccaaggatccaaacttcacttgaattaggttaaagttctgcttccatcctcagatgggtaaccacctggggctggctggcatcattgcagctgctgcccatggtcagcggtcacgtgtcatttcagcgaacacagggagtcaggcttgttctatagtacatgtgtggtcattagataaactaaaatgtatcttcatccagcagggtagagaacacgctggtaccaagatctcttagtttacattctatttctttgctgcccctatcctggcttgaaaatattcagaatacttattagaaaatgtacttcattaggaagagggaattgcctccctcgtctctctctgacaggtattcagctaccacctactagagagggcagggagccattgaagtgctttctggaagatccagggtggctgcaatgatggacttagcttctttattttacctgggagcagtcgcaggcccttcttttccattttcatgctgtggcttgacatttaattttaaaagccattctgaatgacatggcaaggggcgagagaaagtggtgtctcaactgacagatgctcactttgaatgttatttgcagtggggcttatcattctttaatccacagcaggcaaacccagccagcttttgaaggagagggaatcaaagtataaaattgcgtcctctctaagttgcagtagatatgactgactaggcaggtcaaattatttgtcccacctttccccagctgacctattttgcagagttgcacctcctctgaagactgaagctaaatgcaagcccgtcgagggggaatgtgtttcttgggggtcgtgaagcggggacttggtctttttccctcatgttgcttttctctgtgtctcctcaagatcccgtcgggcctcttcatccccagcatggctgtgggcgcgatagcgggcaggatggtgggaattggcgtggagcagctggcctaccatcaccatgactggatcatcttcaggaactggtgcagacccggtgcagactgtgtcacgccagggctgtacgcaatggtgggagctgcggcctgcctcggtacgaccatgggtggggcagggagggggaccggggaactaatctggcttagaggactgccaagaaggaagacatggacttgaacattttctttactcaggataggctgggttgtgtggctataacaagtaaacccctaaatcacaatggcttaacgcaccaaggctatgtctcgctcactatgcagacacacacacacacacacaaacagatgccctcaacttatgatggggttaacatcctgataaatgcatcataaactgaaaatattataagttgaaaatgcattgaatacacctaacctaccaaacgttgtagcttagcttagcctaccttaaacatgttcagaacacttacatttgcctacatctgggcacaatcatctaacacaaagcctattttataatgaagttgaatatctcttgtaatttattgaatattgtactggaagtgagaaacagatggttgcctgtgtacttgaggcatggtttctactgaatgcctgttgcttttgtaccacggaaagtggcaaaattgtaagttaaaccatcgtaagtcagggactgtctgtaaataaaaatcttggtttagcagaaggcgcttctccacctaatcattcaggggcacaaaggtgggtctgtcccctgtctatagtccttaagaatttctgtgatattctgtttatggggttcttgaagagcaccatgcttgcttagtcagaagcttgcagagcccatgtaggatccactcaccaaaaagcttgtgtgggccacggtgaatagacaacccgggatccgtcattggagcagaggccccagtgagatgcaacttcaggctccccaacgcaaagccacatttgacagggcctggcctgggttccagaggcccagtgtaggaagcatgtaggagagtctgcttggaacaggtgtgaggggaatttacagcctgtctgtcattttccccaaatcatgcttccgtgagctgcccggcttgcactttggaatcttactcctcccctctgttgcaggtggagttaccaggatgacggtgtcattggtggtcatcatgtttgaattaaccgggggtctggagtacatcgtgcccctgatggcggcggctgtgaccagcaagtgggtagctgatgcatttgggaaagaaggcatctacgaggcccacatccacttaaatgggtaccctttccttgacgtgaaggacgagtttactcaccgcacactggccaccgacgtcatgcggccccggcggggagagccgccactgtcggtgctcacccaggacagcatgactgtcgaggacgtggagacgctcatcaaggagaccgactacaacggcttccccgtggtggtctccagagactccgagcgcctcattggatttgcccagaggagggaactgattctcgcaataagtgagtaaagagagggaagctcacattttaccaagagccgaatggcatcctttgtacccctaacattatccaagatttttgaggtgatgtgcattaagccaggggctctcaagctttcacatgtctctgggtcacccaggggtctggctcaaaagcagattctgattgagcaggtcttgggtgggatccgatactacatccctcacaagttccccattaacgccgatattgctggtccccacgtcacactgtaaggaaaaaggctttaaacccaagtcttgggtagacattcttggttgcaaagtgactgcatgtttgcaagcagccccctggccctgctccgctgctgcctttcagcaattgttggctaaagctgagaaggaagagaggcgacagcctggagtggcccgggctgagctgtctcagagactttcaggtgtaccaaccatccggctgagatcacgagttctctgccccagacaccccttgccaccacacaagtcttttgcttcactttgtgatatgatgtcagattccacagttagaggcccttgtgggtaaatgtgcagacatcgctgaaaccaattgcgtgagatgattttcctcttgtgtttgaatgacaatcagctgcactgaggggcaggctgttgagttgggggaggggagtatgggatgatgcccaggtcagggtgtcccaacgacaggtggatcagagaagcaagcccatgggccccatcagccgagggatggctccaacagaagggtaaacaggaggtaggagaattcctaagacagaggggcctagggctgcgggctgagggccagaggtctggttgtgagttgctgggaccccaggcaaggagaagctgtgagccttggaggggtagagtcctgctgggcctcaaggtggcaggggcaaggaccagcatagcacatccacgggcacgctcaccatccttgctctgtgatctgtacaacattccagcatctcatgatagaccagggcccatggcgtggctcccatgtgcacacgacagttttactatatatcttctagagtattcttgaagcttgtcaatgggactttccctggtctgatgttggaatggcccactgttaatacatctccaccaggcaactgcttacttctctccctgtcctttgtttcctgtttccaaggcacctcccttaaacctcttcccagtgttacatagctttaaaatatctttaaggcatcttcatcaaaggctttataacaataagttgagataagctatcctctcccattttagcttgacactcaaacatttttacctcccccaaagtaaaaattgattttgtattttagacaccgtagcaagtttgtgcttaagtgttcggcgatgcttctccttattataggtcctgttgcttaacgggtaggtaggtgcctttgtgtaaatattgccttataaataatgaggtttttttaaggttaagtaggattgggtttgtttaaaaatactgtaatcagcagcctttaaaaattttttcattccctaggatcttttaagcaaaggttgaaatttaaaaactaaggtaataaatgtcacagaatctattatctattgtatagctccaggcacacctgctaagaggcagcttactaattttgctgaaacccattactgtaatcaagtgggaagcagtaattgtcatcaaccagttagagaagaaatttaagcttaccaaccaagtactcttctcgaagctatgtttggaatgtctgaagaggcaccacacggtgtaaatactacctatatgctttcaatcagaccgataataatatagaaggtgctatttacatggtttgtgcagagggaaggagtgttttgctctgaggaatcagaaaagctgtttttctggcctgtggaaatagaagagcccctgtactctggtggagaaatacaggtgcatgacctgtatttgaggaatcttgtgccattttatgagtatagaaatatgacagcatttagctagacactatcccatgccaatttcacttcctagaggaattgggagcaaagattatagacagatccaagatagtatggatcagaaaagaaaggtaagtgaggtaaataaggatttttcttacatatcatgtttaaaaattgtagcaactgctcacatgaagctgaaaatgttttgttatgttttggaatgccaaagcatggcgttatctttgttagagagcacgtcgttagcaccacctaggcaacgtgactctcttcaccatcacatactagcacacggggctgtatgcgactcttgctcaagttcctggcaaatgggcctttacctctcattgctctgcaaatatgaggactcgcctgtacttagcagggctcaggtgcttcttgtcttgagttctgcagttaagtagaggttcaaagaggactcagcggggagttgcagagatgattaaagggtggaaagttagagtttcagggaagagttaaggaaactctcaggtttttttggtctggtggatgatttattaggctggtacaaaagtagttgcggtttttgccgttactttcaatggcaagaaccgcaattacttttgcaccaacctaatgattctccagcatgtggaagacgcttagttgcagaaaggggtctacatccagcactgaacaagaagctaagtgtcaggtctgtcagacaagggagaaagaggtttctgcccgggagggctgttagttactggactaggtcatggagaatagtggtgtcatctacacctttctgttggggatgtgtgtgtgtgtgtgtgtatatatatatatatatatatacacacacacacatagagggacttctccatgctttagtagacagacaataacttgtaaaacaatctgctttttcttctgtataatctttacttttttatcatatcatctttgtactacttctgtggttgctttcaattttccattttaacctatctcattaattatatctgtcttatggacgcatttaaaaaaattttttgagacagggtctcgctgtttcacccaggctggagtgcagtggcgcgatcatagctcactgcagcctctacccactgggctcaagcagtcttcctgcttcagcctccggagaagctaggactacaggcttgcaccaccatgcctggctaagcatttttaattaacaggatgatagactattacttccctaaaaacacagttcaagtgggagtactcctcctcagcactgctgacatttggggcttgatgattctctgtgctggggctgtcttgtgcactcttgggtgctgagcagcatcccagggctccacccactggatgtcagcagcacttgccctctcctattgtgataaccaaaaatgtctttagacattgccaaatgtcccctgagggtggaggcagaattgctcccagttgagaaccattgctctaaagccactcaatagcctaatgaatatgtgattatttccaattttgaaaaatttcttggcctatcacatagtttgtgaaatttctcttacccatactttattatttaccatctctacatctggcatatgaacatattgcttctaggaaatggaatgttgagtaaccttagcaggtgctcataaaatatacattccttcatttttttttttttttcactaagtcttgctctgtttcccaggctggagtgcagtggcgacatctcggctcaccccagcctccacctcccagattcaagcaattctcctgcctcagcctcccgagtagatgggactacaggcgcatgccaccaggcgtggctaatttttgtatttttagtagggacggagcttcaccatgttggtcaggctggtctcgaactcctgatcttaagtgatccgcccacctcagcctcccaaagtgctgggattacaggcatgagccactgtgcctggcctaaaatgtacattcttttttaagagctgtggccactgagactcattctagtagaatatatgacaaacctcctacattaaagacagttttaaaaacagtttaactatttttaaaacatttaaaaatgaagtttattacattttttcaaaatgaaagtaatacacactccaaatattggggaaatcagaagaaaaaggaaacatttaaaaagccacctacattcttatcaccaaagaagacatgattgatatttagtgcatttcctttttgtcttttaggtcttttaaaaagatgcattttcggttgtattgttttggtttctttttcaacacagactcccaagtgttcctagggtctgtgggtctcttttcttgtagcactggctcatcccctgggtgaggagttagttggtttatcctttcacacaggaaatatttcttaagtgtccaccatgtgctgataccatcctagaagctcagagtccagggatgacagcacactgcctctgccctctgtgaacttacatgcaggcattttggtgtctgatgatttctggtccaaactgagagcagatgtttcaccctggtagagaattgcaaagagctttcttgctggttgttcttccattcacaggcttttgcctgttcttagcacctctacccacaaagtttgaagcctcctgtaagtctgtaatagagttccaaagtggcctagcagaacctttctgaggagagtagcagttgccactgtgggaacagcaaggtgcatagctcaggcttctggctctgaccctagctgatgcctatatttttgcttggcagtaaataccttgtgtgctttccttcctgatgcctcctatgtgagataggttcagttttatgtggcaggcagaaccagatacactgacatttagtagacctactcatccgttcattcatatgtgcatttggcaaatatctgttttgtgtctactgtgtgttaggcattgtccaggcactgggagtgcactggtgagcaagagttcattgagctagtggctgttagaatcagggcttctaacccaatcagtaggttcaaaggagatataagcatgttatttattttattgtagcaagtggatcgaccatttattaaattgtatttggttttagaaggggttcagcaaatccatgtcatcaactcttgattggggtttgcaacttgatccaatcctgacattcactcagtggttgaaattgatggaaatcctgttagtgggactttaagagaatcggctggtctatgggaatgagcaaataagtgtgtgttgccagttgcctccctgccttagtgggtaaggacagaatcatcttggtttaggagagaagtacgtagtatatatcgaacagtctacatttgaaaacgcgttgtgcctcagagtcgtctggtatttgtggcagaatcataccccatttgatgtaacttgatttaacctgacccatgtaatgtgaaggcatttgcccagcaggccctctgttcctcttttaaacagagaccctttttcagactcagcctgaccccagatgctgccagttttccattagagtactctattgcactaaatggccttagaggaggcagttagaattttatttttgaaagaacaatataggtgaatagtagtctttgagaaggtaagaagtgtattatgggaaccaggatccattttaaagcaagccttgctgtacattttccctaaccttttcccatgaaccaaaagaaagattaaaattccaacagaaggaaaatcgccttggagaaatatcttgagaccgatggatttatttcatgtgtggcttaaaatagcctgggtttctagcaccgcgttaagctgtatttctaatgagttcctgttaccctacttttcttcagctttctttcacatggccttttctatagacagaaataggctaattgctaccataacagttttactatctttctttgagggatccacaaaatggcccatttttaagacaggagatccgaagggttgaggggggatgcagcttttctggggttgtttctttggacccaagggtcgcgtttgggattgagctgcatttctgggctgtgagcctgggctggccgtattggtttcttgttcctcccaggattcataatgccatttgggccagttataagttagttcgtaaaaagaaaaacaatgtattaaggtcatcgggcagctaagtaagtttcttgtcacctcaaactccagcccatgatgaggtgaaggagcgtaaggaaagccagagtggagggccctgggctgtttggggtgcccggagtctgcggtgaagcagtgaatgtccccaaaggggccatctgggtcaggcccatcttgccagactttggcaacaaatgatccggtcacagcaggggaccctcacacagcattagctgcagagagatgccaattccacagatgtttggctaaagccccttattaagaatgtgtggttcatcctccaaaccccttttctgtgggattctagatggtgtgtgtgagtgtggggtggggaattgctcagcaaggggtttttgtgtggctcattgttcctgctcaccccattctagagaacgccagacagaggcaggagggcattgtgagcaattccatcatgtacttcacggaggaaccccccgagctgccggccaacagcccacatcccctgaagctgcggcgcatcctgaacctcagcccgtttacagtgacagaccacactccgatggaaacggtggtggatatcttccggaaactggggcttcggcagtgcctggtgacgcggagcgggtgagtagccggacatgtggccagaatgacctagggagaaaaagatgagtgagacatggtctcagccctgaagaatgtggagggccatggggtggaatagtccttgacagagaatggcagtaagctgtggtgaatgtgttgaggaggaaatgtacagggagcttgggactgagggctgggcagccgtgcagccagagaagggggtggtccaggctggactgctgcctgggctgagggaggttgagtaaaaaggggtggagccacaggagaagggcttggtgttgcttttctaccaccccatgtgacacttggcttagggaggaggttctgctataacgtgatgtatgcggtcctcaaaatcacagcactacgcaaaaagtgctccatgcaaaccacaggacttgtgggaaaaatggggttaggtacacaacagtcaaaaacttcatcagtgatatatgacataaaagaggtggaagcctaataagaatggtagtaccgagccaggtgcagtgagtggctcgtgcctgtaatctcagcacttcgggaggctgaggtggaggatcacttgagcccaggagttcgagaccagcctgggtcgcaagaccctatctctacagataaatttttataaaatcagccaagtgtgcccatagtcccagctacttgggaggctgagacaggagcatcacttgagcccaggcttccaaggctgcagtggcccaggattgcaccactgcactccagccttggcagcagaatgagaccctgtcttgtaaaaagaatagtggtagtaccatgttacacattagttaaatggttaagaaatacagggatacaacagaaatatgtcacttcatcttaaaaaggcctgaagttggctgtggggtgggtttcacaagctgtgccacttccgaattaccgggaaggggtggaaggaggggagcctgaactcaaggggaagtggtcacagcaggtgtggatgggcatggctcttcacgcatgcatgaactgaggtcgcttgtggatgtttgggggccgggcatgtgcattttgtgtatgccgatcccactgggttcagctgggtacagtttcctgcatttgcctagagcttctcatggatgaaatcacacataagcaaaggtaaaattcatattatgctcagattgttcctgatatatcaatttgtttgaaacaactttgttttcgaaacaaacatgattggagaatggagagatttgatggccccatggcattgtccctgctgccacttttgttttgtgttgtcacaaatcaggaaaccaacaatgcaaagatcgagggtccactgtagtagcaccagagaagcagttccttaaaggtcattccttggcctctgagtgtcacaagttccatggtgtcagaagcttgtgtaagggaaggggtcggcttggtcagggtagcctggaacctagggttatctgcccattttattcctttatgggctgggagtaggaggcggggaatgggttctggagacattggtacctaataaagtttaggcctttatagactccagaggctcaactatctaatatagcttatatttccagagccagcacactctagtttaacacagcagttctcaactgggatgattttacctcccagagacattgggcaatgtctggagacaatttggggtgtcatgactggagggagggatgctattggcatctagtgagtagaggtcaggggcgctgctaaacatcctgcagtgaacaggacagctccacaacaaaacatctggcccaaaatgtcactagtcgtgcagttgagtgaccttggactggatgtgcctgtatagccaaatgagcaatcctattcattccactttcttcctgctgtcctggtagcaagcacacagggggacaggctttgcaatttgcagatttacccagagaactcctggccagcagagtgagcatcctccttagctctgactacagacagagcagtgtcttgcatgtgggaggtgcaatcaatagggaaaaataaatgagtccttgtgtttgacaaggctagggatcatttctgctgatgaattttaaaggagctcaagtggtttttcaaacttgagtgtggatcaaaataccctggaggattaaacctccaggttaaatccagatttctgggccctgccacagaggtactgatccctggaagtctagggtgaggcccaagaatattctttcctaacaagctcccaggtgatgctgcaactgccggtctggggaccccaccttgagaaccactgaagtcgatttatgcacttgagtttccagtactcttggtataaacaccactgtgattgcccatgctgtctcaagtgtgtagcagtttctcctttcctttaaaacaataatccaaagtcaattatcgttggaatttcagctcaggcaggaaactctgcccttaatgcccgctcacacctcatagagccccatgaggtcttcctgtgaagatctgggtgccgaaattggctctgaatgtgcttcaagaaagcaaaatcgcactctctctcgctctacatcttttacacaaacacagatgctgctgcgttagtgctggcaagggatgcttgtctgcggggcctttcatctccttgggcttcttgccagggcaggcacgtctctggccagctctcatgtttgatgtgctcgcccaccctgtaccttccctgctcgggatggccacgagcctgagctccaccgctggcctggatcacctgcagcatttctcaggcctggggttcaaggggcatcataaaactggaccaggaatcggaatgccgcaatctaggaagcctccagttgctaagagtgaatttgggtgagattttccctatgaaagttctagaaaggaaaagtgagtaagggagatggtgtcagattttccccaagccctgctaggtggtccacaggggcctggacaggatagctttcgcagaagagcccagctgctcgaatttgaattatgtccttggtcatagatctggccatttataattcgctgaattcgcttcaactgctactcaaaggggctggaagttcaaacacttgatttaaatcaaataggacatttcatgccactaacgaagcctgctggatttgatgttacctccttctgggttgatgttcagctttcttcttttgtgataattaccatcgcgggccagggcacaatttatgcacgaacccaaggcagctcctgaattcatatttccctagtgctgttataatcaacttaacttttagacattacagtcacagagctttaaaaggaggttttcagaactgcaaatgcttgatcttttgatactgtctccagggtgaagacaaggaaacaaaaaccaggatttatagatatgggagggttccgtgtgtgtgtgtgtgtgtgtgtgtgtgtgtgtgtgtgtgtatgtgagtgtgtgtgtgttatagttatcatcactttgcaaacactaacaagtcttatttttttcaaagcaacattggtttaatcaacattatattgagcatctattttagctgggaactgtagggggcacaaaaagtgtttaaaaaaaaaaaagccaaggagcttgttatctactaaagaacatggacataatccagtttaagtggtgctacccaaggcaggcgctccggggggactgttctgttttttcttttttaatttaatttaatttaaagttccgggatacatgtgcaggaagtgcagtcttgctacataggtaaacgtgtgccatggtggtttcctgcacctaccaacccatcacctaggtaggtagccccatatgcattagctatttatcctgatgctctccctccccacatccacgacaggccccagtatgtgctgttcctctccctgtgtccatgtgttctcattgttcagctcccacttgtaagtgagaacatacagtgtttggttttctgttcctgtgttattttgctcaggataatggcttccagctccatccatgtccctgcaaaggacatgatctcattcctttttatggctgcatcgtattccatggtatatatgtgccacattttctttatccagtctatcactgatgagcatttgggttggttccatgtctttgctattgtgaatggtgctgcagcgaacatacgtgtgtatgtatttttataatagagtgatttatattcctttgggtatatactcagtaatgggattgctgggtcaaatggtatttctggttctaggtctttggggaatcgccacactgtcctccataatggttgaactaatttacattcccaccaacagtgtaaaagcattcctgtttctccacactcttgctccacaccagcatctgttgtttcttgactttaataattgccattctgactgatgtgagatggcatctcattgtgggtttgatttgcatttccctaatgatcagtgatgtggagctttttctcatatgtttgttggctatataaatgtcttcttttgagaagtgtctgttcatgtcctttgcccactttttgatggggttgtttttttcttgtaaatttgtttaagttccttgtagattctgcatattagacctctgtcagatggatagattgcaaaatttctcccattctgtaggttgtccgttcactctgatgatagtttcttttgctgtgcagaagctctttagtttaattagatcccatttgtcaacttttgcttttgttgcaattgcttttgaggttttcgttatgaaatctttgcccatgactatgtcctgaatggtattgcctagattttttttctaggctttttatcgttttgggttttacatttaaatctttaatctatcttgagttaatttttgtgtaaggtataaggaaggggttcagtttcaattttctgcatatagctaaccaattctcccagcatcatttattaaatagggagtcctttccccattgattgttagctttgtcaaagatcaggtggttgtagatatgtggtcttatttttgagatctctattctgttccattgatctatgtaccagtactgtactgttttggatactgtggccatgtagtatagtttgaagttgggtggcatgatgcctccagctttgttctttttgcttaggattttctgggctatatggactctccacctcaaaacaacagaatatacattcttcttggcgccacatgacacttactctaaaatcaatcacataattggaagtgaaacactcctcagcaaatgcaaaacaactgaaatcataacaagcggtctctcagaccacagtgcaatcagattagaactcaagattaagaaactcactcaaaaccaccacacaactacatggaaattgaacaacctgctcctgaatgactcctgggtaaataataaaattaaggcagaactcaagaaattctttgaaaccaatgagaacaaagagacaacataccagaatctcttggacacagctacagcagtgttaagagggaaatttatagcactaaatgcccatatcaaaaagctagaaagatctcaagtcaacaccctaacatcataactaaaagaactagagaaccaagagcagacaaaccccaaagctagcagaagacaagaaataagcaagatcagagcagaactgaaggagacagagatacaaaaaacccttcgaaaaatcaacaaacccaacaaatccaggagttgtttttttgaaaaaattaataaaatagactgctagctagagtaataaagaagaaaagagagaagaatcgaatagacacaacaaaaaatgatacaggggatatcatcactgaccccacaggaatacaaacaaccatcagagaatactgtatcacctctatgtaaataaactagaaaatctagaagaaatagataaattcctggatgcatacaccctcccaagactgaaccaggaagaagttgaacccctgaatagaccaagttctgaaattgaggcagtaataaatagcctaccaaccaaaaaaatcccaggaccagacagatttacagctgaattctttgtaccagaggtacaaagaggaactggtaccatttcttcagaaactattccaaacaattgaaaaggagggactcctcccgaactcattttatgaggccagcatcatcctgataccaaaacctggcagagatacaacaaaaaaagaaaacttcaggccaatatccctaatgaacattgatgcaaaaatcctcaataaaaaaaaataatggcaaactgaacccggcagcatatcaaaaggcttattcaccacgatcaagtcagcttcatccctggggtgcaaggctggttcaacatacacaaatcaataaacgtaattcatcacacaagcagaatgaaagacaaaaaccacatggttatctcaatagatgcagaaaaggccttcgataaaaataacatcccttcatgttaaaaactctcaataaactaggtattgatggaacatacctcaaaataataagagccatttatgacaaacccacagccaatatcatactgagtgggcaaaacctggaagcattccccttgaaaaccagcacaaaacaaagatgctctctctcaccattcctatttaacatattgtacaattcacccatttaaaatgcatgattcagtggtttttagtagaaaatgggttgtgcattaatcaccacaattttagatcattttcatcaccccaaaaagaaaccccacaccccttagctgttacctcctataccacagtccttggcaaccactactctatattttctgtctctgtggacttgcctattctggacatttcatgtcaatacagtcatgcactatgtggccttttgtatttggcttctttcactgagcatcatgttttcaaggttcgtccacactgaagatgtgtctgtacttctttccttgttagggctgaatcatcttgcattgtgtggatagaccacattttgctgatcaattcattagttgatggacatttggtttccctttttttcttttttttaaattatttttaatttttgtgggtacataggagtatatatttatgggtatatggtatattttgatacaggcatgtaatgcataataatcatatcagggtaaatggggtctcccagcacctcaagcatttatccttcgggttacaaacattccaattcttttagttatttttaaatgtacagttaaattattgattgtagtcaccctgttgcactatcaaatactagatcgtattcattcttttaaactattttttgtacccattaaccatcctccatcccctcctcccccctcccccattccccttagttttcaaatgaggaggtgagactctaagaagcaaaacactgctcagggttaaagggaattggttgcagagccagtcccatctggattcttccaggtctcctatctcctgaggcacaatcagctgccaggtaccgggaggacctttgatggagaaccctgccagccgaccctgacccttgaggacatcaatcccctccgtacagcaccctctgggaccaacgacagtggggagtagacctgggcgtgatgggaagatatgtggcagcatccttaagtatccagattcctggaatggctgcattttgggatacctgttcagtaaaatacagaggatatggggccaggtaacgggattcctgtgtcccatgctgacggtgtattatagattcacccacagaggtctatttgtgtctgaaagcttctggctgggagtaatagtcaaagtgtttaagagctggtgccagataatgaactgatttgttatgaattgtggggagttcactgcagttctataaggtatgaggttggcagggtacatcccagggtgtctagctcagtggctataaaccaaccggtgtagaactattttagtactttttaatctggatggtggttctcaaccaggggctatcttgtcccccctccacaggagacatttggcattgtctggagacattttggttgccataatgggggatggggatgctgctgcatctagtgggtagaggcccaggatgctgctgtatgttctacagtgcacagaatggcctatctgcaacaaataattagccaacctaaatgtcactagtgccaaggtggagaaaccctgcgtaaagccttcccaggtggagggctggatgggtggaaggagtcctattggcccagcttgcattttgctgctaccgcatgggagggggcctcactggggattcctatctgcctgtaaatagaggcccttcccagtaacaaagccgcctttcctagctgtcactgctttcttgaaattaattagaattatcagagctagaacaaaatttcctgactctgggaggaaaccttgtttaaaaacatttatttaaatttttgtgggtacatagtagatgtgtatatttatggaacacatgagatttttaaaatatatatatatatatattttattatactttaagttctagggtacatgtgcacaacgtgcaggtttgttacatatgtatacatgtgccatgttggtgtgctgcacccattaactcatcatttacattaggtatatctcctaatgctatccctcccccgtccccccaccccactacaggccccggtgtgtgatgttccccttcctgtgtccatgtgttctcattgttcaattcccacctatgagtgagaacatgcggtgtttgtttttttgtccttgtgatagtttgctcagaatgatggtttccagcttcatccatgtccctacaaaggacatgaactcatccttttttatggctgcatagtattccatagtgtatatgtgccacattttcttaatctagtctatcattgttggacatttgggttggttccaagtctttgctattgtgaatagtgctgcaataaacatacatgtgcatgtgtctttatagcagcatgatttatattcctttgggtatggaacacatgagatgttttgatactggcatgcaatgcataataatcacatcatagagaatggggcatccaccccctcaagcatttaccctttgtgttacaaactatccagctgtactcttttcatacacctgtttgctatttgtatgtcttcttttgagaaatgtctatccaaatattttgcccgtttttttgatcagattattagatttttccctatagagttgtttgagctccttatatattctgcttattaatcccttgtcagatgggtagtttgctagtgttttctcccattctgtgggttgtctcttcactttgttgattgggaaacctttatttcttatgtgggcctctggctctgacatgcctcaagtctggaggcctggactgctcttctcagcagcaatacatggctgccaaagcaaaagggcaactctaatgagaccggggcccactaaagcttttgcaaccgtagaagcagggtgatttggcgaagtattgggtaacagtgcccttgagaaaatgtgtatctctggttgattgattgcaatgggccctcattatgacagttgagcccgaagcagctaaaacaaatcaggatggaaagaaatggtttcaggctctgccagctggacccagcaaccttcctgtgtgaggagaccagagcccttgttgggccttgaatctgtcaactgtgttcatactcacagatgggttttcccaggagaactcagcatctcaccgcaaagaagagtgctaacatttgtttcctttaggtagctcttgtttcaggattataacaacatttaggcttacagaacaattgagcaaaatatgcagagttctcatatatccccttcactcccctcagtttcccctattgtcaatatcttgcattactgttgtatttgttgtaattgatgaaccaatatcaatacattattattaactaacatccatagtttactttagagtgtactctgtgtcatatatttctgtggattttgacaaatatataatatcatgtgtccaccattacaggatgatacagagtagtttcactgccctaaaaatcccctgtgctctgcctatttatccctctcttccacccaccaaaccctgacaaccactgatctttttactgtctccatagtttagccttttccagaatgttgcatattatgtagttggaatcattcagtatgtagccttttcagactggcttctttcactcagcaatacacattttgatttttctccacgtcttttcatgacttgatagcacttttgtttttattgctgaagaatatccattgtctggatatgccatggttcagtttatccagtcacctactaaagaaaatgttggttgcttccaggttttggcaattatgaatgaagcagacgtcttctaagacgttttctttacataactaccaaaccatgatgatgtaaaattaacagtaactcaatatatcatccaatatccagttgatattcattcaaatatcaactcagaattccatcaaggtttgtgcattgcattcttttgcctttttagtctcttgtctagaacagtttcctgccttgttgttgtttttttaatgagagatttttaaacataattccaaattttattttagacacaggagatacatgtgcaggtttgttacttgcaaagatttcctttgaagagtccagaccagtagtctcacattctgggtctgattacttcctcatgattcagtttggcataagtcgtttttggcagcattccaacataggtaacgctatggagtctgcttttctgactttgttgatgataagctccattgctcggatgaggtggtgatggccagaaccctccattgtaaagtgacatttttctctttgttcataatctgtaggaaagtactttgagaccatgtgaattttctgttttccagcaaccattcgcccagtgattttggtatccattgacaattattgcctaagctaactattacattgggggttgcaaagtattaattatcaaattctgtcctgcttcctacgtttatcaagtattcctccccatttaagaaaaacaatccctgtagggtcatgatatattcttttaatgtttttgtaattcatattgtcattattctgtttgcttagcatgctctttcactattttcctctctcctaaagatgttgccatgagatggaggggaaggggtcttatttgctgtctctctcagtgtgatacatagggaaaccaacacaagaaacggataccttttccaagactgtttaaggtccagtgttgtcagagccaaaaaagtcagaattctggcctgacagtttgaataatcagtgtctatttcaccaggtgtaactgatttgaatactgcttagaatacttacatcccttcttcatattcactaagagataaatttgactaattttgccttaattaaataaatgacagtatattacagttaggttttctgatttcttttgtatattatcatattacacagagtagaaacccattattttaatagctataaagtattttaatgcaagactaccagagtttgcttctgcataccccttttttggggggtacagtggagatacagtgagtagtgttttgcaaacttatgtgggaatggagcttctttttttccaaagaagttgttcacttctccttctctcagacctttcattttacccaagggacatgatgtgttcctgcaggtggtcatttagtaaaataatgaaacaaggcttgctatgaatggttgtgcaaatgtgcactgtataatccagagggcacaatttctactgcagtgtttgtgagcagtgctccttggcactgtgtgatatacagtcttggtggtcccatacaatggactctgggaagtggcattctttttgtaagttgaaagcaatggaattttggaagagaaggcaatttacgtatatagtcagagataaatgtcaactttatcctcccagtaagaattacaaatagaatcactttttatcttgtacttaaaatttcttatacttaaaataccttacacttggcattcctgtggtgtggtcaagttttgacaatgcctttcataaacccttttaaaattgattatagtcttgaaatttaagaggatatagtagtcatcataggtttactgccgtaataaacaagcttgcaatctctgtggcctaatgcaataaaggtttatttttctcacatgttacatccactgtggattgcaggtgggctctggacctaggtgtttgaatctggtggctcctaagtcaatcctcagagcccttcactggctcctgtgcctctggctgccagatgagaagagagagtggggggaaatgcacaggagacctgggagcagcatctgtcacttccacccacaggcattggccagtgctccctccattggctctgcctaaccacaagggaggctgggaaatgttgtctgtctctgtgtccacatggaaaaggcactggggtttagggagagggatgagtcgtcgtttcaaggctgacctcttttctctattttgtttcttctccaggagacttcttggcatcatcacaaaaaaggatgttctgagacatatggcccagatggcaaaccaggaccccgaatccatcatgtttaattagcaacaaggtggcaattattttcagaaaaacactgactgtgtcatttaaaaagaaataaatgatatgttattatcccaatgaaagatcatgcattggggacagcagaaacaaaagcttttttggaaaggcggggaagaaggatgaaacctttaaaaacaaaaacaaaaacatcaatgagtaggcattttatagctttaaccccgtatgagtttcaagctgtgtttcctaatgagtttgctactgctgtgggggcatgtgggtgggtaaatgatgtaaatgatgtgatctgtacaagtatgtggagcatgaatgctgactcaagaaacttttactccttctgctcaaggctgatgtttgtaacttatgaacacacgtgaagtgttgagtccaaaagacaaaggggcatcggcatgtcagcgtccttatttattggttcttgaagttttgctgctatgttactgaatcatactaaagacatttgcgcttactttgttgaaaaagaaaaagaaattaaatttgaacacagtgaaagctgcaagtatgccagtgggtccgctcacgaccgtcctgtttcttgctcctgttctcagcctgttatctggcttatccatcagtttctgaaccaacatcaggggcacctgccatgatgagtgtgaagaaatcatttctctatgcaagactggcatcctgggactgcacgatgaactattggagcatacagtactgcggtgtgtctcctcccatacaaagggacacatccttattttgagggtatactcacccgatcattgatttgcatccccatggcatttgcttcatttatttattgcttttgcccatgcattcaatattgatcagctcagcacttccatgggccatagccggtatgcccccagcctgccataagcgtgctttcattttcaagtagcatatgcaagagtccaaacaggctacccaatgttactacttatttttcctctcaggtcttatcagatacggctgtggagaggatgaggcatatgcgttgtcagttggaatccctccaaatggattgcaagagaaatactaaattgattctaaatctgttccattatcttctctgtaggatgcaaaacatccagttgtaatgtataagcatgcacttcatactagcaatcacagcacaggaggacagcattaaattttatatagccaatttgggcactgggcatctttgtatttgaacttaacgacacatttactcttttagtcaggatttcggtcttttctgcgggaaggaattaagctatgtattaggtccaccatacgatctgtgtaagtaagattatcccacttgccctttctctttagtctttgtcccttccttttcactaagtgcccctcatccttttcaatctcattgtcactggatagtgctgtatcacttaggtgtgcattcggctgcaaataacagaaaacccagcaaacactgaagggctggataagaaccctgagagggggtactccaggactgtctccataacatcattgggatccccatcccgttgctatttctttttcaccgtttttaccttttgtcctctggcttattgcctcagagttgcaagatggttcctgaactgtcaggtatcatgtctgctttctaagtgggaagaggaagggagaggcaagcaactaggtacaatgtctatcaggaaagcaaagcttccccagagacgctcagcttgtatccattgactggaagtctgtcacgtggctccccctagccgcacactagtgtgggaaggaaaatattgagctaggcacattactctctgaacgaaattcatattatcttattaaggaagagtgttggtcttcaggaggggaagtttgctgtattggatgccatcatcgtgtccttgtcattgcccttccggttttcattcttgctaaacccctgtgaatgttcttctaaccttcctgttccccaccccttttctcagatttgacctagaattcccagcccaaatccataatttcttagctctaatacgaattttcatgttggacaaaaacctagctacaaatgggtttctatggaacttctaattaatgtgcaaaatacatattttctccaggttaagaaattttaagtcagatcatgctgacacaataagaaaatttgtttgtgtaattcattgacctcttccttccaaaataacatcaagtagccacctcagtgtgacaatatccagtcaatagtagagaatttaatccttggtcctataaaagaataaaattcattgtcgtatttatagcacgtaagccttgagtaacaggtcttaatgttagtgttggtgttgtggtttctgcggaacgtttacaagtgaagttggattctcctgggctttaaatccaaaaagtcttaatgaccgcttcatgtagttcccctcttattcccctgtggtctcctcagagccagcgtgtgctgggaaagagtattagtcatagcctggctttatagaatccaggaggtccttttagctgaaacaagtggcttcaaaagggaacatgaaacagtgaaaagatagccaaaggtcagtgaaaccacagcatttctttctaatctggctgaggccatgggggggaatgaggggaaattatgcttccgggccaaggtcaccgagggggaccttgggatttgtgtcctccccagtgcttagagtagagatacctgcaaattcatggcaaacagttggaagagttacttgactgaaacaacccaatcttactttctttcgtaagttgaacctctgatttattgtggggttcaggctctcctcaatagaaggccagagttggacaggtggactaaggtcaaggatgaggagtctgcagtggggactaccacagcaaactgccttccttccgtggagtcctaactcagccatgtggtccactcacccaggggcccgggggctcagacaaaccccatggggaacatgctgccatgctctgtctttcttgtaaacgtagttgggtagggatcccaagggtatttgctctctccaaatgcagaacttccatccactttatctggtgatctgatgaacagcatggggacgtggaggtgaaataagcatctttcagaataaggtttttttttttttcctcttccagaaccaaaggctttagacatttgtagaactttctggattccttctgaatcgggttttaacataaaaaaccatcaacacatcatgggaaaggagctctttcatgatatacatcacatgtttcttgctctcactgaggaaatgtgttgtacaaaagcaccaaataagggcaccctggaagtgacatgtgtgtttcttctaagtcgtttttagtgcatcccctgcgattgcatgatgctcatgtggcttttagggaaaggcagaatgtgctagaagtcgaagtcattcaatattcagtgcttactgttactttgaaccaggtaatctcagttctttattcagtccttcccaaagaccttacaaaggagatgtgtaaactgatagattttgagcctaataagtcacagaaatggaaaattttagagcagtttgtttcacttaggtgagaactgattactttaaattaccaacatgtgcaaattctacttagtattcattattagatgctaagctggaaaagatgagaaacccaaggagaactattgaattaccacataattgtaatattatgctttaattttgtatgggcagtgttctatcagactaagcttctagcctttgaaatgatttacatgaggagagagcctgtatatctgacttgggaaacattaagcagaccctattttcactggcgcggtaataactatttatttgctatcctagaggtgctgggaatgagcctacgtgcgactttgatgagatatattcacatttggtgttggaacgaccacatagcaacgtgttggtttttttttattgtaacactctgtgtaaacgttgacaccttattaaatattaaatgtctgaactctatttttaaaaataaaacaagcacagagtctgcaacaaacatgtaaa

SEQ ID NO: 2987 - DNA, 75220 bp, human; identical to SEQ ID NO: 2984

SEQ ID NO: 2988 - DNA, 75249 bp, human; identical to SEQ ID NO: 2985

SEQ ID NO: 2989 - DNA, 80676 bp, human; identical to SEQ ID NO: 2986

SEQ ID NO: 2990 - DNA, 102 bp, human
tgcttgtttcagcagcacatagactaaaactggaatgatacaaagaagattagcatggccccaatgcaaggatgacaaattcatgaagcattctataatttt

SEQ ID NO: 2991 - DNA, 53630 bp, human
gagaactgatttgaaataagagccaggcggtcctcgcttccctgcgaccgacttttcataggctgggggagaaaaggttgagaaacttgacattgtctcgagcagagtgcgtgtagcaacagatcaaagaaaaagaggacgaaaacgtgctctttgctgcccgtagatttcgccgggttgcttttgtcttgcgggctcctgtcgggttcggtgtttccgctctgaagactgcgacgcgggctccgatgcagctcgctccctgccggatgggtcatgggattctaaacatgaggcaggtaagctcaggcggttgcgctggcggcggagggggcgggcgccgcccgggacccctgcgacgtgttactgcggagagcttgctgggttagcaggcgcctggccgtagtcgatgcgtttggcggaaagacggggctgcattttcctaagacaaccaaagaagcacattttacctgagccaccccggtctggtcctcgccacccgcccccacttttgcctctaattgtggttgatgtcaggcagtcgttgtaaagggcttacaagcagtttgtagaatatatgtaaatcaattccagtttgcggccgctggaatgtatcgtgcaggatgtatctcgagcttttagtgcctctaccctatgctttgggctagaataaagacagctgaatgtcctgaaaaagaatttcacggggcctcttatctcattttggtttcgcattctgagcacttactgtgtttctggcggagaaggcggaaccagcttgaaatgagcacagacagtccttccagaaaaatgcaaatttgtttttctgttctagcagtttggaaactgtattgcttctggacgtgagaaggcagccctgaaagtagtgagcggagaaagggctgggggattacttaaatgagtctttgaaaagaattctaaaccaacagcttcttctgtggctctggggcatgatgataaaattccttatcagtccaggaagaggtttatagctttgctgttaagcaagaaaaggaaagaaaaagtggatgtaggaagccaaggagagggtgtgatttacaactcaatcaaagttatggaagaattttatgtcaatatttaaatatcaagaacaatactcatataaggagaaaacaaggctggaaaaacatgccaataggcttggaagggcagggatttcaagaggaatgctattgcttttaccagctctgaataaatctggatgggaaagttagcatctgtatcgcaaccggaaaagctcttcactttttcttctaagtgggttgggtgctcgccaccctgcacactttgggggaagtgagctttccatttaagagcgcaggggaggggtttcgaactttctgtccctttcccacagccttgggagatgaagcagagcccccttcgaatggtcagcgcaaaccctccgccttcttgccccctcgcttgttcgctcagcaagcaggcttggcaagtttcagtgagtgcagaaaaacacttgcggaggagcaagtgccgtctgcttgcaatgaattgcccttgccttggtagggactgtggggaggacgtctttaagttctgcaaactcacagtccaacctcatacttttaatgtctactaaagtgggatgaggaaaaggaaggagaagggtaattggaaaggattgaaaaggaaaaagaggaacgcaaaacatttttgacaaaggtccttagctggaacaaagaagttatttgatcctgtgcagagccacctgtcctctcctcggtggtgtctgagctcaatttccagaatccctgttcccacacaattcctcaggaaccatggcagtctccgtgccttatgcctaaggtttgcttcccccagcttggaatggtttttcccatgcctagtttgttgtggcatttacgtgaagttggaaaacagcccagtattgaaattttaggggtacaagtacacatatagtgaactccttagttatttaatgaatgggcaacttttcatctcacagctacgtatgtctactaatttttttggcctgttcagaactttgaaagagggtgggatggaacaggggaggagatgaaggagagagacaggatcattgttcatccaaagaacgaggacagtttccagaatctagcatgttgttccactgcagtcagaacaagaatgtagggaggaatgagatggcagtgttattggcatgggttaatccctactttatttgagtttctcttggggaaacctgactgttgcatccaggcagggtgagtcgaattcaccagccaatttgtcatctcagcccggcagctccagctggatttacagggttaactatcaaacagacctgtgtgtcatcagctcagcaatgaaattggatctctttgctgatgagtgatctgtccctagggctgcacaaatgttgtacactggtgtggcagcccagaagagacccctgcctgccactgatagccagaaattctgggtagccagaaattgcccgcagaattagaaggctgtttgcctagctataagattcagaggggtttgggcttctgccaggttggcagaaaaggaacattcctgaagccaccacttcaggtgtagaaggatagtattctttgagggttcctaaggccacggctgagttaggccaaagaaaagtgtaaatctgattcaccttgatcaggaagtaattttaaaatatgtgccaacctgtctctgccctctgatcataaacgggaaacttttatgaaccttccttgagaaggaatttgctctgttcccaggcaaaaggaaaagcatggccacctgttctagaagcctggccgaaaacaacaggtttgcctgtggcattcccgcaactgcatatatcctccccacatggcaagccacccattgtccctacacacaagaagaacaaatagttcattcttgagctgggggaaaaatcagattctctaggcaaaattgcctactagacatattttgtgtttttaacatcctgataactttagaaaaaaaactctaagggaagaaggtgcatgatgtatttctgatctactaaaacaaagtaagtcacgtagctgctaaattcttgcaaggccaggatgctgctgtttcaaggaagccgtgaatctgtttggttagcccgttctgcattctttagattggaattaaaatgcccaaggacatctggcttaataatgaaagtcttcgtattaatctttcctctgaggattagaaagtcctttacaaacacgatctatttattctctgccacatccccaggagagaatgaggtggcaatttgatcctcattgaacaaatggtgagacgaaggcagagaaaggttaagtataaagagacacagcaagttaggggcaagtctggggatgaatactcacccacccagaaagactacctgtgcaggtttaggatctcaaatggcattctagggattaaaacagaatctctcttacgacattctttttcttatcattctgtaactggcaagtatattgtgtcccaagtatgttgtatggtttccttcatttgaaagtccagactcttaacagttcaaaaggcagttctgttctcatttctcccaacattgagatcaggcagcttttatgaaatctaatagaaagatacagtaactaactggaattttaaatatgcatctgagaaatgttccctttcaacagatgttttaagtttttgcacatggtttatagagctcagtgtcttcaacatatgttaaaattttaatttcttctctgctatctctctttcagcaaatgttataatcataagacttgctgtcagtttaaagatccttgttggtcattttgaaataatttttttgagtcatgtttttagttcgcttggctgtagaccgcataggctacaagcaaatccgttaattggtagttgcatgttatccacagacattccagcaagttttaaggctaagtgcatatgtggatgtctcctggctttgatcgtttgtgtggtaaatagacatccaaggtagctatggcaacctgggctgtgcgttggtgaaaggaggggatttagttactggacaaagagtaatttgtttgattagaaaaaggtaggggcaaatcaggacatttttaacccacatgatttgaggatcccagttcaatcaaatcatttggatttttctcaataggcaaaaagaagtaatggctaagcgcaccagagtatcttgcagacgtaatttaattatttttaaacaagtggttgctactttccaaaagcaatttatacaatgaaaaggaagtacaatatatcatataaatatcatcaatatccctattgtactaagtatgaacgtttttattttcagaacttgatgggactttgaaagaccaggatctgattagaggtgtgcatttcagttatctacctgcaggggtcaggcttgaagttcccgtggtcggaagatcaggcagcggacttcactgcagggagcccgaggcagagtcagagagaattgctctgcttatttggaacaattagttagcgattctttaatcttgtgaccaaagctactatgaaaatgagttcattcaaggaagagaatatcaaatacgctgtgattaaagaaagggcgataaagccaggtcaaacagcaatctaatctccgtttacatgtaaggcagtttatcgggaagattctggctcattatcaattcctttgatttcacacaaaagtgagctcagcggttttgttctagaaatttgtttgcccagttttatgagctggcatgttataaaaatttctttaaactaaaaaggacacaatattagggagccatctggatccgaaatatttttccccctctggaggaaaatattccattgacacaagatcaggatggttaatggcctccaggaggtcaggtgatagtaggagcacagaaaattgaggcgcagaacaaaatgccaagaggggactttcctgaaaaaacaaaccagaccaaagaaaataacttacctgctttgcgctatgaaagagaggttctgagtaaacatggaagaggtgctgatcatttgtagtacaagtggatgttgaaggtcttatattcagtccagtgtttatgatgaatataatataaaggctgtccttcctttcttatatcattcaatgacatttactgagcactcacagaattaatatattctgccacattatacgtgattattaatgtgccagggcactttctgggttccaaatatgactttggtaaggcccctgccctcaaagaacttttgatctggtgtacaatttattgtaccagtagcataatgtaggtttttccatggtcaaaatggatgctcattaatatctatatttgtatgggtagggatccacttgaaaaactgatggtatccaaaaccttactgaacttaggagacttgagaagtgatttgtaattgtgaaatttagttgatttttagcccacatgtccatttgtagaaatttatgacttcttacataaagcagatttctcataattattaaatagtaatttatttttctcaatagagaaaagtaactcataggtagtccccaatctaggaatactttatgttttaggagtttgttgtttgaaacccagagcattttccagcgaaaaataatcaatctgattaatgtgagatcaagttctgtgttttgaggacatgccactgtgttatacaggatggaaacagaaggagaaagaattggcatacttttggtaataggccagtcatggcaatatttgaaataggaagttcgtactagttttcacctttctttctccatccttctgatgtcttctggtctcactggggcatctcccccaggcctgtcctaatatatagtgaattcataattgttcatcttcccacccttcccttccccacctccaaaccactctcctgtttcctttagtcaatggtctctaccacatggcaggaaagaagtaatatgggtgagccaaagctcatgactcttatccctttaacccttaggatgaatctttaattggggaaatttcaagcagtggagcctggagctacaaaacacatgattttcctttcagggacaatatttgggggcagggccatgcctttggcagacagaacttgctggtgtgtctgcccgtgggtcagacctcttcatttgttctttctcagcaacctgcctgaacttctggacccactagggtctttgtgagtaacagccagggagccacaggcccccagttgagagggaattatggcgtttgtgggtttgggttgtttgtaagtatgctctttgtatgctgagcactgtctacttggattagaataaatggaaagaaaatagctgtagcatcctcttatccacacgagtatttgagttggtgtatatatttctactcgtttgtctgcttatcttggaactgagttactccagagcaagagtcacatattaattacctttgaatccccagacccaagcccagtgtctggcacacaataagaatcattaagtgttctacaggcacatgctgggtgaattttagtaaaaaagagaatggaaaatgctccttaaaatccgaagggatatgaagaagaaagggcattagaaaggtccgggaaacagcaaggactaaatagatcagtagtagagaaaattagcataggttatgattactgaactatatgtatatggttttatatatatatagtccatttatatacacatagtctctctctgtctgtctgtctgtctgtctgtctctctctctctctctctctctctctctctctctctatatatatatatatatatatatatatatatatatattcctttcagttgtgttctgggcaagaacacaacccaaaacatggtaagcagcttggcttatcctctgtttgattgttctgcagaaatgattacgaaatgggtcatgccctccaatagctcaaagcctaatcgccaagatagaatctgctgctttctctcattgaacccagcctgatagtttaggccttaggtccatgtgcagttgtttaattttgcaggtgagtggcatgcccaaggttactccagaactgagatagcgtgtctgagagaagactgaagccttctccatgtagatggtggccacatttttcatagtgaagttcaagatttgtgccggacaaagcattttcattgctggtaggtgtaacagaccagaagttatagttaaaaatgacaaaatagaaatttcagggacatttaatagtttatggaaacaacaggactaatatattaccaaagggtctatgcggtagactgtggtatctgtcctatgtcaagttttggagtgttgctttggttgtgtgtatttagaagtggtcttccccaaacaattcggaggaagggggatgttactgggaaaatggaattcattgaatgccctgctgagttaataataagtagatgaatggccaaataaagcaatatatagatggacggcaccaccaaatattattaatagagatttatttacttacataggatcaagtcttctgtacgaaatacattaggaatccagactaagaatactggttaaagtttagcatttctgggttgacgttttagcacaagaaacactttaccctccatctgggagcaaggtatgagggagacttaggttctacacctagaagctaagtcttctagactccccatctcattctcttttgtgactgtaccacatgccttctactaagatataatttggatgttttcaggtcatgtgctataattcaatatgctaataaattccaaggcaatttgaatggaatgttggtttataatgaggcaactcaggaaagactacatcatctttagtggaaaatactgtccaaaaaatccaaatagttaaatgatcttatatttgggttttgtgcttcttttatgtgtatattctttgctctgattttagttaagtatgaaaatgtcagacagcaaaaactaggaggattatatttatataaaagaaagtttagggaatgagatgagtcatttagcccatgaattaatcagctgtgctttgaggaaatagtgcaggaaggtaaaatggaacaaatagacgagagaagaaagcgtgacttcttttagtcaacatatgatggggaaagcggtagagaaaaattggctatttggtgagtgattcacttgagttccttttcagtggtcaatgtttaaagtgaaatcctaatgagattgttgctgccctttttgtacggctctgactaaaagagggaaaacagtcataataattaattgagaggggtatgactttctgagtagataaaaacatgatagactattagataatgaatatttattgcttgatgcttctcagtctggaagagacactttctgaatatttctccgctttctaacatttcagctgtcagaattgaatggttcacatataaactacattgttttggtttaactaacaaagagtgataagacatgaattgtttgtgacagccccgaacattgataacagaagacattaatgcctgcagacacagcctacatggtaaaaatctggaaacaaaaatgcttattatgttaggccatcgtgctttgacctagttttgcttttctgcttggaaattatgtcaatattagttacatcatcccttcggatgagcaattccacattcttgtttatttcagtgtcatattattagtttttgtatatttagttctgacctctgaggagccaaactaatcctcattgacttgcattttccttttgaaatgagacttctgcatgataaagagagaggattttatgtattaacaaaacaatctaagatgcctctttaaaggcattcatttctccttgatccggagctactgccctcttgaaggttcctagaggccatccagttttctgctgatcagaattagtctttttttctttgtcttatggggatggaatagattactgggcctagaactgccatagttgaataacaaaaagtaaaactgtgaggctgatgggacatttcccagcccatcatccttaaatttgcccttttcatgtttctgctttacttcttcatccagcagaaacgggcttagcatatttttcccatttaacatttttattgaatacttttcaaaatgaattatttccgcagttgatttcgaacacatttttttctgtcatttaatactttatatcactagaggaaagaaccatttaattctttcatacatttatgaattctaatcttcaaagagtgtgagttcttcaagtgatcaacttacatcaaatttacaagtataatttactaccaaaagaccttgaacgctttttggtgcacatgttttggcattccttattaacaaatgtaatgaggcaaaagcccacaagaatatgtattcctggttcctctttaaaaatgtaccatttgctcttattttctaattaaggctttgaaggttaaaaatccctttgttgttagctcctttacaagtctcctgcctgagtgcagaaaacataagaagggagtgtcctcttcagagcataaccaaaccaactaaattttaaccaggtaaattgttgattagcattggatcatgtaaagaaacagtatgaaagtaattgagataggcacaactcctaattgtgtgatcccagggggcttcaaacattgtttgaaacattcacctcagagattatattccatgtctgatccttatgctaatttgaatactaggatcctgaagaaaaactttataggatttcttgagtccctaattggtatgtaaacatcgtcattcccaagctgcccaaagttgtgaattatagtataccatgtgtctcctgttgtgatatcaatttctacagcaatttttctgcttgttgtaggcaaatgtaaatatatttccctcctcttacacaaatagtggcctttcacatacattattcttcaccctggcttttttctgctttagagtataccctagagatctttccataacagtccacagagagcttcctctttaaaaacaaaacaaaactgcatatcattgcactatgacgatgtaccataattgatttgacccttcccctactagtcacgtggagtgtgtccaatattttgccattaaagcaatgtgcactgaaaaacgttgtgttcatcagtttgtatggggcggatgtatctgtattaaaaatccccagaagtgggattgctgggccaaagggcaaatgcagtttctaattttgataaataaataacattgtctaaccagcctgtgtgagagcactgccccagagcctcatcaatagagagcattgtccaacttgtgcacctttgcctatctgatatctgaaaagcggcatctctgtgtagctttgcattctcttctgagtgacgttgagtgtctctgcatgtgttgaaggtctatttgcatttcttgtgcaatgtctgctcatatcctctgtttagaaaaacaaaaagaaggccgggcgcggtggctcacgcctgtaatcccagcactttgggaagccgaggcgggcggatcacgaggtcaggagaacgagaccatcctggctaacacggtgaaaccccgtctctactaaaaatacaaaaaaattagccgggcatggtggcgggcgcctgtagtcccagctactctagaggctgaggcaggagaatggcgtgaacccgcgaggcggagcttgcagtgagccgagatcgcgccactgcactccagcctgggccaaagtgcgagactcagtctcaaaaaaaaaaaaaaaaaaaagaaagaaagaaagaaagaaaatgccaggtctagtacaacgatgtttgatgggtttttttgacaatgataaaactactatttagtaagagaatcactcccggcagtagacttagaagcacactatcagagaccctcgagtaaagaccctaacgtgccacatcttaactctgtgaccttgggttgattccttaaacttcccaagtttcctcacctgtaaaattgaaatgatgtggacaactcacagggtttatagaataatcactaaatgaaggattatatatataaatgatatataaagcacttaacagagtattggttacatactaggcacttaaaaatgttaggttaacttctctttttttaggtacaaacttaaggtttcagagaaggctgggttttatggacatttctacctcttaccctctgaatgaatacacatccacccacacagaggcatgtaaatatacacatatgtacacacggtggaataatatctgaaatggctgtaatgattcaaaagcatctctttagacaaatgtgtgtgtgtgtgtgtgtgtgtatgcacgtgtgcatgtatatgtataaatatccctgtaatgtaagaaaactaatttgttgctaaaaatgtacccttttcggacaaattatcctaatatgctaaaacaacaccaaatagtattaaatggacatgatcacttatcactacctttcatattataatccaaaaaagcatatttttccttcatctatcttattctttacaacaattaaactcttttacaatgttacacaccttatacttacagctatacctagaaataaaattacacttatactcatgtttatgtatttctgtctttaaaacaaaaaaataaacacagcagtaaatacaaaaggtagaaatggaaaaaatgcattttagagggcatggtgctgagggctgagaatataacactggtctttaaaacaactctaccactgtgaatgagaccatttgggtgatcttgtttcccagggctgtgttgttacagaaacataattttaaaaattgtattttgaaataattacagatccataggaagttgcaaaaaaatgtactgggcagtctgcaccctttacccaccccttaccccatccctaacccccagaaaccagtaatcatctgttctccatctctataattgtgctacttcaagaatataaacgtaatcatacagtatgcaattgtttgagattgacattttttcccgctcacttaattttctagaggtttatccaagttgttgcatgtatcagtcgttttttcctttttattgctgagtaatgttccttggtgtggatatatgacagtttaatcatcaacttgtttaaggactttggagctattacaaacaaagttgctatgagcatttgtgtgtaggattttgtatgactgtaagtttgcatttctctgggataaatgcccaggagtgcaattgctgggtcatatggcaagtacacattcagttttgtaagaaactgccaaagcgtattgcagagtggctgaatcattttacatccccaccagaaatgtatcagtgacccagctttctctgcatcctccccagcatttggtgttgtccctgttttcattttagccattctggtaggtgtgtagtggtgtctcatttgtattggttttcaaaaagtgcagaagatacttcataatccagtttgggtgtgttcaatacctcccaggtaaaattctcacacataatatgggcctatcttggtacatgactgaattgtcaaaaatatctatgattgctgccttttttgttgaaccttaactgaaatattgagagcaaaaaagaaactgtgttgtgcaaaatatatccgaacattagactgggcttcaatttatactctgagacactcagagaattgttacttgctcaagacatggcagatgcacgccccaacacctaacttcactttaggaatagacacattaggtatcaggaaaaattgctaagactatttaaattcctctccccttttccaacatattccattgcctttgcatttgcataaattaaataggggcatgatctgtcttcattgtcaatatacatgtagatgtgtgtaaatctacaaacatacatatacacagacatacatacactggctctgtgggcgtcaatcccaaatgttccccaacatccagtctagattctcccgggtcaggatttctcaactttggcactattgacatttggggtttcataattatttgtggggctgtcctgtgcactgtaggatgtttagctgtatccctggccttaagcaactggatgccagtaacactcccatgcccccaaagtgtgacaaccaaaaatgtctcagcacattgcaaaatgtctactgggggcaaaataaacctccctttgagaatcactggggtagacagaagagaaggagaatctcaggcttcaggttacctcactgggtttgctgaaacttgataagaatctccttaccagcggggatcaggttttggtgcccacctgttcatttctgataactaccaatctctaaatctgtttctgcaagttatggctgaagattagtggttaacagagaacgatatcagcctttgtttcttaaagagcttatattcaatgctttaaaatacaaattggatctggcactgttgtggttcacacctgtaactccagcactttgggaggccaaggtgggaggattgcttgagccagggagtttgagaccagcctgggcaatatactgagaccccatctctacaaaacaaataaaaaattagccaggcctggtggtgcaaacctgtagtcccagctacttgggaggctgagtcgggaggatcgcttgagtctgggaggtcagttctgcagtgagctaagatggcaccactgcactcgcctgggaccttgtctcaaaaaacaaaacaaaacaaaataaaataaaacacaaattgaacacacataattgaaaagcaaacttcatgcatacctggttttgttttacttttaatgatgttttatcacttatattagatatcatgattattttaacagatacaaaatttaataggtaataaaatacctcataaaatagggtatatctccatatgcatagagaattttatagagaaattggcacaattcctggatcttcctctgattcaatgtgtttatctttgaattctaataggttttaaaagacatttaaagaattgcaaaacaggcaaaggaaaatatgatagtgttttataatttaaattatgtctacatggcaacaataattattatataaattatagaaaatgttatgtattttttaactttataaatttacccctacttgataaataatatattttgtatttattacatttggtatataaatatatttctactttagaattaaaataaggtgaaaatagttattttttgaaatactgttaagttgcatattcttacctgtattagaattaaaatatgtatcttatatttatatataaattacaaattacctgaaaaaagaataaattataaccgcatgtaaaaataaaatattcctgtatcagttgtgcaatttaaattccggttttagttttcattctttaagttgttacatttggaagatttggatagtagttatcatgaactcactgttatctatggctctgacagtaaaatacgccattgagttgtactgtaatatgaatctcccgggaacgctaagccaattcagaatgaggcattcctgtctcaggaatagagatttataaagtgaccggaggtatcactatttctagaggaaggtgcaccttgaagtattctcattcttttctatgcatttatgatcccagcctactaaactcaagcaacacttcaatacagcaaagcctcttggaagtatatgagtttaataagaaaatttatgaagaaagaatacactgaaatgcagactgacccccaaaataataggatactttttaaaaaatgtattagtttcatagcatggcaaataatactcaaaaatactttgaaaatgcacattttaaaaatgcccaaagggtttagtagattatgttgagagaaggcattggaggaagaaacattatagccataagaaccaggaaaatgatcctcctttgtttataggattacaaagaggaattttaacttctaaagtgaaaatacaaattacttgtgtaggctaaaatcacccttcttagaggaaatggtacaaattttcttcatatagtttatgttcctccagaaagtctctgtgaagtgataacattataactgcatgcattctcctggtgacttcatttaaagtctgtgatgtagtaacatcatgcacacttccctttcctacagagcccttatgttctctatagaccaagaggttaattaatttttagagttatatagcaaagagttgccagaaccccaaataacatatctctaatttccaaaattgcctgacaaactatattttaaagaagccatgttattcttaggataaacctaataatgtcactttaatccccagtcatgctcatctttgcctttcttccaatatgtgcaaggaatatataaggtgaccttttaaggttacagtatcttcttacaaattagagttgatgcactgaggttataacagcagctgagcattctcaaaagctgcagattgagccgacaggcagattagcaagtacataaaatgttagtagagaaaaaaaatagacttcaattttttggcaatcctgttaaacaactctgtgaataagtctttgaaacttgtacagtggaaggtttgaattttcctcaatgcctggcacaaaacttacctatctgttgcatatgtgcattgctgaattaattaatggaaagtaaaattttaaaatgtaaccttggttatttgggataaaatggcacttccatgtaatggaatgtcataactgaaattgtagggattttcagatactctagctggcactaaatctcatcagagcccttcaagttataacataagatagcatattcaatatgagaaaatatttaattgtcagccttaaaaatgtatatagcagaggcaatcccttttttttctgacaacaaagccttctaaaagcttttcaaactatacagctttgagatttataactttgaaccaagaaaacataatttcaagaaatgaagagaacttctgattaattctagtctaaggcagtgaagtcctgctagattttaaagtattatattcttcataattaatgtcaagataggttcctccctgtggctcattattttcttgtaaaaagtacatactgcctgtgtttttaaatttcaggttttctcatgccgctcttgtctaatgatccagcaagttcaggcatataatacttttgaagaatctatatttaaagactaattatttatgcatgtgtgtctatgtattttgaaatatatatatttcaaaagactgtttttagcctttggctcaaatattttttttttaaggaatataatattgaatatctggacaggttaaaaatctccaacatttaactataaatgttaactaatgctttccttttcatttgttaaattgctgcataaatgctttaaaaagtatgttaccgttggcattaagacatcatctcttttacttaccaaagtgcaccaatctttgggattgaaccattgtagctgctttaagccaaaaattctccccagccgggttccttatcatcacccttgccacagaatctatatcgttgggagttaaagatctttggtctcaaaccttatcctggttgaattcctgtcatatcaccagcaacccctttctaatggcccccaggaatgctagcacaacaggggatcttcaggaggctcattccaatgagagacatcatttgcagtgacaaagtttgtccttagatgaaatctgtatctctctctccctatagcttttacccctgtttggccccctctctacaacacagaacacgtgcagttactctgttctctgacagctcttcaaagacaaagctaacatggccttctgggggcattttttccaggttaaatatgcccagatgtgcttgatttggactctatcctttaggatcaagccatgttagtaagtacaaatgtccaacatttaaaagaactgttcataagagagactcaccagattagaggaaagagataccattcagtttctaatacacagtgaccttaatgccactattttaagctctctctgcctggattgtagagactttgcctagtttacctctggaatagaaattctgaacctttgctagtgagtgagcaataacaatgatgacagacatctagctagatactaagaaaaaaagtcatgaatgaccaaagtgtgaattttgtttctttgcttgtctgataccccatggctatttgcaatatcttattgtcatgtgctaaaggatttaggatattaatcaaagagaaaagcggttctaagatggaagaaaagacaaaaatgtgggcagataagtaggaaaagaaggggatgaggattcaggagctttttccaggtacttggaaagttgaaggcaacttaaatcatttttaataatttaagaaatatcatttttcatttttatataaaatactaaaagtctggaaaatatataggcaggcacagtgtgttggcaatatgctgtttacaggttggcaaaacaagccagtgtctaatgaaaaggaaggttgcgaagagcttagatctgaaactgagaggcatgtcttgttccacaccttgagaaacacttggcatataccaggtgctctgtaaatatttgcttagtaaatgatagaatgagcatgtggtggcagaatgatgccttacatggcattacccagactcataggcatccctagggactgtaagaaaagtttgtgggcttttttcagcgttttgaaaaacccagaagatattgtataattactttttcaatgattgttttatcaaatacttctaaacctgaggatttatgaagttaaaagtgaaaaggttttttaaaaaatgttatgccaaatgagagaagccagtcacaaagggccacatattgtatgatctttttatattaaatgtccagaagaggcaaattcatagatccagaaagtagattcgtggttgccgggggataggggaggggagaatgcggagtgagtgctaatgggtatggggtttcttttgggagtgatgaaaatgctctggaattaagtagtggtgatggttgcaaaactctgaatatactaaaacccactgaattatacacttgaaatggatgtttgtaatgtgtgaattgtatctcaataaagctgtttttaagaatgataagcatagcatccaagcatttaaaaatttttttaaaagtggtcattggtggtaaaaaaaaaaaaaaaaaagtcagaaactatttgcttaattgttacagagattttatcccagattaaaatactccaattccgcactttgggaggctgaggcgggtggatcacgaggttaggagatcgagaccatcctggctaacatggtgaaaccccgtctgtactaaaaatacaaaaaattagccgggcatggtggcgggcacttgtagtcccagctactcgggaggctgaggcaggagaatgggcgtgaacccgggaggcggagcttgcagtgagtcgagattgcgccactgtactccagcctgggcgacagagcgagactctgtctcaaaaaaaaaaaaacaaaaacaaaaacaaaaacaaaaactccaattccatttcgccaaagggaacaagcagaatattcccacaaccctagggaacaggggtaggcttggctattagtcattctccttcttccccattcccaataattggaaaaaaaaatgtgtgtgcacacgtacgtgtgtgtgtatgtatatgtctgtgtgcatatgtgacaagggcagtagtcagagcaggatcatgtgactaccaggatctatggacagccccacactattaggggagaaagtgtcaagctatttgtacggttcttatagagcatgaatctaggccaggggtcagcacccttgttcataaaggaccagacagtaaatattttgggttttgtggccatgcagtctctgtccaaacccctcagctcgacatagactatataaagcaattggaggtaactgtgttccaaaaaaactttatttatagacactgaaatttgaatttcacataattttcacaagtcacaaaataatatttaaacaatttttttttcaaccacttaaaaatgtaagaaccattcttagcttgtgggccacacaaaaacaggcagaggcctggatttggtacataggcggcctgtggtctatagtttgcagaaccctgctctagggtaatgactgagaaagggactctactaatcagcaggttgttgggaagcacgttacttaccttaagccagtataaaacttaaagcaataatgctacattatgtctaaaggctaagctagtgagaggctaaattataacactcaacttttttagcaaataattatgaagcatcagctaataagaccttttcttaagagtattcagagtataataatgctaccttgtgtggtttggggatttttattttaagttagggaagctatgaatctcttgaactttgtccattaagaagtctgccaaagctgtgaattttaaagccatgggaatttttcattgcgcttggctgctgaattttaacagcaaagttattcattaagtccacatttaaaaaaaaaagtatcaacaatgcttctttatactttatctgcatttgacacacttccagatagatgatctttaatttgactaatgagtgcatcctttgttattttaatgacaagtaatttacagaaagagaaaagcttttcaacacgcaagtctcttaaatctggaatttaaagtccctgatgttcagaagcaggaagcaacagttggtgtaagacagggccactaggacactggaaatgcatcctgggtaatgagtgggaaatacaaaaggaagaaaacagttggaaatatgttggccattttatatgacactttctgggtttattttcaggttggagcacaagtcagaagctgaagaacttggagattttggggagcatatgtcccaccttccccaacccccaagtatccaaatatcccctttggttctatcagagaagtattaagatttattaattagaagaaaaattaaagttataaatgttcaataggaacataaggagaattcaaaaaaataaaatgttgagctcaccacagttttcagcagaaattttactcttttttttttctttgttgagatggggtctcactatgttgctcaggctggcctcgaactcctgggctcaagcgatcttcccacctcagccacccaaaatgctgagactacaagcatgccactgtgcccagctaaattttactctttaactgatttttcaatgcataaataaatgaataagtgggtaagtacttactgaggacacagttttcaaccaaaccctgtagatactcaggatgaattaagcatgggccctgccttcatggggcctagggtttactcaactttacagaaaacccagaaatatcctaacaaatgtggcaactgaagaactttattcctaatcctaaaactcactttctttattctcagagcaatggatacagcattctaatgtcaaatcattgtttccatgttacacaatactctaactgtcaaggctaaaccctgtcttaaggaagggtgacaatggctttgttcttatgataatagaagagataaaaagattatttacaaagctacagcctctgaaaaattggaagtattttatacaaacaaccacctcaattcttctcacagtgatatttaagtgtttgtgcgtgctggtttctgttatgtgggtctttaccattttcattcctccttgcagctctatgagttaagtattactattattcttttacaaatgaggagcatgaggcctggaaaaatttaaaaacatgcagaggtgataaaatactgggaaagtttcacattcaaccatgtctgatgcttaatccttttccttctctttccaccatagcatatgatcatggcatatcatcactgtttctgtttcccctatagaaaattcaggaaaattaacacatggaagagtattcagactttcacttttcttcttacataatctttgagcagcccattataggaaaataagggcattggagatttgaagaggcagaatgaacacgttctagatgtagaaagaaaagttctaagcaggtaaaagacaaccagagtgaaatacaccagatggatgcttgacttggagaagatgctaagcactaaataagccaggtggtagagggtgtgaaagcggagagccctgagaaattgatcattaagcggaaggtgattaaaatcttcctaagggacagttggtcagagcagaggtcaagagctaggacttgtctggcaagacttattgtggattcttgaagggttaagaagtcagtcagagacccgggattggatactgtatttgaactgattgtcactcaccagaatctgtgatctaggagacagacattgccaggatcccccccgtcaggatggtcatagagaagggaaggtgtgttcatttactattgctgcatagcaaattagcacaaatgtacagattaaaccaacaccccatttattagctcgtggctctgtaggttgcaagtctgggtggcccagctgtgttctctgctcagggtctcacaagactgaaatcgagctgttggccagacgaagctcttatctggaggccctagggaagaatttgctgccaagctcgctctggttgttggcagaatttactctctggcagctgtaagactgaactccttgatagctataagctgtggtccactctttctaagggacatctgcattccttcttaagtggccatctccaacctcaaagcaacagcacattgagtccttcacacacatagaatctctctaaattcctctttcatcagtcaggaaacgttctcagcagttaagggttcatgtgattaggtcaggcccacctgcatcatctccctttctaacatcaactgtgctctgtaacacaacacaatccaaggagtgatgtcacattcacaagttccagggcttcaggtggacatctttgggctgccattttagaaagtctgcctaccacagaaggtgatgaagaatctcagctcctgccttgctccttggtgagctgtgtgacctgtaataacagcagctttgtggaaaattggcccaccctttcctagggttaaagggccaaagcgaagttttgtgactttttcttcctcttctgacactggcttcttcctctaaggaaatctgctgcttttggtgttctcttctttccttcaccatctcctggtgttggtgccaagaagcactggaaggcaggtggtccatcaatttagggcaactgaaggttttgagatcaaggcatactggaggcccagacatcacaagagggcagcacagagcaagagctgataaatgttgagatgcagacttagcaggccctagctctttctgagatgatgtgttcatctgccctcaaaacatcctctcactcaacatgtgcctcctaacccagaccccaaggagtctttagtaagaacatggcagatatcacatgtgctgaccatggggttatcacaaaacattaactctccaaaaatctgctgcttggaaccttggtttctgcaactaagaaatgagttaaaaatgtattcaaggttgataaatttaaaatggaaaaaatcatcttctgaactctagcaatatgaaggccactttttacaagtctgatgctgtagtgcagtgtttacaacctattttcattttcaaccccctgtcacaaggagcctgttgaaacattttttgctaattgctccttgcatgaaattttaataccacaaatatagtataaatctatttatgtatatctgtgctttgtgcataaaaagagtaaggttttttgtttgtttgtttgtttgtttgccactgagaactagttttctcgctcttgggggcaatattgcccctattgacagtgcatgttataatggggaaaaattgctaacattttaatatttagtaaatcttcagcttatatagtctatttgatttggaaggtggctgtaatactttagttgtactaaaaggtacttgaaattaatcttgaaaagtcagaagaatctttacacatgaaaaatcacccaatatattatatttaaaataacaacttgcaaaacaaaacgtaaagtctgatcccatttttgtggctaagaggtacagaaaatgactagaaagatcaacctgtggaatgttgcttctttgcggttagatccttctataggtgttttgctctttgggaatgttataaatattcaccaatatacattatacatatgtataataaatacatattatattcatgtcaagaagaatactatttaaaaagttagccattctctctctctctctttttttttgccttcaacatttaggattaatgggcagtataaattcaatcattcacatgtagcaaaaggagaaatatttcacatggcccattcatgactcctttagatctctagagggcttcaagcctcaaagtttattgttgcattcttcttaattctggttgaatgcatgtacattattttctgcaaagaaataccacccactaaagactgttccttctcttctaacagggttttggtgtccccagggctcccttagtcctatttactttggatatttcaggagttactgtaggtttaactgtggtgagtccttaagccctctttttaaattcataaactgtctctaatcttagcaaaatgtcaggttacacttttgagaggtttgggaacttgacattttgtagcccagttggggtgtaggctgcttctattctgagcaccttgttccaatttatgtcaggaggaattatatacaggtcagggctgggagcaggttataattaatggggtggacaagtggatttttaatgtttcataaaataaaatggaaatcacatgttcttggaactgttgtatgttttaaaatatttacatttattctagtaaacattaattataactgatatatttctcctatgaactcgctaactgtgaggtcacaagccattgttcactgagtagaaagaatgggtgacaagctagttacaagaaaaaagacagtacttgggcgggtatcggtgagtgaactcgtggaagtaatccagtcttaggtctttctcctaattttctcttatgtttaaagcacccccttgccaatatgatccagatgtcagtccttctaagacagaactgggagggtttagcctgtgaaatttctgaatagctcctggtgaagaaggaacacatgaccaatgtttaactatttgtcttttcaaaattaaagtttagaagtagttgaaatactgccagaatctacagcgtccacgttttattcatattagtttatcaaaaatttccaattccttgaagctgtagcagcaatatgttgctgaggaaagaaattttttttaaaaaaaatttgtacttataattgacacctaataattgtacatatttatggggtacaatgtgatgtttcagtacatggatacacagtataattatcagattggggtaattaccacatccatcattttaagcatttattatttctttgtggtgacaacagtcaaaatattctcttctagctgtcttgaatatatattacattgttatttgctgtagtcaccctactgtgtgatagcacatcaaaacttactcttcttgtctaactttgtgtacctattgaccaatctctacccgttcctcccttcccccataccctcagcagcctctgggaaccactgttctactctctactgctatgaaattgacttctttagattccacatatgagtgagatcatgtggtatttatcttttttaatgtttttaaattttattttattttatttataatttgaatttttattttagattcaaggggtaaatgtgcaggtttgttccatgtagtaattgtcttctgtgcctgacttattccacctaacataatgtcctccaggctcatccatgttgccaaaaatgacaggatttcatcctttttatggctgaatagtattccattgtcctaatcatccccataaagaaatatattttctttatccttttgtctgtagatgggcacttaggctgattccatatcttgactattgtgaagagtgctgcaataaacatgaatatgcgggtgtgtcttcgacatagtaatttcacttccagaaagagatctttaagagtcagaaaaacccagattctaaactggtctctgccatgtgccagttgtgtggccctggagaagatgctttaactctgtgtctcagtttcctcatctgcagaagggggaaaatgatacccactatttagggattgggtagggattagacccaatttgtataaagtgcctggcatattgtaggtatttttttaaatgccagttatggatatatgaaggaaagctccaaaaaatgaaattcaaaggaagccttatgtaaattgcatcacatgtcaaccatttgggtgttaggaatattgatgcattctttattttgcctagaattcatcactccctaaataaatattatttccattaagtcaccaaattttatatatattctttgtcttgtatggtgaagaattaatacaagtgcgctactctattagggtataacagttacctaagtaatgtatcatgagacctttttgcccttttctaaggaaaataagtatttattggaaggacaacttcacacacagtcagcaggtaataatccgcagtacttcccaatgctgcttctatgggctggaagagtgtttggtggttctatatggcacagggctacttgtccatacccttgacccaaggatgtcacgtgcacccaatcaacctggaaatcactgtggtgacagaagttggggcccaatcaccctcagggccttgacactgattttgagtataccagtttggaaagtctctgcagaattccccaagacattaagtttataatatcccttgaggggtccttagaaagaaaaagtgcctatgttttggtgtcattatcgttcttcagggcaaggcttggtgaaaagatactgagagaagacagtacagatagaaggacaaagcgaacaaaaataaggacccactgattttatctttgcaagctctaaactgagttacagattgagatctaaaatatatactcaatacatgcatcctcaaaatgttcttcacacatttgtgcccaagacatagtagttgataatattaatacataaatatatatacacacagatatatatgccttacaatacagtcctatttttagtgtgtaacaactgtactattttcaaaatagtcatcggcacaaacaccagtaccacggctaaatctgacattattgatcttttctccctctaagaatatcttttgtaggcccataagtgagagatggcagatctcctgagcttcattcagtcctttatggaaatatttatgaaaaccctactgtgtgctcagtagctatcagagttcttggcatataaaagatttcaaaataaatttgcctagtattgctttgggggatgaggacttggtgatatcttcctctccccaaaagaaaaagtggtgtgtgtgtgtgtgtgtgtgtgtgtgtgtgtgtgtgtgtgtcagagggacagagacagaggtagagagacagagtgtgagagtgtgtgggtattcagagagagaacatgagtcccagtcttatccttatcttccctcatacaatgcaagctatttggaattgtagagctggaagtgatcttagctaacattttcccaatctcctacccaatacaggagcgtcttctacaataaccttcatcaaagggtggaacgctaaaatgtaagactagaggtctctttttgttgggcaataatttgattcaattatggtgtcattatttggtaactcaggtggcacagtataaatttctgtgggaaattggaatggggagcccaagctggactggacatgactgcaccatggaaggaggacatttgggaccagtcttgagctgccattgtgttccactgggaaactaaacactagtgctttctcaattagtttatatatttctcaaagtattccatagtctttagtttgtgctaacaaaattgatcggaagtactatattaaaattatcattcattttttactcttactgaacagcagtgagaaaagcaggaatctttgtcattttgtttagcatgtaaatgcacaaaaacctcagcttacctgaactttgctaaaatgtcaaacctttattaaccacaagttttctacattatacttttcctaaagatttgtgaaatacaaggaagaaggtgatattatgaattactgtaaaaatccatggtcatggatacaattatacattcaagtcaatctcctacgtcatctctatttatgatcaaatgaaaaaaggtctttttaatgatgatctcaaggaaaaataagatttgaaattacctcaaacttttcaattagatccaatatgtgatttgtagttatgcaagtaaagtggactcaagcattgtagaaatgtttcaattaggattttttttaagttaattgagatttgatcatatttttattgtcatctttgttcccacatggaaattaattccatttcagacttatttcttggagggtgtttagcatagttatcaccttaaatgagtagggtagggtgcgtagggtggcttttcatttttggaatttaattattactctctctatatatatacatgtatatatatatgaaaaagaaagagcttgccttggcagaagtgtttaaagaaacatgagtagttaatgccctcactgtgatttgacttccatcttcctttttttaagcacatttttcattttttccccctttaaacctgccatttagagctgaaaagtatttttcaagaaatggagcaatgctttctatcccatttattaaagtaatgcacagaaggaaatgcaccgtggtaaaaacaatttatacgagaaatgataatgttttgctaaagataaccaggaagtgaggaggagaaaaaaacccctcaaatagcagagagaggccagatggtctttttttttttttttttttttttttttttaacgcagtccctaagcaggaaattttgtttgattaagaagacactggtcttgattttcattcagcagttttgaggaactttttttaatggacacacacacatatacacacacacacacacacacacaccacaagccattttcattcagccaaattatcatttgtgctattgtaagcaagattctgctgatgaaaatgtgaagtcttaatgataaagaagaaaacgagttcccaagtctcagttatgaaagaacttggaatttacccactaccctaaagacgctcgatcattaccatatccatcatattgttgtaaggtctggtgttttgttttgttttcttttgatagcctggaatggaagaaagactgtgtaccacagtggctaactagggttttgtgagatacagggtagacccgggggaaaaaatagaggttttggagttcaacaccccagggggctaatgtgcataaagcgactgctccaaaggacctgagtttaatccttggagctgccagtcaggatcaggatgaagaagcacccatgcaaagaattgcttctggatgctgataggcagggaggtgaagggggggaggtgggaagggggaacggagcacccctctttggactgtgatgttttggcagtcggtgcttggaggagggtagctggcagtggctccggcacaataaagctcccttcggtgaagtcaccagcatccttgccatggtctggcaccctttgcccagcacccctggagtgtgcaatttcccagtctgtattctaaggatgaaaatgactaaagttgtgaaactaactatttgcatctgtttcaaagagaaagagtcacttggaatttggaatggaaagaatagatttagacaactggcagaattgttcggaactatgccctgaatcaagagaccctgttgacttatataaggacaagctaaaggagctacgtaaaagagagaaccaacatatctttaccatgaagatgacaaatcaggcattcaaatttgttttttcaaaaatgaaatgtgttctcatatagttgtgtgatactttctctaatcagtattcatatttatagtcaaaataagtataacttcactttaatatagcttagccaccttgaaagctcactgttcttaaagctagatttttttgtaagtgaatttttaagccctagattgcatcttaagtactgagttattttaattttgcctttttttttaatgtttaaaagccagcttcttgtctaatttgattcaatggataaaatgtacaggatgaaactcacacttaaaatgcatttcaatgagaattaaattgtttaaaatgaaacttttttcctttaaattttaaataaacaaataagatgcaaagcaaaataacaacaaaaaactcttaagtcaactcccttggggataagggataaccttagggataaggtcataccttttgatattaactccaaactcatgccttgtattcgtgttttacaaattacatttataatttatctcaaagataacaaggaagcatactttgataatacaagaagaatctctcagactttagcctgccttgagaatatgttttaaaagccattagaagcttcctagcgtttatgggatttgttcttatatagagtacatttttttttacatatattttgggcagaattctcaagtctccaaataaacagtttaaatcttggcttttaggccaaaaagtctttgggctgggaataactcaccctcagaagactacttgctttataacccctcccctggaatgctgcgaccctgtcttcccacaaaccttatttgcttcactgtggaagagtggcacagggcacccaccacccagacttcccaagctcttctcttggtctctgctatagctacaatagcaactttattctcctacaactgagagaagagagacagaccctctcatattgttgtatattgttttatactcagaaaaggaaagagaagcaaaactaaaggcaggtagcccggcgcctaagaaccagacgcgaaaccaaggaaccagacctgaaaccaggcctgggcctgcctgacctaagcctggtagttaaaattccacccctgacctagcaactgatgttatctatagattatagaaagacattgtaaaacttcccggtctgttctgtttcactctaaccaccagtgcatgcagcccctgtcacgtaccccctgcttgctcaatcgatcacaaccctcttacgtggaccccccttagagttgtgagcccttaaaagggacaggaattgctcactcggggagctcggctcttgagacaggagtcttgctgatgcctctggccaaataaacccctttcttctttatctcggtgtctgaggagttttgtctgcggcttgtcttgctacatttcttggttccctgaccaggaagcgaggtgattaacagacggttgaggcagctccttaggtggctttagcctgccctgtggaacatccctgcgggggactccaaccagccggagcgacgcggatcctgagagcgctcccgggtaggcatttgcccaggtgggacgcctcgccagagccgtgtgtggcaggcccccgtggaggatcaacgcagtggctgaacactgggaaggaactggcacttggagtccagacatctaaaacttggtaagactagtctttggaacttgcccactccatttgtgtggaagcgtggtctgatcacccacggcatgcctttatcggcactttggttttggttttgacttggtttgaattgcttgacggaactggtcttgggaacttgcccgctccatttgagtggaagcgtggcctgatcacccacagcgtgcctttatcagcactttggtgttggttttggttttgacttggtttgaattgcttcacaggactggtcttgggaacttgcctactccatttgagtaggaacttgcctactccatttgagtggaagcatggcctgatcacccacggtgtggcagtaccggcactttggtttttgtttttgacttgacttggattgcttgatacttggattgcctggattgcttagttttggttttgacctggcttagatttctggatactctaattttggttttgattctggtttggtgtaaactgcaaaagtgtgtgtgtgccctttttacctgttctttgttttgtggtgtgcgtgtggtgtgagcatggtgttttgtctcaaagaagcatgggtcaggcacaaataagcccaccctactaggaactatgttgaaaaatttcaagaaaggatttaaggaagactatggagtactatgacaccaggagaacttaaaactttgtgtgaaatagactggccagcattagaggtggcttggccatcagaaggaagcctagacaagtcccttgtttcaaaggtatggcacaaggtagcctgtaagccaaggcacccagaccagtttccgtacagagacagttacagctggttttagatccccttccccccacagtagttaagagaacagcagcataagcggctggcagaggcaaggaaagaccagcagacagaaagagagaggcagaaagagaggaagaaacagaggcaaaaggaaagtcagagagagacagagagacagaaagtcaaagagagaaagaaaaagagaaagagagaaatatacaagtagttaaaaaaaaaaacaacagtataccctattcctttaaaagccaaggtaaattaaaaacctgtaattaataattaaaggtattctcagtaaccctgtaacactctaatactactttgttgtcagtgtaaacaagggcatatcccaagagcactgaggccttcctatcaaaaatccttaacccagtaacccgcgaatggcccagatgcattcaatctgtagcggcagctgctttgctaacgggaaaaaaaaaattatgcaaaaaatgttgtataatttaaaagtactcagtactattgaagaaacagtttatgttcaaggtgtataagaaaagtaaaatatacctttggtaaaaggattataaggaggcataagaatgtggatttttacctacattaaaaggttaaaaaaattattgttttgaaagtttaagcgagttttgagacgttaattgtaaagaaaattctgtgtgtaaacatattagctaaagttaaaaaggtatcatccagtttttctgtgaactggacattaaaataaaaatgcaacaggtttttcttaaagcaccaacctgctctttaacaaaaattatgaaaggttaaaaagagtatataaaatcttgcttatggtcaaacattaaaaattagataaatatgtctacaaggttttattaaaattaagtttaacatcaataacactaatataaaggtaaaatttggcttatctagtataaaaatcatacagaaagcattgttaaatgtaaaatggtatttggctttctttggtctaaaaactaataaaaataggtgctaaaggaaacattcattttactagaagatcataaaagttaaaaacttaaaacaaactttggcaattaagacagcataccaagatgcaaatgcctggttggaatggatcaaatattccatgtgcacgttaaacaaaagcaattgttatgcttgtgcacatggcaggccagaggccctgattgtcccccttccactaaggtggtcctccagtcgacaaggcatggactgtgtggtagttcttttccaggattctacagcctggagtaataagtcatgccaagctctctctgctatatcccaaagtccggcaccctgcgggtcagcccccgagggctgtccagcctccgtctcccaacactaagttcacttcgtgtctctcacgacagggaggaaacttagcattccttggagacctgaagggatgcgatgagcttaagaattttcaagagcttatcaatcagtcagcccttgttcatcctcacgcggatgtgtggtggtattgtggtggacctttactgggcactctgccgaataactggagtggcacttatactttagtccaattggctatccctttcaccctggcatttcatcaaccagcaggagaaaaaataagacattgtaaagcgagagaagccccttgtaggtctttcaactctcatgtccatttagacgcaattggagtcccatgaggaataccagatcaatgtaaagcttgaaatcaaatagttacaggatttgagtcaatattttggtagatgacagttaataaaaatgtagattagtaaactacatctattacaaccaacagcagcaagcttttcatgagttaaaagaaaaactcacgtcagccccagccctggggctacctgacctaacaaaaccctttacaccctatgtgtcagaaaaagaaaaacatggcagttagagttttaacccagactgtaaggccctggccaaggccagtggcctatctctcaaaacaactagacggggtttccaaaggctggcctgcatgtctaagggccctagcagcaacagccctgttagcacaagaagcagataagctaactcttaggcaaaacctaaacataaagtccccccatgctgtggtgactttaataaataccaaaggacatcattagctaatgaatgctagactaactagataccaaagcttgctctgtgaaaatccccacataacaattgaagtttgcaacactctaaaccccgccaccttactcctggtatcagagagcccagttaaacataactgtgtagaggtattagactcagtttattctagtgggcccaacctccaagaccatccttaaacatcagtagaccgagagctgtacgtggatgggagcagcttcgccaacccttgcaaagtgactctgaagaagacgacaagccctgcttcagtcacacccagaagctaactggtccatgcacggccgaaacatgaggaaactcatcgcaggactcattttccttaaaatttggacttgtacagtaaggacttcaactgaccttcctcagactgagggctgttcccagtatatacatcaagtcactgaagtgggacaaaaggttgctacagtcctattattttacagttattataagtgtactggaactctaaaaaaacttgtttgtataatgttactctatacaaggtatgtagcccgggaaatgaccaacctgatgtgtgttatgacccatctgagcctcccatgaccatagtttttaaaataagattaaggactgaagactggtggaggctcataaacgatacaagtaaagtgttagccaaaacaaaacaaaacaaaaaaagaagtgcccaaacaagtcaccttgaaattcgatgcctgtgctgtcattaataataataggttaaaaataggatgtggttctcttaattaagaaagaggctatatggcagaaaataagtacatttatcataaattaagactgtgtaaaaataaatgtggatactggtcttgtgtcatttaggctacttggataaaaaaaaaaaatcctgtccaccttcagcaagggaaaagtggcccttcctgtaccagtggtcagtgtaaccccttagaactagtaataaccaacccccttaatcctcactagaaaaaagaggaacgtgtaaccctaaaaattgatggagctggactggatcttcaagtaaatgtcgtggtttgaggaaaagtttataaacgctctcctgagccagtatttcaaaccttctatgatgaactgaatgtgtcagtaccagaaattccaggaaaaacaggaaatttgtttttgcaattagccgagcatatagcccagtctctcagtgtcacttcgtgttatgtatcagcacaagtgtaaatatgtgaatcattatcaatctattgcacaggaagacataagtagcaaaaataagagtgagaactcccactaataaaaagtgagagtctcaaaggggggaaatgagagaagagagacagaccctctcatattgttttatattgttttatactcagaaaaggaaagagaagcaaaactaaaggcaggtagcccggcgcctagcaaccagacgtgaaaccaaggaaccagacctgaaaccgggcctgggcctgcctgacccaagcctggtagttaaaattccacccctgacctagcaactgatgttatctatagattataggaagacattgtaaaacttcccagtctgttctgtttcactctaaccaccggtgcatgaagcccctgtcatgtaccccctgcttgctcaattgatcatgaccctctcacgtggacccccccaccttagagttatgagcctttaaaagggacaggaattgctcattcagggagctcggctcttgagacaggagtcttgccgatgcccccagccgaataaaccccttccgtctttaacttggtgtctgaggagttttgtctgcggctcgtcctgctacccaattttctctgcgattattttccttctaaccctttcttaaagtgatgggctctaaaaaatcatgattcagctgctattgcaattttacctagccagtgaatttatttattttgagatgctttttgatattattgtcattgtcaaatgacattatgacatttcaaaagacattggctgtcagccagtgggatctagtcttaactcatctttggtgctcaccggtcataaagctgtagtcacatgtgtttatttcccccagcactcttccctcatttccttcctttccttcctgaaatttcctcttccagtggtgcaaaagctggtgagtaagtactgacaaaaccaatgcctcttccaatgtctctattcatttccttcctgtccatccctataagcttaactgtacatccatggttattttcaactttgagttaacatcgtagaatcaaacacttaagatattcaggtaattctgaataccatatgctatggtttgaatgtgtctcccaaaattcgtttgttggaaacttaatccccaatgcagcagtactgggatgtggggcttaatggtaaagcccttacgaatggattaatgccgctattaaaagggtttgtggaagtgggttcttcctctcctgctcttttgccatgtgaggacatagcattcctcccttccagaggacacaggcttcaaggtgccattttggaaacagagataccaggcccctaacctgctctctgttcttcttttttttttttttagatggagtctcagtctgtcgcccaggctggagtgcagtggtgtgatctctgctcaccgcaacctctgccgcccgggttcaagcaattctcctgcctcagcctcccgagtagctgggattacaggcgtctgccaccgtgcccagctaatttttgtatttttagtagagacggggtttcaccatcttggccaggctggtcttgaactcctaatgtcgtgatccacccgcctcagcctcccaaagttctgggtttacaggcgtgagccaccgtacctggcctaaatcgctgttctttataaattacttagtctcaagaattctgttatagcagcacaaaatggactaaaacatcatggttcctgcttttttggctcactaagtgttcgtggcttttctctttcaaaattttattgctaaaataaataaagatgtcactactttacaataattcatcacattccatttttttgtaagaaatagtaaaagttggatttctatgcccttgaaaaagaactctatccttgaggcaatctgaaactaagcatttaacaacttgaaaaattagatcacaaccctctgaccaaacaccagaaagttttatactgaaattcagatactctttgcttgtttattggcagggaaaaagccaaaatatcaagaaagccagcacaaatatgagtagtaatatccccttagctaacatagatttgcaccacccatctaccttctatcatgtcatcctttttatttctttcattttatgtatgagtctttgaaatgtttgtgtttttaaaaaccttttatttttttatttccttcattaaaatgtaagctctccaagggcaggcctttatgctcatatttaccaccaatttgctgctgcctagagcagctcctggcacacagaatgacctcaaaaaataccagtggaatgaaagagtaatgaaagaaatgactcatctggttttactccaaaagaagtagttctaattttttttaatgcttaaagaaagccaaatggatatacatataggatttccagtgtcataaaagtaacaaaattagcttactcttccaaactcttattttattaatattttttaataataaaaaattatagaatgcttcatgaatttgtcatccttgcattggggccatgctaatcttctttgtatcattccagttttagtctatgtgctgctgaaacaagcaccaaactcttaaaattagcttaggttcagagtgaagagctgaagttgcagaccagacccaagctgttttgggactatgaaggacattaagggctctgtttatttgagcaaaatctatgggtgaggcttacctgctttctgccaattttccttgtacaacagctgatgtcagagggtggttggataaggagcttggagccgttggtaaggaagttcttatcactttcttgcaggctccttttacctctagtcttctatgactcaagggtcattcagtgccaaatgaaattctgcctctgtggtaactgctagaaagtccagtgatgatctgatttctagtaacaactattggccatatccccaggaggagataagaattgtgtctattaggaaataattttccatggatctatcacctttttgtacctcttgtgagctggagcactgaatgattttattccagactattccccaggatgtttgtatagcaaacagtcttgggagatagaggtagtatctcgcgccaggggagaaggcaggtttgtttgttgttcattatattaaagacaatgtcttcctccagggcaaaagttgggcaggctaacttgcagtccattataaaagattcagatttcctaagcttggagttgcttaggtatgatgcaaatctcctgagtgtgcaaacatggacctaggatgctccgtaggacttcgagaacaaggggaaccaacagaacatgaaacacataccatttgagtaaaaacagcctttatctttgattcaggtgtcttctgccagcattcatgaaacgaaactggcaaatagcaaaaatctgaaacatttcactgttcttgatagtttcacatgctccatccatgccagggtcccttatttcctgcaaaataaaaaaattctgacaaagagtgcatatgggacagggtgaccttcactgggaagcggaagtgaagccccaagttcatggtgggagatcagtggtaatgaacagaggtatgtcatagtgtaggaaacagatgaaattgccaatgtgaagataagtcattagtgttaagaataaaaatgctagttcatttcacattcacatactgtttgttcacataagatgctccataaatgttattgaataaatggatttatatccttcttgcttgcaaaaatggtatgaagaggtttccagtaaaaaacacagataatgaatttattcaaagaagagtgggaagaggcgattcaggacaagaagggaagaaggaccccaatcccccatcccctaccaccctgtccttccataagagtgagaattttgtcaggcattttaaaaagttcacctcactaatcctcaaaggacccttaagattgctctcagataaggaaactgcatagaagataggaagagcatctgtgagtataagatatgtacagtatctggctccgatctgcctttgcaaggaaatggcagagccaggatttgaactcaggttatctggcttcaaggtactacatgttttttgtttgtttgtttgtttgttttttgtttttgttttgttttatatgactgagtttttttactctatcacccaggctggagtgcagtggcgcaatctcggttcactgcaacctccgcctcccaggttcaagtgattctcttgcctcagcctcccgagtagctgggattacaggcacccgccaccatgaccagctaatttttctatttttagtagagatgaggtttcactacattggccaggctggtctcgaactcctgacctcaggtgatccgcctgcctcggcctcccacagtgctgggattacaggcgtgagccactgcgcctgacctctacatgtttttttttttttttttttttttttacaggacaccacattgacagtgtcagcccaaaactagaccaagaacacttgggcacactgagctcagggcttagcccaaagttttctgaaagcatgccagagggaaagctggatgaaatgctttggtaaagaagaaagcacatcagctcatcactcatctgacaatagaaaggactgatcaggaagtggggaaaaggagaatagtggcaaaacatagaaaagagaaaaaaaaagactgaaatttttaatggagcgcaaaatcagacatatttttttacttttttgaacttctttagagactacaataataattcttatgtgataagtccaataagctatgatgatgttttattaaatgtaccatcatactagcagcttttgcagaatttgcatcagaagaaaagtataagatattaccaccatgacttggcaaaagcggtatactatattaatgttagccacttagttgctgtcattgtttctcagcacagtacccattgcctagtttccctgggagttcttgaaagctctattgaaaagttatatttaaagtgtaagttagagtgtgctgtgaatggagagaaaattgtttttctttttgtaaaaaattcactttccttgggactatatactaagttagctcagttatttgacagaaccagtatcttattttacaaagagaaaaacatagatctagaaatttccagaagcagatcactggttgaaagggcggggcgggggggggcatgtgattgaatgtgatttgaaggcagttttaattttatgacactttacagtgtgtgtgtgtgtgtgtgtgtgtatgtgttttaatgataacctaattttattgtcccagacttaaagatctgtgccacctggagaaactacagttcatccattagcatgtaaatctgttaagagtatttttgcttgaatttctccgagaaggctcccggctttgttctgtacagacacacagtcccgacgctgttcttaatatcctgttttcatttgtcagcgctgttgtccttttcattgccatgttcccatcattcctcttctttcatgtggtgctttacaataacattcagaacaaaagagtcactcctctttctgttgcctttaaaaaaaaaaaaaaaagacttcttcccctgactgcagagcttcagtgatcaggggaaatgtttaaagcatgttattcgtaatagttaaccaggagttgtgaataagggttcgttttccttactttttaagatcaggaggtagcttcagggtattgtgagcaaaaggtttttgtgtgtggctgactttgaagttgagggaaaaagcgattttctttgagaaaaggaggcatcatatttgagagaatttccaatctgctcacacaatgggaatcagttactctataacatcgtcattacctccatgagtcacgagactagtatttgttcttgtctttgaacttaagctttccagtgttcagagaacagttgtgaaatgttgcattggccatcatcaataactattttgctcctggttggtaataattgggaaggggagggtgtgtactttctctgccttctaggagagtattatataaataaagtgagaaaaagtttccccaagcggcaagcttttctccagggcacaatctattatacttgctgcaaaaatcccacttgactggtctttcagagaatagatcacttgcgtcattttgctcatttccaggtgaccttttgcagatatgagcaggcagttgtttttaaataaacattatctacaggtttctgtttctgcactaaggaaggaatgtttctgtaatgcagaagggatgctatgactgaggggtttgtgaagagtgaattctagccagtctcaaataattctgaaaaggtgcttttgtatatgtatatgtgtacttatgtatacatgcacattgtatataactacaaaaactaattccattatggacatatataggactttatacagacatagttatatgaatatatatagaaatacctatcaaactataaatacatttgagaaagcattcagggacagcagtgttaaaagcttttcatctgtgactggtttcacagaaattagtgacttccatttctgctaccatcacgctgttggtctgttcaccaggagggttgatttagacttctgccaggagactaggtgtggccatctctcaccctcttcctctctgtccagtctgctatcattgccttcagaaccaaattcttgcatgatacccagtacagcatagacctggaaaacatcggtcattttcaatataatgtaaaataggttctgtgtgcctttaaaactaaatgctttatttcttaaactgtaaaagacatgaaatgtctgagacattcagatagtgggaaatttcatctgcaagttgtcagattatgccctttagaagattgtaattttttttgttgtttatcattttctcttgaggggtggagtaaatatttctttcctgatgtttcaacttcagatgttcaggctaattttccactacagtgccaaaatagggaaaagttaggcctgtagaattttgacaatttaaatgttgttttaacaaaagccatgtcttgatgaaaagttctttagaattctacttgatgatctatgtgtgtctcttccgaggacaatgagaacttcttaaggaagtcatctatatgtgaaattgagtaatccttttattcattgttaaaagacaaatgaagttataatttggagagacataagccaaaaaatctatgtttgcatttttatgtcctaacatgtgaagcatgctttgatttactgtgaagtgttgcaatggcaataaagtagatgttgagacgtgcagactgggcagcccgaggaagcagttcttgcctctgcttcccctttatcatgaatgttccttaaacacctttggtggagtccaaatgtctggattatgaattgaattgtgcaagattctttttttaaacactttcctgatgatttactttacttgcagtttcttgtcttgcatggtgataagcaatatccttcaaagaactgcagcgcaggactttttttttttttttttcttttaggaagactacttccccttcctcctttagtcaatcaaattttaaaagattacttctttccattctcagttcaccctttctttgccattctggagactgaaattttggacacccatcacagatttgctattatatatataccgtgtatgtaatattaaatatatatatatatatacacacacgatgtttttatatatgtgtgtacataatgtatgcatacgtgtgtatgtgaaacctgtgtgtatatacatatattttaaattgtttatcaggatgatagattgctatttaggtcactatttttggaagaaataaatgactgttctttgtgtctgtactggagattgttcttcctgatataactttgaagaaaacttcttccagacattatacattaattcagaagataaaggcacaaaataatgtgtatattatttttttaaatgaacaagccagcatgcagagcataatgtgatcatgtgctcagtacgacactgaaaggccccaaaggcaaatgagtctagtgcctgttcccagccccaggagctgggcaggacggctcctattggtggcattgaaagctagcattcagccttctgccacaggacagtgtctcattcggccaagctgctgctggtccctgtaaggaatgagagtacagatcccgttgccaagtcctcatttttttggaccaggcagtgggtgttgagctgacctgagctacctttccatttgggttcagttgaacattgagtaggccagaggatagggaagttgtggcgggggccgtggaaaaggcagttgattcttcaactcgggcaaccctggcggagtggatgaggtggagctggccttcctggaattgttggaccgattttcctgttgtgtttcactgttgacgcactcacagacacacaggaccgctccagcactgcctgccacccaccgtctggtctcggtggcctgtctatcatttcgtgggtccccatcctctgcctacggcgatgtttcttcaaaaagaactagtgtgcagtccattggtgggtattcaaggtgatctctttgtcagaatctagagaggtgctcaaagaactattaaggaccaatgtactagttcctgtttttaacctgtttatcagtctttcaattgaacaaattggatttctgaaactgctgaggggttttctgcactattaggacagaacaggatagggtggttgttcctccaggaatctgggttgttcttttgcattgccatttgtctttgtgcttgtctgcttgtataaatgaacctcgagaaggagtgtttaagtattctgttaagtaaatttggaagactaggtttcaattaaaataaccagacagtgtgacccagcttccatttccccttaattttgatcattaaagccttcatatccccacagacatctgccatgcttcgaagtgattcttctcaggaatgttcattcattattaatcaggttgcatggtcaggcgagtatgtgattattttaaagaatgtcctagagatccagttactaagaatgagcatgttataggcagatgtgaaagtacagaaaagatttggttaacagtttaatttgatttgcatgaattccaccaggtgggtgtttggcgaaattaaaagtcttccctggttctcacttcagatatgaggtaaaaaaataataataataataataatttcagcacttcttaaagaagaaatgtcaagttattcaaaatatctattgtattaattattttaaaacttgaggctagcatctcagtgctcatctgcttgtcacttttttttttcaaacagtccctctggtcccctacaattttcttggcagaaattcttagttgtctgttactggttgagcaaatgaatttgagtgtgctgacatttggaggctaaatgcagtgataattcagagtaacattctttacctataaaatgttactggatcaccttttttcacctgttcttacttgatgtattatttatactgttgtttttaagaaccactttgcgtttgtactgaaacagcctacattatgctatcaatttccagtctttcagaatgcagttaaatccaactggatccccttctcccctttttccatcagttcatggccctgttttactgtgcctttgctaacccacctgcttctcaaattggccagagtgctaatcagtaaagtaacatttgggtagtgtctttattcggtggtctttatcactcaaagtcaaatactaaatggcataattgaatatgcagatgctgagtgcttgtattatgttattcaaaataccctatgatgaattcatcttggatgtagcagccagtttttattgagtttgtgttagacaagtttttgagttgagaaattatgcttatttaagatgagagcaagtcccttctgagttgggtccccgttgcaatctgcctcccaaactcaggttgatttccagtgtttcacacttcagtagttttgagtcctctgaaagtctgtatttctgctggtccaagatagaaacatcactctgcagtctttaaaaaatatttcacctatagttctataataaagataatctcatagcaaaaatccaaacagcaatagtcaactaaatctaattacccaggtgaataggggttaagaggagcggacaatcaagtaaattgacttgatttcgtttctgaaatttaggactctcaaataattcatttgtacattttcaatgctatttgttgtttgaaatacttataggagcttcctgttctgaaaccattttcgtgtggcttgctgtaacatcgtgcaattttaacagtgtgtttgtcatctcagttatgttttggtaaatttaacaataaagttagtctctatagtccagaggatatttggaaaagaactagaggaagtgccttgggaatcatctgggcagtggctgacagccacgtggtattaacgattaatcacaggccacccagtgttggcatacaagtttattccttggtctaatgactcactaatttccctggtagtgaaggctttagagttgtacaaagtgaggggctggaagtaaaattattgatagaattgatagaattgcatgttctttttcatatactccaaattagaaaaataattgtatttcatggagtatgcagacataacctagaatacttgtaggaaagcattgagaggtgggtttaccttatcattaaaaaggtcaatgcctccattaagggaaatttgggataaaaattatggatgatgtgctgatgatgggcgatctccttattctaatggatgctgtaacaagttagcacaaacctgatggtgttaaacaatgcaaattcattatcttacatttctagagtcaaaagtctgacacaggtctcactgggctaagagtaaggtatctttagggctgtattccttttgggggcccttggggagaattcatttccttgccttttccagcttctagcctgcattccttggcttgtggccccttcctccatcttcaaggccaggcatggctggtcgagtctttgtcatatctcatcattctgactctgactcttcttcctgccacttccacgtttaaagagccttgtgattcctttgggtccacctagatgatccatgctgctctccccatctcaaggtcagctacttagcaatcttaattatatcagcaacagtcagtcccctttgctctataacctaaaatattcacaagctctgaggaggaggctgtggatatctttggggaccataattgtgcctcccccaaagagggaggagtagaaactgtggtgtctgctgtctggtgaccaggaggacagaagccctgtgaggagacaccaggagccctgtagagaagacaaagacaggctaatgagggaagaggataaatcccacatcatgtgcattccaagtctgaggcacttgcagtacatgaagcaaagaactgtcagtgctaaaccgggttccagaaaggggttctcgaccatcttgggatacaagcctagcagtcattctcagagaggcagtacatgaaacaaacaaaaaactggatggccctgtcaaaggaaccatagaccatcagaaaacacttaggctttgattagcaagaggtagaagtcagcagtggttagacagaggaaaactaggaaagtacagtttcagtgacatacagtgatgtggtttgtttgtccccaccaaaactcatgttgaaatgtaatccccaatgtggtggcattgggaggaggggcctagtgggagatgtctgggtcatggggatggatccttcacaaatcgcttgatgcccttcttgaggtagtcagttcttgctctcatggagactagattggttctcacaggagtggattagttcccatgagaatggagttgttataaagcaaagttccttctcttgagcagatgccagtaccatgcttcttgtacttcccagcctgtggagccacgagctaaataaacctcttttgtttataaatcgcccagcctcaggtattctgttatagcaacacaaaatggactaagatacatattatgagagaggaaaggaaaggaagaagagggaggtgtgaaaacatttacatcattattttccagcaaaacatctacttattaattttccattttaaagaagtactttcctcataagtcttgaatctataagaaagttttttcaaaagatgtatccaatgcctcccacgatgtggggcttcactgtaatctgtcactgaagactctcctgcctaggggagtgattagagtgagtgctagagggactgtagggaacatctgtggacactcacccatggatactcagacagctaataagtagcagaactgcaggatgtcttagattatcccgtcacctgtccagctctctcccctttcattcattattctgtgctgtgttctagatgtttaaaccatggacaggcagaggtgtgagctgtgatttgttgccattcccagtttgttgcaagggactctcaagattatctagatcctcttctcaatgaggaccaatctgcccattcacaaaaatgttaagctataggatttcctgacaacaatatgcatgtgtgatttccttttattgaagtagaaatgaagaagtttttttttttttttgaggcatggaaattacattatgacagttaagaaaaggcaaaagctgctgttttatgatattggggtttttgttgttgttgtttgtttgttttgagacagagtcttgctctgttgcccaggctggagtgcagtggcatgatttcagctcactgcaacctctgcctcctgggttcaagtgattctcctgcctcagcctcccgagtagatggaatcacaggcgcacgccaccacacccagctaattttttgtatttttagtagagacggggtttcaccacgttagccaggctggtctcgaactcctgacctcaagcgattcacccaccttggcctcccaaagtgctgggattacaggtgtgagccaccatgcccggcctgatactgttattaatgatataaataacaatgtaagctatatatatatgtgtgtgtgtgtgtgtgtgtgtgtgtgtgtgtattagatacatatatatatagagagagagagagaaagagagagagaaagggagagagaaagagagagagagagagagagagagtgaaaagaaagataacattttgcataaaattcccacccatgtaccactatctgcttggtgaatccctgttcatcttttaaaacccacttcatactttacctccttcaggaagcttctccctgtctcctctccccctatatagagttgattattccctgtctgtctttggcatgcatctttttttatgttgcattacaccttgttcatttttttttctcgatatgggctcactctgttgcccaggctgtagtgcattggcatgatcacggttcattgcagcctcagcctcccaagtatctgggaccacaggcatgtgccaccactcctggctaatttttttatttttattttttggtagagatagggtctcactatgttgcccaggctggtctcaaactcctgggatcaagtgattatcccacttcagcctcccaaagtgctgggattacaggcatgagccaccacacctggccttgttcatattttctctctcggaatgaaccataagatcatggagacaggggccagctgttaccagtacttgtctcaggaccaagtacatagatgaacttaagtatttggtgaaagaatgaatggcaaaaaaaaaaaaaaaaggaatgaatggcattttaatttctccaaaaagatattttaaagaaagctagaaaataaaccatactaagtttcttttagaagaaggaatggaatgagtacaaataagatactgtagagtcatttaacaaaaatgctatctatgccattgtaaaatctgggtaaaagtggaaaaagtgggatgcactatagatatcaaaccaaaaccccttcctttttggtagcatacaggcaaaagatttagaaaattggctgaaattcacctaccacatctgagtattgtgtcttcacctaatacaattaaccatttacagtacagacacttgcataaagcactatgccaggtgctatggcagtaaaagaaaatatctagttttgagcagctactattaattcgttcttacatgagttgcccctaagcactcgagtcacataatttccattgatgtcagattcaaagcccattgcatatcatttcccattagcactggaaacttgtaagtgcttgttcaagtcttgctccgccatccttgctgctgttgcccacacagcattttattcatacctctctgagaatgattttcatttatgttctggttatctgtatatgcctctatcttccaatacatggctcaacaaaataagatgtgcaggccaatgctggcctgtgacctgtttttctaaatatggttatgttggaacacagccatactcattcctttatgtattgtgtctgattgcttttgcactacagtggtagattgagtagttgcaacagggcccctttggcccacaaagccaaaaatgtctactattttaccctttatagaaaaagtttgttgacctctgttcaaatatattgagagatccttaaagtcaagggctgtgtttgattctttttggttttagctgaaaagtcagtacatttaatggaatcaatgaatgtttgagtcattttgtgtgctgagtgctgttctaggtgttggtggtacgttcttcaaagagcaaagcaaaatctctgctttcacagagcttatattctagtgttgaggacagtggggacagaaggagcaataaacaaactaaaagaatatgtcagtgataaatattataaagaaaaataaaccgagatgggggaagaattaccacgatgggtaggtggtatagtggtagaaggggaattggttttatgtgggttcagagagaaagtgacactggagcagagagtcatgtggattctgaagaccttgcaggggcgagcaggggattgatgtgcttggcatgtttgaggagtcagaacgaggccatgtgctcagagcagagaaaggagtgggtagcgtgggaggaagtgagctcactgtctgagtctgtgttttctggggctggtttattctggtgaatttctctctgggtgaaatgggaagcccttacagggcagagcaaaaggagatgcatgttctgtcatgttttaacaacaggctctcttgcttctgagtggaggatagactatagggggaagggcaggagtgaacagaagccaagagaccatttagaaaggtcttatgatagtccacataagagatgatgctggcttggcccatgataatagagatgaggtgatgtgaaccccagattctggcttcttcatctaactcagtgcctggcacacagtaaacatctgttgaaggaatgaataaaatgtcagtatttccactgaggtctccccagtggaatcctttctagaaattctcatcacacctctctgggatggaatcctggcacctgcattaaaaatatagtcatcatagctctccagacataatttgatgctcatccttctattcagattcattggtaggcattcttgttttatctgagaacagagcagaccaaaagggctacatttttcctttaatttatatgcttctgatgagaaggtaaaagaactttgatttaaagataattctacattttttctatgattaaccaaaataattattaataggtaaaaacctttccatttcttctgagccatctgtaggaagaggtgacagaccaagtggggatgatatgtttcttacaacagcaaccctagggtttccattgcaggttgtagaaagatgtacaagctttaatatttcaagtcacagttgctcttttattctttcctatataataaatgctagtgaatggttgaagattttttaagataccaggcttttatgaagccagtagctgtttaatttttaacaggctcgggacatactttatacttttaatgatcagttaccattcagttggtagcaagatgagcattaatttcaccaaagcaccatattggtatttctgagggatgctatttcagaaggggtcagggtattctagaaaccgtgaattttgtaaataagcggaggtgtgaatacaaacgattgattgtcagaatcactaaacatagctttggatgtgaagccttcccataaatccggctgagaacgctctccccaccacccccgtgggtgatttgaacctcccgaccactgggtgaactgcactgttctcccacagcctgcaatgggctgcatgtaatattcccatcactggtctgcagacctctgctaatggtcttgaaagggagaaggttcaaagcggcttggttcccaggcctgctaatgagcatgaggcctcttcacccttaatgaactggggtttgtgtggaattctttctactactctttttgatgggaaggcagatgagagttcacaaaagcactcaggtctttatggcaaggggagcaggcagctgggccaccctcgggtggcctggaggagagcaacatagctagcagaggtcgtacccaggccaacatagctctgagtgtgaggctggacctcctgccagcctggcctgttgctggcaacagtgacaagcccgtggtgggagttttttggccaaaagggtccctcagcagttttgtaagcctccttaaattgctttctcaactgtaatcattatcattgtcataacataacttatcacatgaatatgatgaccactgaaatccttgttctaattaactaaatcattgctctaaatattagtcattggtactcaaacttactgcagccactgaaaaagcccccagatatttttctccacttcgttctgcctacccacgtcccactgctggattaaacaatagaattattcagaaacataatgaacacatgccaaaaatattgcctctatcacaatcatctttgtgaaagtcaatgttttttctcaggaatatattttggaaaatgacatcccacacttaaacacgatcatctctgctgaaatccccacatttgatttcatgtacatttcatgcccatttctatagttactgccttcctattgttctgaaacctggtttggtattgcagagtaaaagtccttaaatctcgtatacattaatacgtaagtttataaattcaaatttataaaagactctagtttattgatgaatatttctacattttaattttctgtgcgaggttaaacctgactctgacacaataagattattctgattaaatacaaattatggaaattacagtttcaattacattctagttttgaatgaagccttttaaaaaacaaaattgaaaaaaaaaattgcacattttcagttactgaactttgagaaaatgttaactggtatatgatggctcaggatgctttttcctccttttttccccagtgaatagaaagagaattatttggaatgtacacacacttaccctttcatgacctgtgtttggaattattctgagatgcattcaaagctgacacccccctatggttgacctccctgtgcctaatcaaatcttacattcttgtttccagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgt

SEQ ID NO: 2992 - DNA, 232429 bp, human
gattctatgcagggtcactatgaaagaggcagcctgccccagtttgggtattctgaagtgttagtatgtagtggagctggtggtgtgaagctgattcattttgtttcaaagccccaaatggcatgctgccgaacacaggcacaagcacagcagcgtctccttagaaataatgactccaaggcaaacagccctcattgcaaaatgtagaagactgccatctgcttgtctccactgtggtttattcgtttcagggttttaaatgacgtaataaaaaggtaagtcttctttttaaaaactggaggggtaagtgggaattccagattgattatagcatatctggaatatatgtaagatatttgccttaagttagaagaggatttgaatttataaagtgtgaatattattttcaaatgcaagtgcaaatcctgtcctgggaagataaggtaaaatccatatcttaaagaaggtcatgccttacaacttagcaattttatttggtattttagaaacatgatttttaaaaaaatgaattttcataaagacagtaattttccagatgtttgatagtacatatcgatcactttttcatatatgatattccaccttttcttgatgtttgcaatctgttttcagcttttggataagttaaaaacaagcagctgctataaattgtcaagggctcttaaaatgaggtgccagatagatttgggaagcgtctagctgatttctacataactcgtttggaattactctgttatgggagggagtataaagggtcataagactcagatgaagtttgaagctgaggtgtcccctctcccatccctgagggatagtgaccagggtttggagatataggaagaagcaaatgcacacctccgtgcctcgccatgacctatcgtattccagtcgatgaggagtccagagggctgggatccatgactccctgaggattcgcctggcaggaatgaatgccagcaaacaccccccttccacccctcccctcctagctccccaggagaggcgcttctgcagaagtcatttggtgtgtgtgctggttttccttgtgagaggattagagaataggagagtgctttgtgagaaaaatcctgggagaggttgctgggaagaaatcaaacagagggaaggaagacttcagctttcagagtcccctcagtcaagtaagtctgagacccagttgcctggcctagagcagctgaggggttgtttcctttcgtccacactaggagaaactggtaaggctcattttattctctactgctctgggatgctactgtaattgctttactgaagcgcaggggtcagaagggagggaagttggttagtgactctgcggacgtcctgcatcgtctctgtctggtgtatgaggacggcgctgtttctggtacaaagggctggtagccacagaacaattttacttttcccaaacttgattagcatcacttctgagcaactgacttaagcaaaacgcatgcccacgcaaaaactataccccatagaggaatgcacttatctatcagatactcggatctttaaagcatttctatctcaatttgattagtttggggggtacaacttcaggagagtgagagaaaaacccggtccttctggaaatttttcaattgtctgtttcctgtgagaatgtatttttgccattgtatgtatcacctgttttgtaacaagagccgttcagatccaagccactgttaaaaatccaagtagtacctagcgcaagttcaagacactgtgaaaggaggggagagtgttcacactcaagtgaggaaaatggaacttgaagaactttatattctttgtctgtatgcagaggagttctaattggaaagaagaaatgaggaagctgccctagagtcagaaagaataggtacacgtttccttcaacattttcaaagaatcagctcatgcacacagccttcttgggcaaatgttgcttcttactccctaattccattctgttatttctagagctgactttcatatttgtgtgaagatatatatagaatacattatttatattacttatatatttaaaatgtatatgtatacacacacatataaatatatccttttatcatatcctggcaaacttgagcctgaagagtttagaaatatattgattcagtctgaagcaaattatcccttaagcaagctacaaaagtccttctgagaggcgtgtttggagttgggggctgtgtgaagaagagagaagtggcagacagctgttgtttctgtgatggacaagtccagaagcctttcctcatagctgagaaccaaattcctaaaaactctgcgcaccctcccccatccccaagacagggtggtaatctttgttgttgtttttgccctgagaaaatttgagtgctgcctaatttagggggctctctgcattttttcctcctcattaaaataaaactagaagcattgctaaatgcaaagttctgatgatggatgttttgtttctaaacttaacatatgccaatacacttattatcatttcagttgaatctgcccatcatgaaaacactgatcaagtaaaatgattcaacacaaattattcaagtctgcaactgttacttcagtttacttaattctacagtcttaagatgatgtgcttattagaatattcaaaaattgaaaatgcatgccatttatttcattaataacaaccaggttatttaaactataggttataaaatataggtttcaactacaggttataaactatttaaatacagtttctttgcatgcacattgatatgaaaacctgaaaaaatatatgctttttcttttaaaatgaaataattatttgcctgagatatcctttgccaaaaaatgaaagtcaattccctttcaatttcagttttttattcttttctcaactgaaaatgctaattcaaccaaacgatgttatctttgcctttaggaattgtttacggaatgctggcagtcaatttgggagtcctgagtgtgagataacagttaatcaatttatctgtgaactgtgaagttttcaggttttgatcaacattattcactattctccaccccatgctcattctggttataaagactatttaccttcattattatatttgaacctgagagcgtcaagtttattagaattgattttctttccaggttgatcttctgaaatactttggccatttttcactactgccttatgaggttatcattaatctggcatatatttattgagtgcttgggtgtcactcatatggcacacgtttgctgttagagatgaaagctatgttttgtggagtttattgcagaggcgaccaaggctagaagggaaagaccaactcgtgctgttctaacaattgtttgccagctcccgtggttcagttgcgaatgtggtttcagcaacaacgaaaaactcttaattcttctgaattattgatacattaaaatatgttactggctacttggaacctgtgagctgagttaatcaataaccctctcacattgcacaagacccactgtgtgttattctcatcactggccatttaaataattcaaaagaaaggtttctcgtgaattaaccttgccattgcacaaattgggaaaatacagaacaaaacattccagcatccttaatctttagagcttataaattactgttccttctcatttttttcttgatgtattagttttttctgttagatgacttttgttaaatgttttgatatatcataataatacacataatttgcaataatgtcagtaagaaaaaagaatcatgggaaagaaatgaacatgtcttgaatccaccatataccagacactgccctggcccctttacaagcatgttatcatttactcttctcaacaatactgcaaaataggtattattgggcccattttaaagatgatggaatgaaggaccagagaatttaagaataaattcatgccacactactaaggtagcaaacccaaatctgttccctgctccacaaaagcactttttagcacacttctatattgctctcttaccagccatgtctttcttcccagatctcgtatcaattgagaactcactatagcttaccttaatgcttccagagaatctcccttgacagcttctgcctgttccctatcttcctttatgatcagagagccaacacatgtaactatggattggacaggcaccatatgtatttacgtgtaaaaatggcttttgaaacatcaaggtagaaacatcatattaggttaaaatacagaatacagtattttagatttgctcagttaagagaaattacagacttggtttagtttggtttctggccatgcctgccctggtttccaccagctatccagtagggagccccggtctgcatgtacgctgtgacatatttgtttgtatagagatctgcttgtataaagatctaggtttctataccgacacagcctcactttctgcccccagcaggtgagcagaagacaggatggagttgtagaaaaatgcatcccttacccccatctgaagttactggttgagggaaagaaaatcataacacatcattaataaaaagaattctaaatatatcagtgcattagtctggtactctcatagtatagtcattcatttaccgcaacacaattatttagtcagcactatctatccaattgccttgtgtactagtttccgatggctgctgtaataaattaccacaaattattaaaaatttaaacaacacggccaggcgcagtggctcatacttgtaatcccagcacattgggaggctgaggcaggaagatcacttgagcctaggagttcaagaccagcttgggaagcatagagaaacccctcctctgcaaaaaaaataaaaagttaactgggtgtggtagcacatgcctgtggtcccaactacttgggaggctaaggagggaggatcctttgaggccaggagtttgaggctgcaatgagctataatcatgccactgcactccagcctgcccatctcaaaaaaaaattaaacaacacaaatttattttattacattcctggaggtctgaagcacaaaatggatctaaaatcaaggtatcagcaggcctgcattccttctgaaggctctagacaagaatctgttccctgcttttccaacttcaagaggcttctggcactccttggctcatggcgctgcatgtttctgactctgcttcattcgtcacattgccttctctgactcttctgcctccctctttccactataaggacctgtgcaattacactggggccaccaggtgaccccatggaaatcttcccatcttgcatccttagatctaaccatattgaaggatgtcgaaggatgtggttaaacatccttagccacatctgcaaggtcccttttgccatgtaacataacacatacaaaagtttgggagattagaacgtggacaactttggtggggagcattgttctgactaccacatcttctttcaattttttttttttttgagacaggatctcgctctgtcacccagattggagtgcagtggtgcaaacatggctcactgcagcctcaacttcctgtggtcaagtgatcctcccacctcagcctcctgagtagctgggactataggcatgcaccaccacgctcagctaatttttgtattttttgcagacatggggtttcaccatgttgcctaggctggtctggaactcctgggctcaagcggtccacctgccacagcctcccaaagtgctagggttataggtgtgagccaccatgcccagacacaaatttctttatattaacttgatatgtatttattccatgatcttgtaggcagtagggagccatggaaatatttcaagtggagaggtgaaatgaaaatgatcaggtttccatgttagaaagctcactgagagagccctatggagatggaggcccaactaggctgcctgttggaatgcaggagagagaggtcgagaacatgacttctgagagaatctgtagagaaaaggacaagaagtttgagaaatactaaggacagtgcattggcaggacagctgagaggaagaggtttgtgacttggatatctcaggtagatgatggggaggtagagaggatgggggactctgagaagatgtgtgtatgctgcactaggacctggggatagaacaccggccagaaacaccttttctcctaagaagctaaaagcccatctgtgaagacaccagtaataataataggaataactcatattcactgagtactttagcttcttccaagcacactacatttaattttcatatcaaccctctttggtagacactagtaacattatcatctcagttttctgatgaagaaactgaagcaaggagaccttacgtgatttgcccaacatcatgcaatttgtaaggagagagaaggcagttgaagtcaagtagtctggttccagaatccatggttttaattcttacactctactgccttgcttaacaaacaattataattttgtgagatatttagtatgagagctacctgtacatttaatgggggcgggagcaaaccacagggttagcaattactgctatcaagatgaactgtgaatttttctgaggcacattcctgtagaagcctggctatcagtagggtgtgatccatgacaaaataaaacatttatatggagcattagcctggaagcctggacatcagggcaaaattggagaaagttcttatttccctgctgtctaagaatttataaccacactgagaaaaccatattgcaatcataaaaaatagatgaccaaaaattaaatggttccaaggccctctggataaatatgaagtgagagcatagttcttttctaaaagagagtgggaaagaacaaggcaataagaaggtcaagatgatgggatgcagagccattgtgtacattcattgaatgacttaatgtgttatgcacttgcattctcccatttccaacaacactataaaataatggcagggtgaaatttgaatcccaaggtctctcactctgctatgtgtgtgtttaaagaatgttgggacagagctccctttgaataaaatttttaaatgccttaggaatcctaaaatgatgcttacattttgtaagatcttgataccttgacgtagttgttcttcattatcattatcattgactagttgttgggtggagctgccctgggcgtgtgaagatttcagtatcactcaatataggtgggtctttaaaagaaaatcatgccaagaaagatagatgtaaacttatttttttttacattctcttttattttctttaatattctgtatctttgtagaagctataatatggaattatagactatttacttatgggctttaaaaagcactgtggtaatcattaggtaataaatttcttaccaagagatattactgaaaggaatgtggtttttattcttttatagccagatcaccaggaagatatgagaccttgccatttaagtttgctttttaatttgtgtaacagaaagattcacatttaaccttttctactagacatgtatttaacaaacaattatttggtatctactatgtgaaagggacacattttattccatttgttccttgcaattcttgttcggaaagaccctctttacagtggaagaaggagaatctcagagaatggcccagctagacttgaactcctgtcttctgtctcagcccagaagacttgctcccatgtcctttaacctacttagctaagacagatattcaaagccactgaggaaggactccatatttcttcatttggaacagcaaactaggagagtttggttatatccccatgaccaatggtaggtatatcttggggcaattatctctatgctaaaatcaatattgctatttatcaagataatctacagcttgccttaaagatagagaggggatttcaaagtctatttgttgaaaagattactctctggaattgtagaatttgcttcaaagtgagatttgcaaaaaatatgagatttataccatagctgtctacccaatccctgaaagatttccattcaaggtgacatctgttcaggcttacacactgcttacctatgtgttggtgaaacactttctgtgaaccttctaaatgttctcacagcactctgacttcacccaatactcatgacaagaagaggacaaagctagaattattataccagagtatctgaccctgggttcaatgctgagagtgggtcacaattagttttaatagaaaataacatataattactgacaggtgccttggggcatgggaaaatagcatttaaaataatgtttttagtgatacattgcctacaggatgacatcatgcaagcttaatggcaatgcttgaaggtgagaactgactatgatgttgaaagggaaagtttgttcagatttattcatccaccatcagggaatcaaacgtgtcctagatttcttttttttttttttttttttttttttattttgagacggagtctcactctgtcgcccaggccggactgcggactgcagtggtgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattataggcgtgagccaccgcgcccggccgtgtcctagatttctaagactaacgaaacaagaaactaaaatctactattgaaacctaaataaatacagttatcaatgtgctgataagatctgcaaagactaatagcataagcccttaatgaaaaattattttattcaatgacttaccaatacaaaggttagatatccttacatcaaagtaatactgtattattcttccctatagttctgtaccacaaggaaaaattagtgctttatttttgctaattcacaaatttgttaaagtgatcaacaaatttaatttccatatacatgtgtaacttcaaatgtacagaggcgtgaagctactgcaaacacaagcttgctcactaaattttatttgataatatctattgccttgccatataacagcaagagcaaacattctaaaacttctaagtaaaaggaaatcatccgtctttttaaattatgtgaactttaccttatttgtaaagtactgtatagaaccaagaaaagtgtgggaaattggaacataattggaacataataggcatttaagccttatattttcacaacaaaattgccttaaattaaaataaaaatgatatgcaaataggatttgtttatccaaatgtgggcaaaagggctgtaaagataccagtatgtattagaacgacatgaataatttattttataatgtaaaacctaataaagatttaatgatcacccataagcctttaaaattatgtgagtaatagcactatggcaagcaaatacaggcagctattacagctctaccaaaactctgtttataactctttgtatgttactttttggaaagggtgggtcacagaatgatgtaataaatggttgcaaagaagtttctgtcccaagatgcgtattcagtgaattctagagctcaagctgcttttctctaaaaccatgcaatacatgcctttgcttcaggactggactaaccattttctgatttataaatttaatgatttcaatattatggagtaacttcagtgaagaaaaattgttttaggggcttactttcctgcaacgattattgccctattgcttttaattccatttgaatgcatgctatggagtagttgagttaaatccatggcatcttggttattcttcacggatgagttccagttctttgggtgatacaactaaaagctcacaagatgctgtgtatcggcactgaaacaatcagtctttgagctttggggaaattactcaagcagcgaattaatcattgcgattctggtcccccttcacaaatgctaggtctccgaaaagactccccccacacacccctgttcctggtgctcttattaaaggtgtaaaatttcataaaactttagtaaaacattatgaattctctttttgtgcaatacagctggtatttcttccagacatatatttccataattaaacatcctaaaatacaaatcccattattatttgttatgtctagtcagtaattagacctcagctggtagggcaatttcagaacagagtttaccaatttacatactaatccagcagagtctggtgggacatgattagcatagattcagtcaacatcttaattagccctaatcccagcatgcactccgaggtgcctttaccccacccccactcatgtaggtcttgtttagctgactattttccttcaacaaattccagctcttccaaacatattttccagtgctctttttcacagaggagatgattacatctcaaagtggtgtgccagggaggacattttgtgtaaagccagggaaatgtgaggcattgggccaggcgaggggtgcatacacaagtctgaagcaaaatcaaggtaccagaatctgttcttctagaatgttagagtatacccacttccctgtcccacccccaactctaggtagcaagatctgtaaaccattccaaacctgtgagaattttacctattttgtaagaagaatattccttattcctgtccatgatcaggagcccatttcatcatttaccagctttcatgtcaggaaattccttatacctaaatgaaatcccccatattgcatatttaagcccctgcctttctatccatccatagtggaaacagagaacaggtggccacctatgaaaagctcgtcttatagctgaggaccgtaattaaattatctcctttaccttctcttcttcaggttggatttttccagctcctcgactttcctctgagctcccttttcttcacctctttgatctttgtggttttcctctgaactctttccaagttccccacaccccctttaattgtgctcagaactaggccgagtatctttgaaatcatttgaatggccagatttcctcaggataaataccaacacttgagtatacctccatatccaatttacttctagaatcagtgcctgctgttagttagctggctagtttcacttattcctcttccatttttcaaaaaactcatttggtgtgctattgcataatctagaggggatttcttctatttgctttttttttttttttttgcagtttatcaagggcactttgagtttcaatttcaatttgcaaagctataaactaccagtatctcctgctaaggtttgaagtcatttgcaaattcaatttgagcattaccaataaattattgcacaatcctaggggaaagacatcaatagcgactgagaagatcccaggagattatcacttgctaagaccttcatctcaagattcttctctctgctttccctgttctctgccactctttcccactttgacctttgtcttatgacatagcctttccctatttcactcttttttctctctctttttttatttttacttattctttctctctcatcgtgtcttgcgttttcactcaacactttccagccatcccctgcttgagattgttccccatccagaaaatgtgtctggtcatagggaagagacaatggaataagagaaacatcccaaacaattttcctttttggctttgtactgacctagctgaaatcaggtcacgtgtgtcacagaaaaaagcaagtcaaaagtgctgactgatggatataataaacatcagggcaaagaagtgaagatggctacttggccaggcggggtggctcacgcctataatcctggcactttgggaggccgaggtgggtggatcacttgagcccaggagtttgagaccagcccaagcaatatggcaagacctcgtctctacagaaaataagaaaattagctgggtgtggtggcgtgtgcctgcagtcccatctactccggagactgaggtgggaggattgcttgagcccaggagatcaaggctgcagtgagctaggattgcaccactacactccagcctgggcgacaaagcaagaatctgtctcaaaaaaaaaaaaaaaaagtggctatttgagtctagcagtgacaggtcaggaactgtttgcagcctcgaagcctcaagacctttctggccacacaaaaagagctagtcagagtgttgcgaggttcgtgtgtaaaagaaccagccgaattcacctccagactctagcttgacttgtcaggggccaagcatgtgttttgaattccagaaggtgtcccagcttgctttaaaagtcagggtctgtatcaatctctgtctagaggcttaagaatccttaagattataaaaggtttattcatatggttttggagatttttttgaaatagttgtacatctgtgagcaagaagcaagtgtgagggctttgacctagatgtcttcatagccaaaaatatctcttgctattaagagctacaaaaacggttcaaatatctcatattgttgcactacttcaggggctacagatggaagatcaaatgccaaggatgatgttgtgaatctctgtttgactggttggttgatttggtttgttttttatttttgtatggccgcttgaattgtgtgtgtgtatttgatgcaacttaaagttttaaatttcctcaccaataaataacttacattctagatgtttaattaatatgcatatccttaatctccttgtttcccattctaatttctgatggcttttctgaaatcatgtgaggcaaatacactctcccacttttcacctgaccagacccagaagtgtgtgcaagaaaggactttgatggttagtttagtaactaccaggagccatcacggaggctttaccagctcaagttaagaaaaggattattagtggaaatgaaatatggtgcagtcactttggaaatggtttggcagttcctcaaaaagttaaacataaggttaccatatgatccaacgagtgtacttttaggtatatatccaagagaaatgaaaacatatgttcacacaacaacatgtatatgaatgttcatagcagcattatttacaatagccaaaaagtggaaacagcgcaaatgtttatcagtggatgaatggataaataaaacgtagcatattgctgggcgtggtggctcatgcctataatcctagcactttgggaggccgaggcaggtggatcatttgaggtcaggagtttgagtccaccctggccaacatggtgaaaccaccatctctactaaaaatacaaaaaaataaaaatagctggacatggtggtacatgactgtaatcctagcttctcaggaggctgaggcaggagaatcgcttgaacccgggaggtggaggttgtggtgagccgagatcacaccattgcactccagcctgggcaacaagagccaaacactgtctcaaaacaaacaaacaaagaaacaaacagatacacacacaaaacaagcaaacaaacaaaaaccctcttttaactccatagttaaaaccatagttttgcattcctagctgtcatgagtgaagctgagatttaaaaaagtaatataggactatcacaaaccaaagttacatctaacataaatgtccattcatatttcatttggctgtgattgtgtatttgtggcatgtatatgggtgtgtagggaggatgcgtgtatactcatacaatgttagcatcaacaggaccataggaatctcctaattcaagctcaatattaacacattcaatatacataggtttgatatttataatatatactgctgattgtgcaataattcttcacattcccatggccttctttaagaggccatcatagcacacatctaattttatcctaacataattctacgagcttgctagagggcattattattattctactgagaaaatgggcagctaattccaaagaggtccagctttggctcagtcttacacggcatgtgaatggtgaggttgaggattaaaacccagattccacatccttgctcagagtacttcattctggcccacaatctctaaagctacaactgtctaaatacaaacaaacaaacaaaaaacaaacaaaaaaacaaatgcaggatatccatgcatttccgtacaaccggatagtattcagctctaaaaagtattattcagctgctgatacatgctacatcatgctcagagaaagaaggcagtcacagaggatcacatattgtaggattccatttatgtgaaatgtccagaataggcaaattcatagagatagaaagtcaattagtggttgcaaggggctaggggtgaagggtagggggaaagggagtgactgctaatgggcacagcatttcttttattggggggataaagctgttctaaaattagatgttgatgatggttgtaggacactgggaatatactttaaaacattaaattgtccacattagatgggtacattgtgtggtatgtgaattgtatctcaactaaactttaaaaaaaaagaaaagagaaaggggttatgatacagagccgtgttcctaggtcactcacaaaatgcttttaattgttacagtttaaaaagaattaactaactcctattatcattttaatagaactctccctccaacatgcactgtttcagatattatacaagacagtgtagacagtgtatttagacagttgtagctttagagattgtgggccagaatgaagtactctgagcaaggatgtggaatctgggttttaatcctcaacctcaccattcacatgccgtgtaagactgagccaaagctggacctctttggaattagctgcccattttctcagtagaataataataatgccctctagcaagctcgtagaattatgttaggataaaattagatgtgtgctatgatgacctcttaaagaaggccatgggaatgtgaagaattattgcacaatcagcagtatatattataaatatcgaacctatgtatattgaatatgttaatattgagcttgaattaggagattcctatggtcctgccgatcctaacattgtatgagtacacacgcatcctccctacacaccgatatacatgccacaaatacacaatcacagccaaatgaaatatgaatggacatttatgttagatgtaactttggtttgtgatagtcctatattacttttttaaatctcagcttcactcatgacagctaggaatgcaaaactatggttttaactatggagttaaaagagggtttttgtttgtttgcttgttttgtgtgtgtatctgtttgtttctttgtttgtttgttttgagacagtgtttggctcttgttgcccaggctggagtgcaatggtgtgatctcggctcaccacaacctccgcctccccggttcaagagattctcctgcctcagcctcctgagaagctaggattacaggcatgcgccaccatgcccagctaattttgtatttttagtagagatggagtttctccctgttggtcaggctggtctcaaactcctgacctcaggtgatctgcccacctcggcctcccaaagtgctgggattacaggcgtgagccaccacaccgagccaaaagagtttttaaaaagagcgaaaaaggcaaaggaaatgagatccaattatgcctccagatttatgagaattgtaaatactgttttaataacttctagaagagcgtctgaaacagtaaaagtaagtagatttctcattcataactgtttacaaattcttttctgaacaagttgaaaattcggggtaaagagattttctttgagaaagttaactcattgtctaaaattcctttgactccagatgccaagacaaatattgagagtaatgtcatatggttctgtaatagtaatattctaagctctactgagacagcatattcttctacaagtagaaaaaatatatttttattaggtatgaaaaatagatttttgatataactttttttattatgaaatagttggagacacaatgccgggtgcggtggctcatgcctgtaatcccagcactttgggaggccgaagtgggtggatcacgaggtcaggagattgagaccatcctggctaacacggtggaaaccccgtctctgctaaatatacaaaaaatcagctgggtgtggtggtgggtgcctgtagtcccagctactcgggaggctgaggcaggagaatggtgtgaacccagaaggtagagtttgcagtgagccgagatcgcaccactgcactccagcctgggcagcagagcgagactccatctcaaaaaaaaaaaagaaatagttggagacacacaagagtttgcaaaactaatgcagagagttcccccgtaccattcatgcggcttcccccaatgaaaacatctttcataaccacagtaatgtcaaaaccaggacattgactttgacacagtattgtcaaaaatagattttcatatggcaaaatttcccttagaaattggactacaaattatcacatcatttcaagtctcaagtgtcacagttggatcaagcttttattattaaagggtataatttgattctttgtgtaaacaagcattgccctaagtgtttttttaattacatgcattgaaacctgaataatagttcatttcagcttacatttgtatctaaaaatactaataagctccacttcaaaatatatagtactatttttaaaaactctgtgtcgctttcaaacaacacttagatcattaaattagatcctcattgttccctcagaggtgacaggcattattaaaatgtattctgcatattttgtttctgtaattatgtctaatcagtgtgaattgatgctgtggaaaataattaaaaacacatatttgagctataagtgggaaacaaaggagaaactctcatagttggactctaaatgacaagaactgatagaaagttgaaatattagacaagaccagcagcccggaaaaaaaaatgtgttaataggtagaaaatgcaaaatgtctatagaaatatcctgaccttaaaacaaaagaaagggctttgtcattgtgtattctttttcccctgcagaatcgattctgaaagatgtggagatctcataaacgtctccaaagaacagttcacagcacccagggagtgaggctttctgaaagaaatgccttcccatgccgtgtaaatggcatgtgtcaagggggaaaggccccagcgctgtggtgattgagcaggggctgctgtgggcagcttcctttgtgtcctgatcatttacatgacttaaacacaacaatgtgctccatcgtcaataacacaagacgctttgccatagcaacagtttcagaatgtggcacagcctcagtggtgtccctgaaacagaaaagttccctaaagaaacactccttatgaatatgttcagagatttctttatcctactaggacttgtttcaaattccattgggtttaggttttatttgcacagcccatctttcctttgctctgtgagaaccagctttggggagaagttgggagagacacgactgtggggtcagagggtgggaatacatacatggctgtgatagaaatggaattcttaagaacattctcagaaaactgttaatgctatccagaaaatcatgtaaaattcaggaatgcaacatacatcccaaagtcattgttggtttccttgaaggtctgtaataaatggcccttttattgtttgtacattttgcttctttccatcacaacatgtgcatgtactgtgacacactttagacaatcataaggacatgaaccccacactcaatggcattgtccaaaagacacagcacatacgttatcaaagctgtgattaaactccaatacctccctctaatttcaaggtcattttctggcaagacacaattttcccgttaagaaagtacccatcctcccccaccccccttttttaagcaatagcgctttctacaagtttgaatctaagagttgttctagtgaaactttcacctaagacagcatagaagagaagaaaaacataaataattttaatgataagtgataacagttgaattatatttggctatgtaacatacagtggtgttttacctttaggggatagttagagcactttatagtttgtctggctcagtgagaaggaaattgtttaccttgatatgtttgtgtttctgaaagatgtgccttctgtggcatatgtgccatgttgccccctttcctcatctgttccccttcgttgatttctgggaagtagccatcccttaacactggagctgcctatagtgatagatgatactctgaatctgtgcacctgactccatagtaatctataaattattgatgagctggtaataaaaaatcctaaatgttcctgcttctcagggagccacagaccccaggggtcgccaagcaatgaaagatcaaactggactcaccagtgaaaacacaattaattatttacacacatcagcatttgacattggtatcatttgaatcaagagatcctttgttggctacattgctacattgatttgtgctccaaagactgtaagtttggatgcacccttgttcaggcaaagggagatgagtagatactgagtgatgaaaggtgagcactgagtgtcaaattttatgcacatgttaatataaagaaattgatgtcatatattatagtgatattttaaggagttttgaaaacacaaagattgtgtgtgggtgcaaagtgaaaaggaaaggggatagagaagcaattataattatcttatctcagtccagtaaagccaaattaatttaaccagagctggggagaagtctcaagagaaacaccttctgaataagaccccactggagaaacttaagcaacaccagtgaggagtagctccctctcatgtctcttggttgctctgctgtcctctaaaatgatttcctgagggcagcagggctggtgagtttcattgcagaaacttcgagtcctctatcataggcattttatgggttaaattgtgcgagtaaaacacgtcctcctgagttggagtgcctctaatatttagcctactcaaaaggctgagcaggttcagttctttctgtgaacctggggaagagaaataaaaatctttatttttgtatgttctgtaattttcaaggcttttttttttttttttttttttttttttttttttttacagttgaaggactgccattttaatgctgtggattttgtgggccgctgctcaacaatggggaaatttcattaagctgagccaaagctaattttgaagcagttctgagacattccctattaagtagagaaaggatttgattccttatccttcctttcatgcttgagggatctcagaacccttgacaaagcaatgactgcaatactgactgaaagtaaaggaagccctattcaaatggttagcattgcctcccagatgccaaaattcccaattttttaagaaagttcatcattcagaactattaagaatttttccactctttggtagaagaataataggtcatagatttatagagaggtctttcttcaatcagttcagacgcctcaattgctcactgtctcaaaagatggagtgtaaacatgtgtaatatttaatttctatgtacaagcaaagactcataattttctggaccacacagaatctctgtaaaagttttggatctaatctctgcttctgtactaattccaaaaaagtcaatgaagtctgaaggcatttggcaatagaactaaccaatttaaactctgtgctttagcctacaacccaaaagtcaatgtttcataaatatttgaacatagctattggaagtcccgctggttatcttttaagttgtactttgcttttggacgaagaaccatatcagagtatcattctcccataaaaatctgtaaaataatgtttaaatagtcacacattacaaaaaaattaaattccacaagtttattgccctgtggatattgggcaaagtgactgatgcccacacccatggattaatcaggttataaccaaaaatttcccttatattcatccttggttcacatactctactatcaggaaggtcacccaagactaagatagagggcaaatggggcctggtagcaacactgattttgctcaccatctaagtggctggttctgatcatcatcatattattgtgctgtttttccttttaaattgttaccatctccatagatccagctcctgtcctatagagtattcagttactgggtggattattatcttggtttgggttctcttggatgcagaccttgagacaaaatttcaagggcatgtaatttatttgggggagagagacaaggaagagaggaaaaccaataaagaataggttatcaggtaagttaccactgtgggcactgaagcttaatcttattggggaactctgagatccagtggaaaacatactcctcagagatatcctatctgagggacaagggagcgggggtattaatacaccaattctggccagtcactgcatgaggactgcacagtggtagaagtgggagacattaattctccagcacttctgggctgccatatgcaagcaaagctggctccagcaccagagaaaactctctggtaaaaaaattgtagagactggcagttggatgtcaggctactgggcatagaaatggaaaggcctaagggaatatgagcagagaattgacctatctggttgatattgagaatcaatttcattgtctacaaccccaaaggcaataaacagactccacgggtgcctgcaagagccttgtcaatattcttccacgaggaagagaatagttttcccatggcttgtttttttttttaaaaaaaatcaccatctacttctactgtatgtgatttgtcatctgaatatgagagcttaaagagattcacttaccttcccagacccagctctaacccagacagaggataaactggaagagtaatcgtatgggaatctcaatctaacgaaacagaataggccagaaagggttcagatctaggctggaaactgactgttggcatttggcaggtggatagctctcctatttgcaggagggagtgaagtctgcacagacaagtgaagagggatgacagtaggtccagcaattagtgacagatggagagtcacattgtcaagctgttggcattgaaaagagccaacaggaagtggcagtacagacccttggcaaaaggccataggaagggggccaacctgacaggtgtgggcattgaagaggagggaggagaaggttcttttgtagtttgtttatccacaaacggtagtgtctttatcctggacaaagcacaggtggataatgtcaacattgagattggaaggagaagcttggaattcaggggcatagttcaagtcacagaataactaaattaatgaacagggcaccaagtcaatgacacaagcacaagaagctctatgattttagttagaacttcttttgattgcaaatggcaaaaaattgttttactttaagaaaaaatataaagtgtgtgtagtgtgtgcatgtgtgtgtgtagagtgtatcagttatccagcgctgcataacaaaccatcataaaatttagtggcttaaaacaataatctttagctatgattctgtgggtcagcaattagctggattcagctgggcaattcttctgcttggctcacttggggtcactcatgtgtctgcagtcagctggcaggtgatgagagggctggtggatctagaaaacaccagctgagatgcttctacatgatctacatgatcaatcgctgctccacctcatctctcatcctccaggtggccagtctggcccactttatatattaatgaaaggttcccagcggccagcgagcacaagccccaaaccacaaacactttttagcctctgcttgcttcgtgtttgctaatgtcccattgaccaataagagtcatgtggccacacccagattcaaagagtgggtagatttcacttgttgacataatttgtgaccaattcatgtgatctactatcagagggcatttgaagctgcacagaaacaggaatacaatggtagaatgacctgtctgcttcttcctgtttctattctttctctctaccaacttcagtctcatgggtgagctgtcttcataaggcaggaggtccgggtcacttttagctcttgggatcacatcctcactgcatcataacctgagaggaaagtactctcttctgtcaggcccaatttagaaaatcctgcaactaaagcttattggcctggcttgcatactgggggatgatactggtggctcatattcaacccagatgatgggagaggaagggggaagaactgttcctcccatgttttctttgcctttctctggcttaattcttgtgtttcctagattccattttttctctttcttggttttctctttcatttttttctggaacacatactggaaaatgttacatggaaggcaacttttttgaggtcttgcatatccattcttccgctgtccaacttgaaggaaaatttgatttatttccccatagggcttatcctctaagatattatgtaatttccttgttcgttgtgtttcttgtctatcgtttttatatcctgctatgcaagcacatcaaaggcagagttttttgtcagtttatttcactggtgtgtctcaagcatctagaccagtgtatacagcaggcactcaatcaatatttgtggaattactgaatgaatcaggctgagttttctgtagcacatgctcctaatgtcaccctttgtccctccagtccccactgcactgtgggtttttgagggttttgtgcattttcacatctccagtgccttgcccactctggcatgtgtgggagtcccataaatcaggggcccccaagtccccaggccatggactagtaccggtcccagtctgtggcttgttaggaaccaggctacacagtaggagatgagtggccagtgagtgagcattatcgcctgagctctctctcttgtcagatcagcggcggcattagactctcataggagcgcaaaccttattgtgaaccgtgcatgcgagggatctaggttgcccactccttatggtaatctaacgcttgatgatctgaagtggaacagtttcatcctgagaccaccttcctcccacccatcccggattcatggaaaaattgtcttccatgaaaccggtccctggcgccaaaagggttggggcatcactgccataaattgttcttgaatgaataactgaattaccagggaaagcaaaactagctaatgctatttggagggaaagttcttctcaggacagaagtgttttctgtaatatttaaattatattctcgaggtagaggaagtacatgaataaacttatagaataagaccaaatttattttgcttgctgctatatttatatataactataactatattagtatctctatatctagatgccctagttaaagattcagttgacccagctggaattccgtctttgccaggactatctctgctgtgaaaaatcttctcttttcaaatcctgtgtataaagcaagctgcctataaatatttgttgtctgaataaacatagaaatgatgcatacatctttctaatgtttcacagaggggtttagttaactgaagctaaagaacagttctattaaaatcttggtagaattttctgttattcaagtagaatgcttggcagggacaaattatacaatgtaatcttttggcaattttcttttgcattcctgtgaagcacagcctttaaaggtattgctgggaagagttttgttttccaaaagtgatgatagatttcggcaaaaggccataaaacttatcaatgttttttaacctccatcaacaaaataattaaattttgttatgttttcaaatttgaggggatttttatttttcatatttcaactctttgagttttcattagaaaagcaatgttttccttgttttaagaaatacaggtttttatttctacctttttgaccaatgatgtataggaaagtttaaggaggcacagacctcatccccaattattaagagcagatgttttctgagaaatgtgctgtggatgattttagcattaacaacacccagtgtggacaatattgtcttggagagaactttggttaccgcaccagagtttatttctaagtcgagaggcagaaatacaagacaagacatgggaattgctgaactggttttgcccaagttaacttagagtctcaactagttcatgccttaatgaagctacattttactcattaatctacacatttgaagggtaacacataaagctaggaaagcagctaatactttgaaatacaaatttaggaaccaggggatgatctgtctctgcaaagagcataggaagctacggggaagtgtatgaagctgggggaagcaggaagctggggacagtaaagcatctgtgccttcttcagccaatctttattgagcaccagcagcacatctagtgctattctggatgctgaggccacaaaagtcaattaaatgagtccctgcccttgttcagtttatattctaatggagggagatggacaataaaccaatcactgtcagctagtgaggggtgctgcaaatacaaataaagcaggatatacaggaaccaaggccctccacaaaggagaggagcaaggaggttaccctttcgtgtaaggtgtctaggaaggccttttgggagaggttaagaattgagcagacacctgaagaaactaagagtgcaaatcatgctgatatcctggaggcaagaactatgggcagaaagaacagcaagtgcaaaggcctgagatgggagcctgtggcgtctgtgaagaactgacggggcctcagagtggtgagggcagcgggagtcaggggcaactgggagaggactaggtcacagcaaggacagcctcttagagctttgggagcattgcgtggactttgtcttttactcttgtgaaatgggagccaacgaagagtcttgagcagaagagttcaaaagaatgacagctttgaaataggctgggaaggagtgcaggggaatgcaaggtaggagcaagcacccagaagaggctccagcagtaatgcaatcaaaagatgaagcagaaggacaggaagagaggccatcagattctgggtgtgttttcaaggtgaagtcaacaggattttcttataagattggatgctggatttgagagacagaaaaaacaacaacaacaaaaaaccatggataactacaaagattctgatctgagcatctggtggtccttatggttggctcttaaatgccctctcttttaggtatgggcacatctgtttacagggccagagatgggacagacacgagctgaagtattataattcagctagtgatggtattcaaattcaacaaaatgaaatgaagaaaatatcaagacttccagtaataaactaagtgcaaaaaggaagaaaatgtagcttagcagccaaattagctaaatcatttagaaggagtaagttcaatatgaattaacagaacctaatatggtaatttgtagtaataaatttacaatatctcaagctggggtcactattggagtatctcattcagttttcattcaaactgtaaagcaattggagcttaggaaaacaaaaaatgacctggcacagtggctcacacctgtaatccgagcacattgggaggcagaagtgggaggatgacttgagcccaggagagcaagactaacctgggcaacatggtgggaccccgcctttactgaaaaaaaattttaattagctggatgtggtggcatgtgcctatagccccagctactcaggaggctgagatgggaggatcacttgaacccagaaggtggaggctgcagtgagccattatcgtgccaatgcactccagcctggacaacagagcgagaccctgtctcaaaaaacaaacaaacaaatcatgaggggatgtgaaaactgatgatatgagaacaagttgactaattggatgaatagcccagaagcaagtagacgtagaggcataatgactgtcttcaaatatctgtggggctgtcatatgaaagcagaattaaacttggtcaatgtgacccaaagttaagctgggttctataggtagaaactactgcaagaaacaccttagctcaatggaaggacagttttccataacagacactgctagtactctccaacatctgtgaactcatctccatcttggttaccctgatagtctatatattttaaccccttgctatctaagtggggccatgtgcctatgtcagtcaagccaataaagtatgggtgagcttagtatatgctacttccagtcctgacctctaaagccccctctgagctcttccacatattctctgttcccctgctgctagtcagatgcagagggtcctggggaggactctgaggtcctgtaagatggtaggtgaaagaagccaagatctgcgaaaagagccagctgagcagaactgcctggtgcattgtgatatgaacattaaataaacctttattgtgtcaagccatgtagatgtgggggatcttttcttgtgcagctagattcacttaccctgactaacacatctactaacttttagagctgtccagctataaggggattgcaagggagagaatgagttttctgtccctggatgtgttcaagaacccccacttagacatgaaactctcaaggttgtaggggcaaagggaaagctttcccttcgcccttggaaggtttgttgaaaaatcaactcacaaaaagggagattaagagaaaagccatataaaggtattactaccgtgggcagggggacaatcacagactgaatgcccaatatcccaacagggtacagatgcttatacaccctgcttcttaggagagcgggagatggggaagtgtggatgattttagggattagtaaattatttttagggagattcaatgggcttgaagaacatacaatggtctggaacaaagtttgttgggcctgcagagcagacaatggtttgtgacaaaatctgtccaggtttgttaatagacttcagccttccttcctgcaataatgaaaactcaggggagggaccagaggtaattgttttcttctttgttaggtccggactttaggctgaaactttagagaacaacttcagcctgtgctttgggagagatagaggattcagagatgggaggggcaagttgcggggagggagaagtaattgttcttcttggtgggtctgtccaatccttatgtagatggcggggagctctcttcttttatctgttgatttctaaaggcctttaattcgaaatactcattataccagggagccatattttggggaagttccttgtgctccaaggttaaaatcaagctagagataagtgacctgaccaaataattcgaacagtacttttcaaaactttccactgaggttcccttatcaacagagagatgtggctttttatccccaagtgacaggagttatatgtctcctgtgaattttctttgaactcttttgttttcataatcttatcttaaatatgaatgcagtttctgtgttcttatctacaacctatcagtttattttcatatactttttaaagttataaagtacatactattactgaacaagactttttcttttaaatattacagtcagattgacacgttaagtgttcaaaaattaatattttcaaagttaagctatgccaaaatcaataaattcatatgtgagcactgttttaagtgaaatataagatcagaattcaaatgaacacatacattatttttcaacaaactaaagtttgaagatcattccccatgccaaatcaacagtattccacattgcacggttcatattaaaaattataatggtagctagggtcctttgaaaaacgctagagacttctttatcttctaggtttcttttatagaaatgattttcattgcttattttcttacttagatggatacaaattgcaattctgttattgtgcctgcttacaaaaagaagaggttgctataaacatgatatgattcacaaaacgaaaaccatgctgacgttagtgggcacacacattttgcttgctcacatgttgtaatgtgatccaactagaaggagaggtagatttctccttcagcatattctcacatcttcccttcaaccagccccgccagatggaatggaaatgcagagattgtgttaaaagctgcagaagataagatgtctaggctgtacttgaaaaaggggaaaaagatgtaggtgcctccagacatcattttcttaatgggctttctctttagtagatgtttaggcatgtataatacccacttacatgcacctacttagaggggcctcatttgtactgctaggagtagctgctttgcttctatggagaaaatttgcctatagatttttgtaaactttatctgatattttaaagccatttccccatacttattttaatataggttttgagctagctttcctaattattaatttatatttcctttttaaagggaaagcaagaagcatgtgtgaaaaagcatgaacaaagttgtgaacttaaggaaatcttcaatattttaataaaataaaactactcaatgtctatatagtggccaatatgaaggcttgatctcctgcttgtagtggttagaccttcatattcaaacgtaatagtaacatgacaccaggaaagaaggcagaggatcatgtgcaacagtaataaaaaccaggccacatgtggctttcatcactttttcccacagctcagatctcagtcacatgatcacagcctaacaacacgggaagctgggaaataatggtcttcccgtgtgcccaggaagaaaaacaaaatgtaacaggagttactggacatataacattgtctctgccacactttctaatgcaaaataaaatagtcaaataatgaatccttactatggacttacgatctcaatgaggtagatatatcttagattctatttagcaaatgaagaaaaggaagatcacatatgttaaggagtttttctctcctggcatcactcatcttcttcttttattggtctgaaataaatttgctttctcacaatattgtttggcctgtgaatgcgttaaaaaatatttcaaagtatcataatgcagagttttggattgcatgttttagttagttgattatagtggctttaaaaacacagatttccttaaaacacacacacacgcacacagagagagacacacaaattcaaacacagttccacagttgactacttctttggcataatgatgtcatcaagaatcctggtgtgtctctgttttccactctgccatcctcagcaagacttatccaagttcacagtcactggggcattgtaacaacaccatagctacgaaaatacatactaaaatatacagatagaggaaagcttcgtggaaatctttcttactgttggtgttcatgtgtacatatatgaaatctgtgaaaactggatttatggcagtggaatctcatatttttctgccagaggtgatggttttaaaaagtcagaactggaacagttggagcctgtggctggagattattgaggaattttgtgtattcctttttcataaagatggtagtcatacagtgatgtgtataagatgaaagcaaaatttaattttgatacctggaggaaatgcctaaaatgagaaatgaaaaattcttattctgggtaatttgtggtagttctgctcttcttttacctacgtatatgatgattctgacgctcagagatttcaccctaaaccacacttgaatggcgatgactgcattttccatgctttcccacacaaagggctggtattgttctgagttggctcactacatgctagggacacgtggaatcaggtacatctcaacccactactaacccccaaatagataacttacttatttgtggcactgtgagcagaatatgccctttattcttccattttcaaaatatcatgttattttttcagggttttttatttttaatttttagcactctttaatattaacccttctagagtctaattctccatttgaagttagagttgaaaggcacacaatactcttaatagttttccagcagtgatgttgacccttctcaacctcatatgtttcattttgtgggagtagtattggggaaagatcaaatcacaactagaaataaaaagcaattccccttctatagaatgggatgctaaataaataaactaataaaaatgtcaaaatatagatgtggtggtggtaacaatgctggatcgggagctggaagacatagatctgatttcctggctctgcctcccccatcacttaaatataggtgaacactgaactgttttctctatcaaagagtaaaggttcctgttacacctacctcctggatggttgtgtagcttgagaggtgtgggtgagatggagcaatgccatatataccctaattcaccataaaaagatttggtcatttgtatatcttatgccacaagtactgtatcaggatcatagtgagagaagcagccttgagtgtttacctattacatcctccaattaagatattgttaaaatcaagcaaaaaagacagccttcttttcgtttctctgatataattagaaaaattcctgtttcacaccttctttttctgcaaaatggcctgtggaaaaatggttaggtcaaaaaataaattaggtaaatgctgttttctcagcctccctctcaaagaatcacaatatatgttactattttcaaggctcagagaaaatttgccatttattttataaaagattacttaacttattttccaaacctaattgacaaagaatactctttttccccctaaccattattaatgtcccttggctgtgttctaaagggagaaatggcacacttccctcattttgggcaacatgcaaaaatgtgcttctcagacatttttctcctgaactttaaaacttctgtattgagcagaaatggaggcgaaaatttccttcccctatggttttccttaacatcagggggtggaaagagagaagaacagttttggggtctttctcattagcctatttctgtttaaattactctctgttatacctcctttccacttatattaggttgctgtgtgatatagccaaatataccctgggactataccagagtcttatacccggtggcctcttgaagtcaggcaaaaagctggaagtaattttcagttatcctggccactcagcttcttcccagtctgttcttattacaaggaccactgggcagaattgaactctgccagcaagcaattgcacacccatcaacatttaaagcgggaaaggatgaagatgtctgatatggagtaggtgcttgtcttagcctgtgtctgcccacagcagatcttgaagcaaggcttccttagaggaagtttgtatgggaggtggtctcagggagtggcagtgtggttcggggagtggtggcgaggagagtaaaacacagctgtaaagcccagacaagggcattaccaacttggcttctcctatggacaactgaggttcatcccagggagtgttctgaggagcttatcaaatctgtctcagaactcccctgttctgagggaaaagaggctcctgtggcccatccatcttgggtggccccatgaaagtcaactccctgtacatctgggttgccaatccaggagagttgagggatgggtttcctttgccctgtcagaaaagcctcaaggtaggaatcaagaggtccttggtacaaccaggggcaagacactgtcagactgcacccaagggaaactggttaaagccaacatagaaactgtcaccacagcagtggctggaggaagagttggcaactagaagccttgatgtggtacttaagaggtgtccaatagggtgcttagtaaaccctagtggtttatctgcacaaagcccagcccctcactactgttaaatcaagtttagcctaaagctgcctccttacatattttaagctcgacctaaaggtttctctgtatatcatgaactatcacctaaatggagttgtaaagagactgtagtctactcttgcaccaaccactaagttttggccaatcaaaggtgaccaactgttcaaaccatgttcaaataagacaaaactgagctgtgaccaattcagctgtttctgtaagtcatttccgttttctgtatgtcactttcctttttctgtccataaatcttaccatgtggctgcactggagtctctgagcttcaggaggctacctgatttgagaatcatcctttgctccattaaactcttaaatttaattcagctaaagtttttcttttaacactacccacctcaggacttggagaccctgagaagttacataggttgccccaggacacaaagcatgctggtgacagagaaaattgaagagagccctcctgaccccctgttcacttggactttcagccatgttgcactgccccggctcaactaactgtacttaccactatggtagaaaagcttgagaacaaagtgccatgctgtcgcacctacaacatttaggaagaagttcaaaagatgtctgacttcaatcacggcaatgacaaagcagcaaatgcaagaaagaacaggatcaataaaagtcccagtggaattaaaaagaagacaagagaggtttaaaaggaaactgggctttggatacatactctttctgcttgtaatctgtgcttcttacactttctgagtttgaaaaggagtaatgtttttgtgtcacacttggaaattttgccacatgactgtcatcatgggaactttggaccctgttctggagctaagaatagctgagatactaattaggttgcttgaaaagtgctaaagaactgatcaagtccagagaattcacaatggaacttcatggccagaccgaggtctgttctaactaggattcttgtgttgccatcagcacatcaactgccccttgctttttcatatgaaaaactaatacctgtaatgatctcaaaattcaaatatttgagtatcagaatatttattctgatactcaaacatatgaataatgaaaaagaaatgtcgtggtgggaaccaataaagacagggtttggaggggccgaagatcctagggacggataaaatagggagatggctgagaggaaggaggaatgaaggtctcctactgaaatttaagcaccacacttctggacttgttttcttatgaattggttcttttttttaatgagagcaggtaataatattcctttatcaatgcatttaaagggcacaatttaatttagtttctgtagttaaggtgtgtagttaagtgcctggtacataacaaacaacagtgattaataacctactgtttttttattatttttattatactttaagttctagggtacatgtgcacaacgtgcaggtttgttacatatgtatacacgtgccaggttggtgtgctgcacccattaactcattatttacataaggtatatctcctaatgctatccctcctccctcccccaaccccacaacaggccccggtgtgtgatgttccccaccctgtgtccaagtgttctcattgttcaattcccacctatgagtgagaacatatggtgtttggttttctgtccttgtgatagtttgctcagaatgatggtttccagcttcatccttgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacatgtgcatgtgtctttatagcagcatgatttatagtcctttgggtatatacccagtaatgggatggctgggtcaaatggtatttctagttctagatccctgaggaatcgctacactgacttccacaatggttgaactagttgacagtcccaccaaccgttcctatttctccacatgctctccagcacctgttgtttcctgactttttaatgatcgccattgtaactggtgtgagatggtatctcattgtggttttgatttgcatttctctgatggccagtgatgatgagcattttttcacgtgtctgttggctgcataaatgtcttcttttgagaagtgtctgttcatatcctttgcccactttttgatggggctgtttgattttttcttgtaaatttgtttaagttctttgtagattctggatattagccctttgtcagatgggtagattgtaaaaattttctcccattctgtaggttgcctgttcactctgatggtagtttcttttgctgtgcagaagctctttagtttaattagatcccatttgtcatttttggcttttgttgccattgcttttggtgttttagacatgaagtccctgcccatgcctacgttctgaatggtattgcctaggttttcttctagggtttttatggttttaggtcttacatttaagtctttaatccatcttgaattaatttttgtataagatgtaaggaaggtatccagtttcagctttctacatatggctagccagttttcccaacaccatttattaaatggggaatcttttccccatttcttgtttttgtcaggtttgtcaaagatcagatggttgtagatgtgtggtattatttctgagggctctgttctgttccattggtctatatctctgttttggtaccagtatcatgctgttttggttactgtaaacttgtagtatagtttgaagtcaggtagcgtgatgcctccagctttgttcttttggcttaggattgtcttagcaatgtgggctcatttttggttccatatgaactttaaagtagttttttccaattctgtgaagaaagtcattgatagcttgatggggatggcattgaatctataaattaccttgggtagtacggccattttcacaatattgattcttcctatccatgagcatggaatgttcttccatttgtttgtgtcctcttttatttcgttgagcagtggtttgtagttctccttgaagaggtccttcacatcccttgtaagttggattcctaggtattttattctctttgaagcaattgtgaatgggagttcactcatgatttggctctctgtctgttattgctgtgtaggaatgcttgtgatttttgcacattgattttttatcctgagactttgctgaagttgcttatcagcttaaggagattttgggctgagacgatgggattttctaaatatacagtcatgtcatctgcaaagagggacaatttgacttcctcttttcctaattgaataccctttatttctttctcctgcctgattgccctggccagaacttccaacactgtgttgaataggagtggtgagagagggcatccctgtcttgtgccagttttcaaagggaatgcgtccagtttttgcccattcagtatgatattggctgtaagtttgtcataaatagctcttactattttgagatacattccatcaatacctagtttattgagagtttttagcatgaagtgttgttgaattttgtcgaaggccttttctgcatctattgagataatcatgtggtttttgtctttggttctgtttatatgatggattacgtttactgatttgtgtatgttgaaccagccttgcatcccagggatgaagccaacttgatcgcggtggataaacgttttgatgtgctgctggatttggtttgccagtattttattgaggatttttgcatcaatgttcatcagggatattggtctaaaattctctttttttgttgtgtctctgccaggctttggtatcaggatgatgttggccttataaaatgaactagggaggattccttctttttctattgattggaatagtttcagaaggaatggtactagctcctctttgtacctctggtagaatttgactgtgaatctgtctggtccttgacttttttggttggtaggctacttattgcctcaatttcagaacctgtcattggtctattcagggattcaacttcttcctggtttagtcttgggaggatgtatgtgtccaggaatttgtccatttcttctagattttctagtttatttgtgtagaggtgtttatagtattctctgatggttgtttgtatttctgtgggatcggtggtgatatcccctttatcattttttattgtgtctatttgattcttctctcttttcttctttattaatcttgctagcagtctatcaattttgttgatcttttcaaaaaaccagctcctggattcattgattttttgaagagtttttttgtgtctctatcttagttcttcagttctgctctgatcttagttatttcttgccttctgctagcttttgaatgtgtttgctcttgcttctctagttcttttaattgtgatgttggggtgtcaattttagatctttcctgctttctcttgtgggcatttagtgctataaatttccctctacacactgcttaaatgtgtcccagagattctggtatgttgtgtctttgttctcattggtttcaaagaacatctttatttctgccttcatttcgttatgtacccagtagtcattcaggagcaggttgttcagtttccatgcagttgagtggttttgagtgagtttcttaatcctgagttctagtttgattgcactgtggtctgagagacagtttgttataatttctgttcttttacatttgctgaggagtgctttacttccaactatgtggtcaattttggaataagtgtggtgtggtgctgagaagaatgtatattctgttgatttggggtggagagttctgtagatgtctattaggtccgcttggtgcagagctgagttcaattcctggatatccttgttaactttctgtcttgttgatttgtctaatgttgacagtggggtgttaacgtctcccattattattgtgtgggagtctaagtctctttgtaggtctctaaggacttgctttatgaatctgggtgctcctgtattgggtgcatatatatttaggacagttagctctgcttgttgaattgatccctttaccattatgtaatggccttctttgtcccttttgatgtttgttggtttaaagtctgttttatcagagactaggattgcaacccctgctttttttgccccccatttgcttggtaggtcttcttccatccctttattttgagcctatgtgtgtctctgcacatgagatgggtctcctgaatacagcacactgatgggtcttgactctttatccaatttgccagtctgtgtcttttaattggagcatttagctcatttacatttaaagttaatattgttatgtgtgaatttgatcctgtcataatgatattagctggttattttgctcgttagttgatgcagtttcttcctagcactgatggtctttacaatttggcatgtttttgctgtggctggtacctgttgttcctctccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttcttcaagaatgttgaatattggccctcactcccttctggcttgtagagtttctgccgacagatcagctgttagtctgatgggcttccctttgtgggtaacccgacctttctctctggctgcccttaacatttttttccttcatttcgaccatggtgaatctgacaattatgtgtcttggaattgctcttctcaaggagtatctttgtggcattctctgtatttcctgaatttgaatgttggcctgcctcactaggttggggaggttctcctggataatatcctgaagagtgttttccaacttggttccattctccccgtcactttcaggcacaccaatccgacgtagatttggtcttttcacatagtgccataattcttggaggctttgttcatttctttttactcttttttctctaaagttctcttttcgcttcatttcactcatttgatcttcaatcactgataccctttcttccacttgatcaaattggctactgaagcttgtgcgtgcatcacgtagttctcatgccatggttttcagctcagtcaggtcatttaaggacttctctacactgtttattctagttagccattcatctcatctttttgcaaggtttttagcttctttgtgatgggttcaaacatcctcctttagctcggagaagtttgttattactgatcacctgaagccttcttctctcaactcgtcaaagtcattctctgtccagctttgttccattgctggcaaggacctgcgttcctttggaggagaagacgtgtgctggtttttagaattttcagcttttctgctctggtttctccccatctttgtggttttatctacctttggtctttgatgatggtgatgtacagatggggttttggtgtgaatgtcctttctctttgttagttttccttctaacagtcatgactctcagctgcaggtctgctggagtttgctggaggtccactccaggccctgtttgcctgggtatcaccagcagaggctgcagaacagcaaatgttgcagaacagcaaattttgctatctgatccttcctctggaagcttcatctcagaggggcacccagctgtatgaggtgtcagttggcccttactgggatgtgtctcccagttaggctacttgggggtcagggacccacttgaggaggcagtctgtctgttctcagatctcaaactccatgctgggagaagcactactctcttcaaagctgtcagacagggacatttaagtctgcagaagtttctgctgccttttgttcagctatgccctgaccccagaggtggagtctacagaggcaggcaggcctccttgagctgcagtgggctccacccagtttgagcttcctggcagctttgttcaccttctcaagcctcagcaatggcggacgcccctccctccacctcgctgccaccttgcagttcgatctcagattgctgtgctagcagtgagccaggctctgtgggtgtgggaccctccgagccatgcgcaggatataatctcctggtgtgccgtttgctaaggccattggaaaagcacagtattagggtgggagtgtcccgattttccagttgctgtctgtcacggcttcccttttctaggaaagggaattccccaaccccttgtgcttcccaggtgaggcaacgccctgccctgctctgtgggctgcacccactgtctgacaagccccaatgagatgaacctggtacctcagttggaatatgctgggagctgcagactggagctgttcctattcagccatcttggatgacaaggccaatatcctactgttattaaacttttcttctgccagagaactttgtccatcttttcccacttcccgagtgtatttgccgacattactctctgtactttttttaaaaaagaaactcttgattttggaacattttaagatttacagaaagttgcaaaggtagtacagagagttcctgcatgcctttcccccagcctcccctgttatgaacatcttacctaatggtggcacatttgtccagactaagaagttcatctgtacattactattaattccttgtacttccaaatagctgctgtctctttttcaggcattaattaggagcccagataattctaatgttgatatttgattgaaccaggatacttccttgtgaataagaagtgggctctataaattcaacattgtacacacaagttatcataggtctttctttctttcttttttttttttttagatggagtcttgctctgtcacccaggctggagtacagtggtgcaatctcggctcactccaacctctgcctcctgggttcaagcgattgtcctgcctcagcttcctgagtagctgggattacaggcgtgcaccaccatgcctggctaatttttgtatttttagtagagatggagtttcaccatgttggtcaggctggtcttgaactcctgataccatagatcttttgtagggtccatgtggtcctaacaaaattccatcacctctggcaggcccagagaactgctggttaattactaaaaaaaaaaatacataaagcagactcctattgaaaccaatttaaaatatgtgtttgagtattcacaaacttaccctcactgtgtttgaaaccttcaagttttttttggtgaacacagaatatctgtttttgaacaaaacattctaacctgatgtgtaaatgtgatatgctcatagaaagggagctgaagattgcagcactcttttggacatgatatttgatacaagttagattataagactcaagattttgaaaagggccccttggaaacttcccagatgagatggttcaatggggaacataccagatggaatgtataggcctctgtcctaaacagatgttgtacagctgggaaagctgtgacaagaaaatgcaccccaaatgcttctgatggacagatctctgtgcacacatgcacacacacacacacacacacacacagcgttttaagaatcaaaatattcagattgcttaaaaattagaatttcaggtgtcagtcaccagtggtgtatatatatatatatatatatatatatatatatccccattgttggaatggcccagtttgtcagcatcaaatccatagtccatctgtgattgcccttgaaactgatgaattcacttcaattccaacctaatcaattctgaactagtgccttgaagtcatttaaatagtaacttcctttgcacaaaatcttaagaccgtggagagtggaggtcaagagaacactagtaaggtggcctctgacttcttgagcttttgacattcagccaccagaggctgctctgagaccattatcctcttttcactccgggtccaaatcccaacggtgaaacctgtaaggactgattttgtttccattgctttgaattttccttcctcaatgcagttccctggaggtctgctgtttggagaagatgattaattatagttaaagaggaacagctgaaagaagaaaaaaactacagattactgttttgccctcctctctatttttaaactcttaatcttgttctgtttcttttaaataaaagaaaattggtcagggtggaaagagaaagtgctttcttactggcactggctaatttttcttcatttttcccctctgtgttgctggattttcaaagaacatttctgaagggttttaaatctttattccacaatacttacttccacatggtttctattcttccagattttgccagcattttatagttgctttcatgctgttccctctgttttatgtttttaaatctttgcctttctcctttctctctatctaacaaagcaaatccaaaattaaatggaatatctatagttaggtaagaaggattaaaaatggttttgttgcctctaacatattttgtagtctgggacaactaagcactgatttaaattgttaactgaagaatgaaaccagtttcttcatgtgacattgctttcaatcttcacgagtgaagacatgactgtgacagacaatgaccagcctgtcaaaaataagtgtttttatgttattgttacatacaccaccctaattattatacttccatatttatgaaagtaagttactatgtaaagaacttaagttctaaagccatggcaaatactaaattaatagttttgcagcagacaaagtaatcaatgtgtaaatgacctggagaatttcagcatgacaattctttcattctagacttattctttttttttcttagtaaaattccatgtctgattggaaaaggtataatttaaatgtatgcattcttatagaaggcatatagaaaacatgctcattttctacagattacagaaaaatcaattgagttgcaaggaaaatgaatacttattttattaatttctatttgcagtaaaagatggaaatgtaaagatttccttttgctctgaaaaggaattcttgagataccatgaaacattcctaagtggtatcatattcatagagtggaactatcattagaagcatttgaaatgtttggtatttcacctcaagtgtaatcataatggtaaagattcttaatattggtgactaaagtaggatacatgtgggtttatattttcaggtagaatactggcagctacagtatgtcaactggagcatatttcaccaaatgccttgacaaagatggaatgacaatgaaattgctagatctcttctctggggcaggttatgcttttcaacttgcccctactaaggagagtaccagaagccatttgcccatgagtaataccttattaaaccatcatgatttaatgtggcatatttttctctcaatttgcatgcctgacagtcgacttcctgaatatcacattcgagctgagccacagaagaaaaatagacccactgaagtagcattaggtcagcttcgcgggatgcattagcaacctgtctgaacaaagacgggggactcaggcgcagaaaatcataacgtggccccaggccctgggaggtggccccattgccttgcaaatgtatcgcatgactcattattaaacacaccaagaacagacgaattccaggcgagtgaagcatccactgattcaattgcagttaggtgggttgtacgatattcgtcttacttgcttttccttaaagaacacccacaccatctcttacgctcttgaacacggcacgtcaaatgcatgaagcaagtgtattaagataaaaattgctagcattaaatacaggcacttaaattagtataaccctctggccagatatagtgcactaaattgcacaggctttaaaatgccagcactcaatttaaaaaaaaaaaaatgtatccatagcaacctctttgttaagggaatagttaccaggaaggatacacatctttccagagaatcagagataaaaccatattagttaactggatgatattacttggatttaaatttaactagaggcatggttcaggagaaggggctttttaaaaactttacaacttatatgcttatttccagtaaaatgtgttttcatatctttcttattaccaaaagattcttacatatgggacttttattaaaataccatggaataactttgggtttcagatatttagaaataaatatcaaccatcctgttcttcctgcccacagcatgcctatcattttttttcttagcattttcttttagcatacacataggtattattctgcaatttttgctctatatgcatctttgatggtcctttcatggatatttgttaccagaaagggcacagggtcttgtaataacccacaatccttctattgtgaggtcatctgacttaagtcatcctgtttccaagagactttctctctgtctaatggagtggcctttcgtgcagttatgtcatgtgatgtgggctgtaggggagggggaaatgggggatgactaacagtgaggtgaagagcctgcaaataacaatgtctcacatttcttaggcaacgagtattggggaggaaatcttttcatctaccttcttctgttcaatccctgggggcctgcaaactaaactaacaaaagatagattaacaggagaaaaggcacacaattttaatcaatatttacatgtacaaggctgtgtttggaagctctagcctgtaattccagcactttgggaggccaaggcgggaggattgcctgagcccaggagtttgagaccagcctgagcagcatagggagaccctgcctctacaaaaaaaatttaaaaattagccaggcatggtggtgtgcacctgtagtctcagctactctggaggctgaggtaggaggattgcttgggcctgggaggttgattgaggctgcagtgagccataatcacatcactgcactctagcctgggcaacagagagagaccttgtctcaaaaaaagaaaaaaaagtacatacacaagagttcacacaaaaggagcaaaacacaaagaagcagctagactcaggggcttttaacatacccttttaacaaaggaaagagggtttgggcttcaagggataataaattatgggaaaatgactaggaaatatataggggaactaatgaacaataaggactaaggtctatttatacaaactcttcttggtatcaactccccatcttctatgataaaagtcattcttctctctctggtacagggggcaccttcttcaaagggaaatgtatgttctgcttttaggcagatagagggagggcagagaactcttccgacagctgttgattttcatttgactttagctcaaaataattattatgccaaagaggcatatttggggttggcatattctgatccccttcaggaggtaaacacatcaagcttggagcttaaattagtcaatgtcagtcagagccagcttcttgggcatacaacctgtgcagttacatgaggtcccacacttggtctaatggtagactgaatgggcatggctgcattccaataaaactttatctatgggcactgaaattttaatttcacatacttttcatatgtcatgaaatataattcttttgattctttcaactatttgaaaatgttaaaaaaaaaattcttaactcatggaccatacaaaaacaggtggtgggcaggcttgggctggagtacctgagtttgccaacccctgatatacagaagcatttccaaaaccaacagcatcggccctacctgggaacttgtcagaaatgcaaatttctaggccccaccccagactgctgaatcagaaactctggggtggggccctgtaacctgtgttttaacaagccctctaggggattctgatgcccactccaatttgagaaccactgatctagacctgtggttctcaaccttggctactcatcaaaattccctaaggtagcttttaaaaactctgctccaaggcccagcccaggtcaattaaatcagactttctgggggtgggactcaggcacccgtatcttttaaatctcttccaggtgatttcaatgggcagccaaagcaactaatggttccattgtacaaataagggaactgtagctcagagagtttaagtgacttgcccaagatacacaacaagaagaaacaggtacagcacagctcatttacgtttgtttttttagacatatgagggttagaatagtacatttggtaatggaatgtatttgctagaagcttcaggggtcaggttaccttttatttagcaccaattaatttaacacatctgaaaacatgccctaaataaaatgaaaactagctttggaaactcattaggccagacaatgcaagcgtaattgaaagaaataaggtgcagacgctcagcaaggtcccatctgaaagcactttggggctgaagggtgagctccatgattcaaaggaaagacaaatatggagagctaatgtcagacattgttgcctgccctggagctacttagaagtgtgtctgaacaattgcttcctgttcggtatctgggacataggtaaatatgttacagtcctaaatgacattaatgacagaaaaaaagtctccatgcttgtgatggattttatgactcttaaggattcctgtgccttgggcatttttaaggcgaactttcaaatgataaatattttgttctgattttctcagcaaagacttcatcatatcaaggaaggaagaatatgggctacgtacccaaaatagagctggagaaagcaatgcacgatggaaactgagtcatgcaatgattacaagtggagtcatataaacatacaactgactctttgacgtttttgttttatgagttacctgatcataatacaagctactatttttgagtatttactatgtgctgtgttctcctcatagttctatggttaagggcatgttttcaggaactggtcagcctgagtgcacaaactagtatctatggcctcctagctgtgtgactttggcaagttactttgcctctctgtgcctcagttttctcctctggaaaatggggataatattagtaccttttctcatagggtgaaggaagattaaatgtgctcacaacagtgtctggcttctaataagcattcaataaatgttaaataatattatttttaaacaaatcacctcaattctcacaataactttgagggatattaagcagatgggccaacttatcacaactattaagtgacaggattgatatttggactaaggctgtttccagcatcagtgctgccagccacagtgctatactgcattgattgggaataataaattaagtatttatgttcaattttttccatgtatagtataaacttttgggcatgatccaaatatccctggaccttcttgttatctggatgattttacaaagcctccagactgcccctcccacaggacactgaagcaaggttgtggtccctcctatcaactgctcctcctgcagttgtccccatctcagtaaatagtgacttcattctcccagctgtcccaggaaacaacctggaaacctcgtttctgctctttatctgacacatacagtccatcagcaagccacactcattgtactatcaaaatctatccaggaactccccaagtcaccccacttccagtgccacccccgtcccaatccaccatcatctcttaacatctcctgccttgcaggctgctctctgtctagcagtcagactgagctctataatatcaattggatattgttactcctgagctctgaaaccttcccatctcactccaaggaaaacccaagatccttctagtgatctactagaccctacaggatctgcaaacactgcctcaccaacacccacccacaaccactgcccccgccccccgcacacatacaccctcagacacattcctgagacttcagctcctactactgtagtgcttcctccctctgctccaacctacataggcttcctgcgttggttgagttcaccctggcctcacagcttctgcaatcactgtttcctctgcccgggtaactctgcccccatccatcactgtagttgaaagtcttgcttcctcacttccttaggactttgctaaaatatcaccctataaaatatagaaactcctcatcccattgacactccttaccccacatacaatagcccctatcaccatcagacctactttctacttatttgttgatgtgtttgtctatctcccttcactagaaggtatgctcatgacagcagcacttaacctatttgtacctgtctgtatcgtcagcacctagaacaatgcctggcacatagtagacacccaataaatacttactgacatgatcaggcatgttcagggtgttatagctgtagtccataaatacttactgaatacctatgaccgttctggcataaagaaggtataccatctttgttagcatatggttaaggcatgagagtctctccgattctttttcttatatgaagcacttgtctctatgcttgagatctttggattccctgggagtgatgaaaatcaattcatagagatgtacagatatctatctatatgttgctaatgaaatcgatggctagaacattgatgcaccaattagctctgaataaagaaaagtgctctaaggctgcattcctaactgtggaaatgaatcacacaaacgtattccactaggaacatcattcagcaattctgaatggaaaaggaaaacctcattcacagtcctagacaaagagccctaaaatccaaatcctcctctgcatagcacaataccaacatctttttccatgagggctactcccttaacagacaaatgcattgttttttcctacctctggttgattggatgaacacagcccaaatttggagagccatttaaggtgattaaaaatcattacagtgctggccaggcttagtggctcacgcctgtaatcccagcactttgggaggccaagactggtggatcacttgaggccaggagtttgagaccagcctggccaatatggcgagaccctgtttctactaaaaaagaaaaaaaaaatagccaggcatggtggcactcacctataatcccagccactagagtggctgaggctggagaatagcttgaactcaggaagcagaggttgcagtgagctgagatcacgccactgcacaacagcctggatgacagagcaagactgtctaaaaaaaaaaaaaatcattaaagtgcttcagtttgcttccaaatgtaatggcaaattcctgactcatcttgaaggtgcaacatgagagacttttggaggtagattgtggttggggatcttagaaccatctaagtggtaaattccatcacccccattgaggcacaggaggtgaaggagtgtttgtgatgagtcatgggcatactgcattttgagcctcattccaaaggggacctgcatctgaactagggtgccagcaccacatgctgctggaaagagtatgggttctcgagtttgagagatggattccgatgtcccatataccaactgtacacttcctgcatgtccaaaaagggactgatgtataactggtccatgatagatacgagagtttttcaattgcctgccttttaattcagcacaaatacctcctggtgggttatattatatcatattatattgtattgtgcatctctgtaatgtaggtactcgtatttttatctcattagacctctcagtgtgtggtgtatcagctggttttaaattcccttaattgggctaaattaatttgcccagttgaagaaaagtccacctatttgcgaattggttggtttctaaagatgaccataacaaaattatcttttttttccacacagatatagtttaggacaaatatcactagggcactgtggtacaacttaaataatgctatgaaaaagaatagttattttgttcattgtatgatgctatttaaatcactcacattaaaataatattaaatagcattgctatttataagataatgtagacaggcaatataagcccttccttttgtaaattaatgattcaaaggagaaataaaatgaagcctcatttgaatgtagtttctcagatatttagatttctttaataaatatgggaaaagctgaggcactgatacccatgtttgcatttttttcttgccatgactaaatatgtttattttgcatcaggggaataatataagaaagcctatctcagtatgtgttgattttcataagtggttctcaacagaaaaaaaaaacttatgacaagttacctagttataaggaaataagggtaaatattatttccttggccattaaaaatgttaaaaaaaaacacacaccatgatctgtgtgtaacaaaggaaagtgacacataaaccatgattcctaagtagtttttatctttactaccatcttagatccaggtatgtgtgaagtgggagaggattttcaccaatcagaaataacacaaccatcctggcaatctttctgttcatttaagtaccaatctaaaagataaagcattgactttttgtaagcaaggagcgcaaatcctgttcaaagcttcttttgattaaaatttttattcacctccttatgtccacatgcttatcaatgatccagcctgatttgcttgtttctaacatacaaaaaaagagatctgattcataaaagttaatatttttaatctctaagactaatttaaatatcagctttgtgcattaaaatattaaaggtttgagggactaatctttctcgtatataaggaaagtgagataaaagaataagaagtaaaatggttaaatatgaaggacagtaaccagctattcctagtcatacaaaaacccacaaaaaatggatttaaatcaagaatgataccaattaggaataagaacaaaaggtggttttcgattactctaatgaattattaaggtgtcttggatatagaatattcattcctggagatctaaaagaatgtccaaaacaatttggatcagaactgtctatatgtatctctggttacatgtggaaaaactatcataagccttgaacaaattaaagctgaaatggtggaaacaggaaatgccaatcaggtcatatgtgtatgacgtgatcacattacacttgggtttcagaatggaccattaggcatataatttctctgaagctctaccacgactctggtcatctatgggccagatgataataaaacactgctagttcataggaagtgactttaaggacaagaaattgatttaataaccagagagtatctttttgtttattttaaactaattttaattttatcaaagtaatacatgttcaacatacaaatgtatgaaagactcttaatgaaaaacagtaatccctgtcccatcccactccaccctagggacaatcactttcaactggcaaatatctcctctgctatgtatctccatatttcccataatgtgcctttactgctctttcctggtttatgaattttggatattattcttaacattctacatatgatcaaaaaggaattagccctcctcatcccaataccacattcttccaatataatggtgtcaggaattatgttcacccagtaacacagatcccaaaacattggctcaaacaaattagcaatttattttttcatagaacatgaagcttagggctcatttggaggctccaggatgtcatcagaaatccaagatccttctatcttttctgttatccagctttactaggtgttctgtcctcgtcattgttacagaaaggccccagtccctcagacattgcaaccattcctggtggagaaatccaggaagggcaaagagcaaacagtgtgtgttccctttaaatagctttcccaaaagccctacatagcacatagcagcttctattaaaatttcataggcctaccagacatggtggtgtgagcttgtagtcccagctacttgggaggctgaggcaggaggatggctcgtgcccaggagtttgaggctgtagtgcaatatgagtgtgcctgtgactagccactgcactccagcctgggcaacacagcgagacctagtctttaataataataataataataataataataataatagtttcatatgatcacctatacctgcaaagggggctgggaaatgttcttcagctgggcacatttctgccccaagtaaactgaggttctgttgaaaagaagcaaagggaagatgaatactggattggctaccagtagtctctgccataatatctatatcagaaatcactgccaagttaaggactgttctataacaatgcttcctttttttgtgcattcttttgttttgcctggagttaataatagcctcacatattgcttatatttatgtgtaactatttgccctcaaatgttacctatagtatcatttttcccccagagtcctaactccaggactcctccatcctcctgctacaatttagatggggcctttctaagatgctgcacacaactgcatgataattatgtagttattatcctggactttccttacttctttttatgttggttcctctattttctgggtcccattgacttatctttcttagtttaacactctcattttgctaaaacacatctttgagtggtttccaaagaaagagtacatgggatgcaaaaatgttgagccttggtatgaaaacaattgcattatattctgacatttgattgatagtatgacttggtaaagaactgtcagctagaaatcacttaatctcaaaattaaataaaatggagctcttaacttccagcactgcagttgataagtacataataaatcgattagcaaaatttcattattgataaagaagacggccttctactaatggagattttaaaattattaatattattattagtcacaacaactcagtaaacatttattgactgaccacacactctgtgcttgttgttgcaatggatatacaaatgtttgggcatgggccttgtgacggtttatgtgttaacttggctaggctgtagtacccacttattcaaccaaatgttaatcaaggtgttgccatgaaggtatattgaacatatatggtgaatatctacaatcagttgacttcagtaaaggagattatccttgataatgtaggtgggccacaccccattagttaaagcctttacagcaaaatcgaggtttccctgaggaaggagaaattctgcctcaagtctacagagtccgcacctgccagcctgccccatggatgtcagacttgccagaccccatagttacataagcctgttttatgtttctctggagagccctgactgatacaggcaatcacttaaaaaataattaatttaaataattttcctctttaaatttaaataaaaaattatagtaaaaaataaatgacagaaattgaagaattattcttgggaagtatgatattattgtattgaaatgaagtagaaagttcaattgggagtggagattttgaccacaggaggaggatataacaagcccttggtaaattcatgcataaaccatttttggcggctgaagcaggaggatcacttgagcccaggagttcaagaccagcctgggcaacatagcaagacccccatctctacaaattagtaaaaaatattagccaggcatggtgacatgcacctgtggtgccagctactcaggaggctgaggtgggagaatcacttgagtccagacggttgagggtgcagtgagccgagattatgccactgcactccagcctaggcagcagagtgagaccctgtttcaaaaaaattttaaaaaagtaataaagttaaatgaaataaaataaaaatcttaaaaattcatgcataaaccatttaccagattactcaagggcagataatgaagaatctgctatatttaatcttaagacaaactagatgctgttaaaatatttcacctttaaaagcatagaattattaaatagtaaggtttaattaacattaaaaatgacatgatttgctttgattccttaattttctagtgaggaaacaacaagcttagggtacatttctgactacatagattttttcccttctttccagtgttggtcatccaacacatttacacaacaagcaatagcgattgcactgggcacacttcccaatatatgaatttattcaagctgtgcaattgtcccctgagaaatcttgggcttagaggtatcaactggcttatctgaggtctattagccagttagtgaccaagtcagcacagaaaactgactccaagtcttatttggcccatccttgtggtatgccacattgtttcccttaaccaactgaaagaaactaatttaaggagtacctgtacacaggaagtagaaacttttttctctttttgtgactttctataagaattatagatgagatttttttttctaagtggggactcatgttgttgtcaacttaaattacctttactaatcacttcgaacacggtattccatacatttccctctgtcccgataataaaacaactggatttctgaaacctctgagggagaataaacatgctcttttcatagctcccaaagtctgtgcacttgtactgggcactgtccaggtggctgcatagacaacttcagcttgattttcattgacttttgatgtgtcctgacacacattaaaataacctatgtgaaattgctgatattcagccattttttacttacacaaacattcactccatgttctttgatctatgagatcactgagagaggtggcacaaatactgttaggtatcgtccaagggcgccacagcaatgcctgtccatgtctgagtagcgctgcctgtccaggactatccacccagaacctatgttaggtttgctacaaggtctgttaataaccaaacccgcacataactaacaagattatcgactaggctgctttttttgaagaagagctttcaaaacttccaacatcccttcagctaatatttgcaaacatgtttaatcacagatttgggaacagaacatctgttcgtttggtagagcaagctcttttactcacttcacctttcttttctttttcccttccttccttccttccttccttccttccttctttctttctctctttcttttctttctttctttcctttctttatttttttttcttttttttcggggtcttatttgtcgcccaggctggagtgcagtggcacaacctaggctcactgcagcctcgacctcctgggttcaagtgatcctcctgtcttagctccccaagtacctgagactacaggcacacaccaccatgcccagctatttttttttttttttttttgtagagacagcatttcaccatgttgcccaggctggtctcaaactcctgagctcaagcgatcatccgccctcctcggccttcaaaagttctaggattacaggtgtgagccacctcaccgggcctcactgtttctaataggtggatcaaatcctcactcaatgaacattctccaaaggaccatttatttcattcagaattttaaacatttccatttgtttatttgtaaatgaaaaagactttgtgtatccccacctttcattttttttagaggttttctgaaacatggaggcagcatattttatggcactgtgttagttcaggctgctataacaaaatactgtaccttagactgggtcatttataaacaacagacaattatttctcgtagttctggaggcaggtaaatccaagatcaaggtgccagcagatttggtgtctggcgagggctctctgcttcatcagtggctccttgttgctgtgtcctcacatggcagaaggggcaaataggctctctgaaacctcttttataagggtattttgctttaagggcatagaagatggaagggattaatttttcttggggcatttggggaaatcacgaatgagtggtgacatttgagattgttggatagttggtgagtgagtcaaaggagaataaaaatggaaggaacattaaaagggctcagtccttgagagaggaaatcccagctcatatttacctttgaggtgatgaaagcagaaggcagacgcagttgtagcttctactgaaggtgataaacagatgtgccatgggattaagctccagtatttaatggcaggagccctgggtagcttcctgtgtcctgtggctggggcatacctagggctgggatagacgcaatatttctcaaagtaaatcagagtcctttgtcagtgggataaaatgctgattctcaggctcctcagcaaacctactgaatcagattattttggtgcaggggcctggagatttgcatttttaacaatctccccagaggtttccttgcaccctcaagtttaagaaccaccctttcaaagcgtgatttcatcacccaggagacatttggtaatgtctggagacattattggtcatcacgattgtgggggtgctactggcatctagtgtgcagaatccagggatgctgctacacatcttacagtgcacaggacagccctcacgacaaagaattatcctgcccaaaatgtcaatagtgctgagattgagaaatcctgaactccatcatatgaagggctctcaaggaaaagtacaagaagtggactgaagtcagtttgtgtcactaggtggctccttaggctactcaggcagggggctagcgttatgggcttccaggcccagttatcggaccaccaaattttcacagaactgggcagagctcacatgtattgaacccatgcagctgacactcctgaagccaccaatgcattatttgctaagtaattttttttcctctgataccaacacatttaaaatctttattgaattatcgtcacaaaattgcggtcatttcttgggggaaaatatgccattagttctacacaaagtactctttgctcaacttgcactttcttgaaatccagaaggtagatttacattaaaatcatgttggctaagagttgaaaaaagttattgcttatatggagttaagaaagcaaactttggaaattttttttggtctgagtttgtttctaagaagccaactacttctccagctctcctgcaatcctgccaaggtgatgtccagcttgtccctgttaataagttcaacagatcaaccctgtagggaagccaaaccatagagaaaggtggatgcactaaatttttttttttctgaacaaaatgtcagtgtgtattgttctatgacaatagtgttatttgaaattatgcctcgggccttcagtaggtaaagattcttgttcatttgctgcatttcaaaaaaattgtgtgcacgttcccattaagatttatttttcttaaattgaatatacagttaatctatatgcagatgaggtaggtaacaccctcctttctggattgttcgttttagttaaggtgttactcataacaatttggtttcctttccagtcttttgcaaaagtagggcttcagtgcaagatatccttttaaaaatacccttgggtcctgagtgttgaacttttctggctgaaataattttgcaccttccaaatgttttaatgctgttagggagctcttaaaatgcaaggatttaaggcccttagctagttaagcttttagcagaactagagctgttagataagaatagaactcatcctttacttttggagctttggacattgtttccagctgcttccagtcatttgaatcccgaaagcgcccctaatcctcgcggaggcagcctttctggctcccaggacccacccccttgcttctgattggcgaagctcctccgcggcccaagccagccacctacaacgtctctgagaactgatttgaaataagagccaggcggtcctcgcttccctgcgaccgacttttcataggctgggggagaaaaggttgagaaacttgacattgtctcgagcagagtgcgtgtagcaacagatcaaagaaaaagaggacgaaaacgtgctctttgctgcccgtagatttcgccgggttgcttttgtcttgcgggctcctgtcgggttcggtgtttccgctctgaagactgcgacgcgggctccgatgcagctcgctccctgccggatgggtcatgggattctaaacatgaggcaggtaagctcaggcggttgcgctggcggcggagggggcgggcgccgcccgggacccctgcgacgtgttactgcggagagcttgctgggttagcaggcgcctggccgtagtcgatgcgtttggcggaaagacggggctgcattttcctaagacaaccaaagaagcacattttacctgagccaccccggtctggtcctcgccacccgcccccacttttgcctctaattgtggttgatgtcaggcagtcgttgtaaagggcttacaagcagtttgtagaatatatgtaaatcaattccagtttgcggccgctggaatgtatcgtgcaggatgtatctcgagcttttagtgcctctaccctatgctttgggctagaataaagacagctgaatgtcctgaaaaagaatttcacggggcctcttatctcattttggtttcgcattctgagcacttactgtgtttctggcggagaaggcggaaccagcttgaaatgagcacagacagtccttccagaaaaatgcaaatttgtttttctgttctagcagtttggaaactgtattgcttctggacgtgagaaggcagccctgaaagtagtgagcggagaaagggctgggggattacttaaatgagtctttgaaaagaattctaaaccaacagcttcttctgtggctctggggcatgatgataaaattccttatcagtccaggaagaggtttatagctttgctgttaagcaagaaaaggaaagaaaaagtggatgtaggaagccaaggagagggtgtgatttacaactcaatcaaagttatggaagaattttatgtcaatatttaaatatcaagaacaatactcatataaggagaaaacaaggctggaaaaacatgccaataggcttggaagggcagggatttcaagaggaatgctattgcttttaccagctctgaataaatctggatgggaaagttagcatctgtatcgcaaccggaaaagctcttcactttttcttctaagtgggttgggtgctcgccaccctgcacactttgggggaagtgagctttccatttaagagcgcaggggaggggtttcgaactttctgtccctttcccacagccttgggagatgaagcagagcccccttcgaatggtcagcgcaaaccctccgccttcttgccccctcgcttgttcgctcagcaagcaggcttggcaagtttcagtgagtgcagaaaaacacttgcggaggagcaagtgccgtctgcttgcaatgaattgcccttgccttggtagggactgtggggaggacgtctttaagttctgcaaactcacagtccaacctcatacttttaatgtctactaaagtgggatgaggaaaaggaaggagaagggtaattggaaaggattgaaaaggaaaaagaggaacgcaaaacatttttgacaaaggtccttagctggaacaaagaagttatttgatcctgtgcagagccacctgtcctctcctcggtggtgtctgagctcaatttccagaatccctgttcccacacaattcctcaggaaccatggcagtctccgtgccttatgcctaaggtttgcttcccccagcttggaatggtttttcccatgcctagtttgttgtggcatttacgtgaagttggaaaacagcccagtattgaaattttaggggtacaagtacacatatagtgaactccttagttatttaatgaatgggcaacttttcatctcacagctacgtatgtctactaatttttttggcctgttcagaactttgaaagagggtgggatggaacaggggaggagatgaaggagagagacaggatcattgttcatccaaagaacgaggacagtttccagaatctagcatgttgttccactgcagtcagaacaagaatgtagggaggaatgagatggcagtgttattggcatgggttaatccctactttatttgagtttctcttggggaaacctgactgttgcatccaggcagggtgagtcgaattcaccagccaatttgtcatctcagcccggcagctccagctggatttacagggttaactatcaaacagacctgtgtgtcatcagctcagcaatgaaattggatctctttgctgatgagtgatctgtccctagggctgcacaaatgttgtacactggtgtggcagcccagaagagacccctgcctgccactgatagccagaaattctgggtagccagaaattgcccgcagaattagaaggctgtttgcctagctataagattcagaggggtttgggcttctgccaggttggcagaaaaggaacattcctgaagccaccacttcaggtgtagaaggatagtattctttgagggttcctaaggccacggctgagttaggccaaagaaaagtgtaaatctgattcaccttgatcaggaagtaattttaaaatatgtgccaacctgtctctgccctctgatcataaacgggaaacttttatgaaccttccttgagaaggaatttgctctgttcccaggcaaaaggaaaagcatggccacctgttctagaagcctggccgaaaacaacaggtttgcctgtggcattcccgcaactgcatatatcctccccacatggcaagccacccattgtccctacacacaagaagaacaaatagttcattcttgagctgggggaaaaatcagattctctaggcaaaattgcctactagacatattttgtgtttttaacatcctgataactttagaaaaaaaactctaagggaagaaggtgcatgatgtatttctgatctactaaaacaaagtaagtcacgtagctgctaaattcttgcaaggccaggatgctgctgtttcaaggaagccgtgaatctgtttggttagcccgttctgcattctttagattggaattaaaatgcccaaggacatctggcttaataatgaaagtcttcgtattaatctttcctctgaggattagaaagtcctttacaaacacgatctatttattctctgccacatccccaggagagaatgaggtggcaatttgatcctcattgaacaaatggtgagacgaaggcagagaaaggttaagtataaagagacacagcaagttaggggcaagtctggggatgaatactcacccacccagaaagactacctgtgcaggtttaggatctcaaatggcattctagggattaaaacagaatctctcttacgacattctttttcttatcattctgtaactggcaagtatattgtgtcccaagtatgttgtatggtttccttcatttgaaagtccagactcttaacagttcaaaaggcagttctgttctcatttctcccaacattgagatcaggcagcttttatgaaatctaatagaaagatacagtaactaactggaattttaaatatgcatctgagaaatgttccctttcaacagatgttttaagtttttgcacatggtttatagagctcagtgtcttcaacatatgttaaaattttaatttcttctctgctatctctctttcagcaaatgttataatcataagacttgctgtcagtttaaagatccttgttggtcattttgaaataatttttttgagtcatgtttttagttcgcttggctgtagaccgcataggctacaagcaaatccgttaattggtagttgcatgttatccacagacattccagcaagttttaaggctaagtgcatatgtggatgtctcctggctttgatcgtttgtgtggtaaatagacatccaaggtagctatggcaacctgggctgtgcgttggtgaaaggaggggatttagttactggacaaagagtaatttgtttgattagaaaaaggtaggggcaaatcaggacatttttaacccacatgatttgaggatcccagttcaatcaaatcatttggatttttctcaataggcaaaaagaagtaatggctaagcgcaccagagtatcttgcagacgtaatttaattatttttaaacaagtggttgctactttccaaaagcaatttatacaatgaaaaggaagtacaatatatcatataaatatcatcaatatccctattgtactaagtatgaacgtttttattttcagaacttgatgggactttgaaagaccaggatctgattagaggtgtgcatttcagttatctacctgcaggggtcaggcttgaagttcccgtggtcggaagatcaggcagcggacttcactgcagggagcccgaggcagagtcagagagaattgctctgcttatttggaacaattagttagcgattctttaatcttgtgaccaaagctactatgaaaatgagttcattcaaggaagagaatatcaaatacgctgtgattaaagaaagggcgataaagccaggtcaaacagcaatctaatctccgtttacatgtaaggcagtttatcgggaagattctggctcattatcaattcctttgatttcacacaaaagtgagctcagcggttttgttctagaaatttgtttgcccagttttatgagctggcatgttataaaaatttctttaaactaaaaaggacacaatattagggagccatctggatccgaaatatttttccccctctggaggaaaatattccattgacacaagatcaggatggttaatggcctccaggaggtcaggtgatagtaggagcacagaaaattgaggcgcagaacaaaatgccaagaggggactttcctgaaaaaacaaaccagaccaaagaaaataacttacctgctttgcgctatgaaagagaggttctgagtaaacatggaagaggtgctgatcatttgtagtacaagtggatgttgaaggtcttatattcagtccagtgtttatgatgaatataatataaaggctgtccttcctttcttatatcattcaatgacatttactgagcactcacagaattaatatattctgccacattatacgtgattattaatgtgccagggcactttctgggttccaaatatgactttggtaaggcccctgccctcaaagaacttttgatctggtgtacaatttattgtaccagtagcataatgtaggtttttccatggtcaaaatggatgctcattaatatctatatttgtatgggtagggatccacttgaaaaactgatggtatccaaaaccttactgaacttaggagacttgagaagtgatttgtaattgtgaaatttagttgatttttagcccacatgtccatttgtagaaatttatgacttcttacataaagcagatttctcataattattaaatagtaatttatttttctcaatagagaaaagtaactcataggtagtccccaatctaggaatactttatgttttaggagtttgttgtttgaaacccagagcattttccagcgaaaaataatcaatctgattaatgtgagatcaagttctgtgttttgaggacatgccactgtgttatacaggatggaaacagaaggagaaagaattggcatacttttggtaataggccagtcatggcaatatttgaaataggaagttcgtactagttttcacctttctttctccatccttctgatgtcttctggtctcactggggcatctcccccaggcctgtcctaatatatagtgaattcataattgttcatcttcccacccttcccttccccacctccaaaccactctcctgtttcctttagtcaatggtctctaccacatggcaggaaagaagtaatatgggtgagccaaagctcatgactcttatccctttaacccttaggatgaatctttaattggggaaatttcaagcagtggagcctggagctacaaaacacatgattttcctttcagggacaatatttgggggcagggccatgcctttggcagacagaacttgctggtgtgtctgcccgtgggtcagacctcttcatttgttctttctcagcaacctgcctgaacttctggacccactagggtctttgtgagtaacagccagggagccacaggcccccagttgagagggaattatggcgtttgtgggtttgggttgtttgtaagtatgctctttgtatgctgagcactgtctacttggattagaataaatggaaagaaaatagctgtagcatcctcttatccacacgagtatttgagttggtgtatatatttctactcgtttgtctgcttatcttggaactgagttactccagagcaagagtcacatattaattacctttgaatccccagacccaagcccagtgtctggcacacaataagaatcattaagtgttctacaggcacatgctgggtgaattttagtaaaaaagagaatggaaaatgctccttaaaatccgaagggatatgaagaagaaagggcattagaaaggtccgggaaacagcaaggactaaatagatcagtagtagagaaaattagcataggttatgattactgaactatatgtatatggttttatatatatatagtccatttatatacacatagtctctctctgtctgtctgtctgtctgtctgtctctctctctctctctctctctctctctctctctctatatatatatatatatatatatatatatatatatattcctttcagttgtgttctgggcaagaacacaacccaaaacatggtaagcagcttggcttatcctctgtttgattgttctgcagaaatgattacgaaatgggtcatgccctccaatagctcaaagcctaatcgccaagatagaatctgctgctttctctcattgaacccagcctgatagtttaggccttaggtccatgtgcagttgtttaattttgcaggtgagtggcatgcccaaggttactccagaactgagatagcgtgtctgagagaagactgaagccttctccatgtagatggtggccacatttttcatagtgaagttcaagatttgtgccggacaaagcattttcattgctggtaggtgtaacagaccagaagttatagttaaaaatgacaaaatagaaatttcagggacatttaatagtttatggaaacaacaggactaatatattaccaaagggtctatgcggtagactgtggtatctgtcctatgtcaagttttggagtgttgctttggttgtgtgtatttagaagtggtcttccccaaacaattcggaggaagggggatgttactgggaaaatggaattcattgaatgccctgctgagttaataataagtagatgaatggccaaataaagcaatatatagatggacggcaccaccaaatattattaatagagatttatttacttacataggatcaagtcttctgtacgaaatacattaggaatccagactaagaatactggttaaagtttagcatttctgggttgacgttttagcacaagaaacactttaccctccatctgggagcaaggtatgagggagacttaggttctacacctagaagctaagtcttctagactccccatctcattctcttttgtgactgtaccacatgccttctactaagatataatttggatgttttcaggtcatgtgctataattcaatatgctaataaattccaaggcaatttgaatggaatgttggtttataatgaggcaactcaggaaagactacatcatctttagtggaaaatactgtccaaaaaatccaaatagttaaatgatcttatatttgggttttgtgcttcttttatgtgtatattctttgctctgattttagttaagtatgaaaatgtcagacagcaaaaactaggaggattatatttatataaaagaaagtttagggaatgagatgagtcatttagcccatgaattaatcagctgtgctttgaggaaatagtgcaggaaggtaaaatggaacaaatagacgagagaagaaagcgtgacttcttttagtcaacatatgatggggaaagcggtagagaaaaattggctatttggtgagtgattcacttgagttccttttcagtggtcaatgtttaaagtgaaatcctaatgagattgttgctgccctttttgtacggctctgactaaaagagggaaaacagtcataataattaattgagaggggtatgactttctgagtagataaaaacatgatagactattagataatgaatatttattgcttgatgcttctcagtctggaagagacactttctgaatatttctccgctttctaacatttcagctgtcagaattgaatggttcacatataaactacattgttttggtttaactaacaaagagtgataagacatgaattgtttgtgacagccccgaacattgataacagaagacattaatgcctgcagacacagcctacatggtaaaaatctggaaacaaaaatgcttattatgttaggccatcgtgctttgacctagttttgcttttctgcttggaaattatgtcaatattagttacatcatcccttcggatgagcaattccacattcttgtttatttcagtgtcatattattagtttttgtatatttagttctgacctctgaggagccaaactaatcctcattgacttgcattttccttttgaaatgagacttctgcatgataaagagagaggattttatgtattaacaaaacaatctaagatgcctctttaaaggcattcatttctccttgatccggagctactgccctcttgaaggttcctagaggccatccagttttctgctgatcagaattagtctttttttctttgtcttatggggatggaatagattactgggcctagaactgccatagttgaataacaaaaagtaaaactgtgaggctgatgggacatttcccagcccatcatccttaaatttgcccttttcatgtttctgctttacttcttcatccagcagaaacgggcttagcatatttttcccatttaacatttttattgaatacttttcaaaatgaattatttccgcagttgatttcgaacacatttttttctgtcatttaatactttatatcactagaggaaagaaccatttaattctttcatacatttatgaattctaatcttcaaagagtgtgagttcttcaagtgatcaacttacatcaaatttacaagtataatttactaccaaaagaccttgaacgctttttggtgcacatgttttggcattccttattaacaaatgtaatgaggcaaaagcccacaagaatatgtattcctggttcctctttaaaaatgtaccatttgctcttattttctaattaaggctttgaaggttaaaaatccctttgttgttagctcctttacaagtctcctgcctgagtgcagaaaacataagaagggagtgtcctcttcagagcataaccaaaccaactaaattttaaccaggtaaattgttgattagcattggatcatgtaaagaaacagtatgaaagtaattgagataggcacaactcctaattgtgtgatcccagggggcttcaaacattgtttgaaacattcacctcagagattatattccatgtctgatccttatgctaatttgaatactaggatcctgaagaaaaactttataggatttcttgagtccctaattggtatgtaaacatcgtcattcccaagctgcccaaagttgtgaattatagtataccatgtgtctcctgttgtgatatcaatttctacagcaatttttctgcttgttgtaggcaaatgtaaatatatttccctcctcttacacaaatagtggcctttcacatacattattcttcaccctggcttttttctgctttagagtataccctagagatctttccataacagtccacagagagcttcctctttaaaaacaaaacaaaactgcatatcattgcactatgacgatgtaccataattgatttgacccttcccctactagtcacgtggagtgtgtccaatattttgccattaaagcaatgtgcactgaaaaacgttgtgttcatcagtttgtatggggcggatgtatctgtattaaaaatccccagaagtgggattgctgggccaaagggcaaatgcagtttctaattttgataaataaataacattgtctaaccagcctgtgtgagagcactgccccagagcctcatcaatagagagcattgtccaacttgtgcacctttgcctatctgatatctgaaaagcggcatctctgtgtagctttgcattctcttctgagtgacgttgagtgtctctgcatgtgttgaaggtctatttgcatttcttgtgcaatgtctgctcatatcctctgtttagaaaaacaaaaagaaggccgggcgcggtggctcacgcctgtaatcccagcactttgggaagccgaggcgggcggatcacgaggtcaggagaacgagaccatcctggctaacacggtgaaaccccgtctctactaaaaatacaaaaaaattagccgggcatggtggcgggcgcctgtagtcccagctactctagaggctgaggcaggagaatggcgtgaacccgcgaggcggagcttgcagtgagccgagatcgcgccactgcactccagcctgggccaaagtgcgagactcagtctcaaaaaaaaaaaaaaaaaaaagaaagaaagaaagaaagaaaatgccaggtctagtacaacgatgtttgatgggtttttttgacaatgataaaactactatttagtaagagaatcactcccggcagtagacttagaagcacactatcagagaccctcgagtaaagaccctaacgtgccacatcttaactctgtgaccttgggttgattccttaaacttcccaagtttcctcacctgtaaaattgaaatgatgtggacaactcacagggtttatagaataatcactaaatgaaggattatatatataaatgatatataaagcacttaacagagtattggttacatactaggcacttaaaaatgttaggttaacttctctttttttaggtacaaacttaaggtttcagagaaggctgggttttatggacatttctacctcttaccctctgaatgaatacacatccacccacacagaggcatgtaaatatacacatatgtacacacggtggaataatatctgaaatggctgtaatgattcaaaagcatctctttagacaaatgtgtgtgtgtgtgtgtgtgtgtatgcacgtgtgcatgtatatgtataaatatccctgtaatgtaagaaaactaatttgttgctaaaaatgtacccttttcggacaaattatcctaatatgctaaaacaacaccaaatagtattaaatggacatgatcacttatcactacctttcatattataatccaaaaaagcatatttttccttcatctatcttattctttacaacaattaaactcttttacaatgttacacaccttatacttacagctatacctagaaataaaattacacttatactcatgtttatgtatttctgtctttaaaacaaaaaaataaacacagcagtaaatacaaaaggtagaaatggaaaaaatgcattttagagggcatggtgctgagggctgagaatataacactggtctttaaaacaactctaccactgtgaatgagaccatttgggtgatcttgtttcccagggctgtgttgttacagaaacataattttaaaaattgtattttgaaataattacagatccataggaagttgcaaaaaaatgtactgggcagtctgcaccctttacccaccccttaccccatccctaacccccagaaaccagtaatcatctgttctccatctctataattgtgctacttcaagaatataaacgtaatcatacagtatgcaattgtttgagattgacattttttcccgctcacttaattttctagaggtttatccaagttgttgcatgtatcagtcgttttttcctttttattgctgagtaatgttccttggtgtggatatatgacagtttaatcatcaacttgtttaaggactttggagctattacaaacaaagttgctatgagcatttgtgtgtaggattttgtatgactgtaagtttgcatttctctgggataaatgcccaggagtgcaattgctgggtcatatggcaagtacacattcagttttgtaagaaactgccaaagcgtattgcagagtggctgaatcattttacatccccaccagaaatgtatcagtgacccagctttctctgcatcctccccagcatttggtgttgtccctgttttcattttagccattctggtaggtgtgtagtggtgtctcatttgtattggttttcaaaaagtgcagaagatacttcataatccagtttgggtgtgttcaatacctcccaggtaaaattctcacacataatatgggcctatcttggtacatgactgaattgtcaaaaatatctatgattgctgccttttttgttgaaccttaactgaaatattgagagcaaaaaagaaactgtgttgtgcaaaatatatccgaacattagactgggcttcaatttatactctgagacactcagagaattgttacttgctcaagacatggcagatgcacgccccaacacctaacttcactttaggaatagacacattaggtatcaggaaaaattgctaagactatttaaattcctctccccttttccaacatattccattgcctttgcatttgcataaattaaataggggcatgatctgtcttcattgtcaatatacatgtagatgtgtgtaaatctacaaacatacatatacacagacatacatacactggctctgtgggcgtcaatcccaaatgttccccaacatccagtctagattctcccgggtcaggatttctcaactttggcactattgacatttggggtttcataattatttgtggggctgtcctgtgcactgtaggatgtttagctgtatccctggccttaagcaactggatgccagtaacactcccatgcccccaaagtgtgacaaccaaaaatgtctcagcacattgcaaaatgtctactgggggcaaaataaacctccctttgagaatcactggggtagacagaagagaaggagaatctcaggcttcaggttacctcactgggtttgctgaaacttgataagaatctccttaccagcggggatcaggttttggtgcccacctgttcatttctgataactaccaatctctaaatctgtttctgcaagttatggctgaagattagtggttaacagagaacgatatcagcctttgtttcttaaagagcttatattcaatgctttaaaatacaaattggatctggcactgttgtggttcacacctgtaactccagcactttgggaggccaaggtgggaggattgcttgagccagggagtttgagaccagcctgggcaatatactgagaccccatctctacaaaacaaataaaaaattagccaggcctggtggtgcaaacctgtagtcccagctacttgggaggctgagtcgggaggatcgcttgagtctgggaggtcagttctgcagtgagctaagatggcaccactgcactcgcctgggaccttgtctcaaaaaacaaaacaaaacaaaataaaataaaacacaaattgaacacacataattgaaaagcaaacttcatgcatacctggttttgttttacttttaatgatgttttatcacttatattagatatcatgattattttaacagatacaaaatttaataggtaataaaatacctcataaaatagggtatatctccatatgcatagagaattttatagagaaattggcacaattcctggatcttcctctgattcaatgtgtttatctttgaattctaataggttttaaaagacatttaaagaattgcaaaacaggcaaaggaaaatatgatagtgttttataatttaaattatgtctacatggcaacaataattattatataaattatagaaaatgttatgtattttttaactttataaatttacccctacttgataaataatatattttgtatttattacatttggtatataaatatatttctactttagaattaaaataaggtgaaaatagttattttttgaaatactgttaagttgcatattcttacctgtattagaattaaaatatgtatcttatatttatatataaattacaaattacctgaaaaaagaataaattataaccgcatgtaaaaataaaatattcctgtatcagttgtgcaatttaaattccggttttagttttcattctttaagttgttacatttggaagatttggatagtagttatcatgaactcactgttatctatggctctgacagtaaaatacgccattgagttgtactgtaatatgaatctcccgggaacgctaagccaattcagaatgaggcattcctgtctcaggaatagagatttataaagtgaccggaggtatcactatttctagaggaaggtgcaccttgaagtattctcattcttttctatgcatttatgatcccagcctactaaactcaagcaacacttcaatacagcaaagcctcttggaagtatatgagtttaataagaaaatttatgaagaaagaatacactgaaatgcagactgacccccaaaataataggatactttttaaaaaatgtattagtttcatagcatggcaaataatactcaaaaatactttgaaaatgcacattttaaaaatgcccaaagggtttagtagattatgttgagagaaggcattggaggaagaaacattatagccataagaaccaggaaaatgatcctcctttgtttataggattacaaagaggaattttaacttctaaagtgaaaatacaaattacttgtgtaggctaaaatcacccttcttagaggaaatggtacaaattttcttcatatagtttatgttcctccagaaagtctctgtgaagtgataacattataactgcatgcattctcctggtgacttcatttaaagtctgtgatgtagtaacatcatgcacacttccctttcctacagagcccttatgttctctatagaccaagaggttaattaatttttagagttatatagcaaagagttgccagaaccccaaataacatatctctaatttccaaaattgcctgacaaactatattttaaagaagccatgttattcttaggataaacctaataatgtcactttaatccccagtcatgctcatctttgcctttcttccaatatgtgcaaggaatatataaggtgaccttttaaggttacagtatcttcttacaaattagagttgatgcactgaggttataacagcagctgagcattctcaaaagctgcagattgagccgacaggcagattagcaagtacataaaatgttagtagagaaaaaaaatagacttcaattttttggcaatcctgttaaacaactctgtgaataagtctttgaaacttgtacagtggaaggtttgaattttcctcaatgcctggcacaaaacttacctatctgttgcatatgtgcattgctgaattaattaatggaaagtaaaattttaaaatgtaaccttggttatttgggataaaatggcacttccatgtaatggaatgtcataactgaaattgtagggattttcagatactctagctggcactaaatctcatcagagcccttcaagttataacataagatagcatattcaatatgagaaaatatttaattgtcagccttaaaaatgtatatagcagaggcaatcccttttttttctgacaacaaagccttctaaaagcttttcaaactatacagctttgagatttataactttgaaccaagaaaacataatttcaagaaatgaagagaacttctgattaattctagtctaaggcagtgaagtcctgctagattttaaagtattatattcttcataattaatgtcaagataggttcctccctgtggctcattattttcttgtaaaaagtacatactgcctgtgtttttaaatttcaggttttctcatgccgctcttgtctaatgatccagcaagttcaggcatataatacttttgaagaatctatatttaaagactaattatttatgcatgtgtgtctatgtattttgaaatatatatatttcaaaagactgtttttagcctttggctcaaatattttttttttaaggaatataatattgaatatctggacaggttaaaaatctccaacatttaactataaatgttaactaatgctttccttttcatttgttaaattgctgcataaatgctttaaaaagtatgttaccgttggcattaagacatcatctcttttacttaccaaagtgcaccaatctttgggattgaaccattgtagctgctttaagccaaaaattctccccagccgggttccttatcatcacccttgccacagaatctatatcgttgggagttaaagatctttggtctcaaaccttatcctggttgaattcctgtcatatcaccagcaacccctttctaatggcccccaggaatgctagcacaacaggggatcttcaggaggctcattccaatgagagacatcatttgcagtgacaaagtttgtccttagatgaaatctgtatctctctctccctatagcttttacccctgtttggccccctctctacaacacagaacacgtgcagttactctgttctctgacagctcttcaaagacaaagctaacatggccttctgggggcattttttccaggttaaatatgcccagatgtgcttgatttggactctatcctttaggatcaagccatgttagtaagtacaaatgtccaacatttaaaagaactgttcataagagagactcaccagattagaggaaagagataccattcagtttctaatacacagtgaccttaatgccactattttaagctctctctgcctggattgtagagactttgcctagtttacctctggaatagaaattctgaacctttgctagtgagtgagcaataacaatgatgacagacatctagctagatactaagaaaaaaagtcatgaatgaccaaagtgtgaattttgtttctttgcttgtctgataccccatggctatttgcaatatcttattgtcatgtgctaaaggatttaggatattaatcaaagagaaaagcggttctaagatggaagaaaagacaaaaatgtgggcagataagtaggaaaagaaggggatgaggattcaggagctttttccaggtacttggaaagttgaaggcaacttaaatcatttttaataatttaagaaatatcatttttcatttttatataaaatactaaaagtctggaaaatatataggcaggcacagtgtgttggcaatatgctgtttacaggttggcaaaacaagccagtgtctaatgaaaaggaaggttgcgaagagcttagatctgaaactgagaggcatgtcttgttccacaccttgagaaacacttggcatataccaggtgctctgtaaatatttgcttagtaaatgatagaatgagcatgtggtggcagaatgatgccttacatggcattacccagactcataggcatccctagggactgtaagaaaagtttgtgggcttttttcagcgttttgaaaaacccagaagatattgtataattactttttcaatgattgttttatcaaatacttctaaacctgaggatttatgaagttaaaagtgaaaaggttttttaaaaaatgttatgccaaatgagagaagccagtcacaaagggccacatattgtatgatctttttatattaaatgtccagaagaggcaaattcatagatccagaaagtagattcgtggttgccgggggataggggaggggagaatgcggagtgagtgctaatgggtatggggtttcttttgggagtgatgaaaatgctctggaattaagtagtggtgatggttgcaaaactctgaatatactaaaacccactgaattatacacttgaaatggatgtttgtaatgtgtgaattgtatctcaataaagctgtttttaagaatgataagcatagcatccaagcatttaaaaatttttttaaaagtggtcattggtggtaaaaaaaaaaaaaaaaaagtcagaaactatttgcttaattgttacagagattttatcccagattaaaatactccaattccgcactttgggaggctgaggcgggtggatcacgaggttaggagatcgagaccatcctggctaacatggtgaaaccccgtctgtactaaaaatacaaaaaattagccgggcatggtggcgggcacttgtagtcccagctactcgggaggctgaggcaggagaatgggcgtgaacccgggaggcggagcttgcagtgagtcgagattgcgccactgtactccagcctgggcgacagagcgagactctgtctcaaaaaaaaaaaaacaaaaacaaaaacaaaaacaaaaactccaattccatttcgccaaagggaacaagcagaatattcccacaaccctagggaacaggggtaggcttggctattagtcattctccttcttccccattcccaataattggaaaaaaaaatgtgtgtgcacacgtacgtgtgtgtgtatgtatatgtctgtgtgcatatgtgacaagggcagtagtcagagcaggatcatgtgactaccaggatctatggacagccccacactattaggggagaaagtgtcaagctatttgtacggttcttatagagcatgaatctaggccaggggtcagcacccttgttcataaaggaccagacagtaaatattttgggttttgtggccatgcagtctctgtccaaacccctcagctcgacatagactatataaagcaattggaggtaactgtgttccaaaaaaactttatttatagacactgaaatttgaatttcacataattttcacaagtcacaaaataatatttaaacaatttttttttcaaccacttaaaaatgtaagaaccattcttagcttgtgggccacacaaaaacaggcagaggcctggatttggtacataggcggcctgtggtctatagtttgcagaaccctgctctagggtaatgactgagaaagggactctactaatcagcaggttgttgggaagcacgttacttaccttaagccagtataaaacttaaagcaataatgctacattatgtctaaaggctaagctagtgagaggctaaattataacactcaacttttttagcaaataattatgaagcatcagctaataagaccttttcttaagagtattcagagtataataatgctaccttgtgtggtttggggatttttattttaagttagggaagctatgaatctcttgaactttgtccattaagaagtctgccaaagctgtgaattttaaagccatgggaatttttcattgcgcttggctgctgaattttaacagcaaagttattcattaagtccacatttaaaaaaaaaagtatcaacaatgcttctttatactttatctgcatttgacacacttccagatagatgatctttaatttgactaatgagtgcatcctttgttattttaatgacaagtaatttacagaaagagaaaagcttttcaacacgcaagtctcttaaatctggaatttaaagtccctgatgttcagaagcaggaagcaacagttggtgtaagacagggccactaggacactggaaatgcatcctgggtaatgagtgggaaatacaaaaggaagaaaacagttggaaatatgttggccattttatatgacactttctgggtttattttcaggttggagcacaagtcagaagctgaagaacttggagattttggggagcatatgtcccaccttccccaacccccaagtatccaaatatcccctttggttctatcagagaagtattaagatttattaattagaagaaaaattaaagttataaatgttcaataggaacataaggagaattcaaaaaaataaaatgttgagctcaccacagttttcagcagaaattttactcttttttttttctttgttgagatggggtctcactatgttgctcaggctggcctcgaactcctgggctcaagcgatcttcccacctcagccacccaaaatgctgagactacaagcatgccactgtgcccagctaaattttactctttaactgatttttcaatgcataaataaatgaataagtgggtaagtacttactgaggacacagttttcaaccaaaccctgtagatactcaggatgaattaagcatgggccctgccttcatggggcctagggtttactcaactttacagaaaacccagaaatatcctaacaaatgtggcaactgaagaactttattcctaatcctaaaactcactttctttattctcagagcaatggatacagcattctaatgtcaaatcattgtttccatgttacacaatactctaactgtcaaggctaaaccctgtcttaaggaagggtgacaatggctttgttcttatgataatagaagagataaaaagattatttacaaagctacagcctctgaaaaattggaagtattttatacaaacaaccacctcaattcttctcacagtgatatttaagtgtttgtgcgtgctggtttctgttatgtgggtctttaccattttcattcctccttgcagctctatgagttaagtattactattattcttttacaaatgaggagcatgaggcctggaaaaatttaaaaacatgcagaggtgataaaatactgggaaagtttcacattcaaccatgtctgatgcttaatccttttccttctctttccaccatagcatatgatcatggcatatcatcactgtttctgtttcccctatagaaaattcaggaaaattaacacatggaagagtattcagactttcacttttcttcttacataatctttgagcagcccattataggaaaataagggcattggagatttgaagaggcagaatgaacacgttctagatgtagaaagaaaagttctaagcaggtaaaagacaaccagagtgaaatacaccagatggatgcttgacttggagaagatgctaagcactaaataagccaggtggtagagggtgtgaaagcggagagccctgagaaattgatcattaagcggaaggtgattaaaatcttcctaagggacagttggtcagagcagaggtcaagagctaggacttgtctggcaagacttattgtggattcttgaagggttaagaagtcagtcagagacccgggattggatactgtatttgaactgattgtcactcaccagaatctgtgatctaggagacagacattgccaggatcccccccgtcaggatggtcatagagaagggaaggtgtgttcatttactattgctgcatagcaaattagcacaaatgtacagattaaaccaacaccccatttattagctcgtggctctgtaggttgcaagtctgggtggcccagctgtgttctctgctcagggtctcacaagactgaaatcgagctgttggccagacgaagctcttatctggaggccctagggaagaatttgctgccaagctcgctctggttgttggcagaatttactctctggcagctgtaagactgaactccttgatagctataagctgtggtccactctttctaagggacatctgcattccttcttaagtggccatctccaacctcaaagcaacagcacattgagtccttcacacacatagaatctctctaaattcctctttcatcagtcaggaaacgttctcagcagttaagggttcatgtgattaggtcaggcccacctgcatcatctccctttctaacatcaactgtgctctgtaacacaacacaatccaaggagtgatgtcacattcacaagttccagggcttcaggtggacatctttgggctgccattttagaaagtctgcctaccacagaaggtgatgaagaatctcagctcctgccttgctccttggtgagctgtgtgacctgtaataacagcagctttgtggaaaattggcccaccctttcctagggttaaagggccaaagcgaagttttgtgactttttcttcctcttctgacactggcttcttcctctaaggaaatctgctgcttttggtgttctcttctttccttcaccatctcctggtgttggtgccaagaagcactggaaggcaggtggtccatcaatttagggcaactgaaggttttgagatcaaggcatactggaggcccagacatcacaagagggcagcacagagcaagagctgataaatgttgagatgcagacttagcaggccctagctctttctgagatgatgtgttcatctgccctcaaaacatcctctcactcaacatgtgcctcctaacccagaccccaaggagtctttagtaagaacatggcagatatcacatgtgctgaccatggggttatcacaaaacattaactctccaaaaatctgctgcttggaaccttggtttctgcaactaagaaatgagttaaaaatgtattcaaggttgataaatttaaaatggaaaaaatcatcttctgaactctagcaatatgaaggccactttttacaagtctgatgctgtagtgcagtgtttacaacctattttcattttcaaccccctgtcacaaggagcctgttgaaacattttttgctaattgctccttgcatgaaattttaataccacaaatatagtataaatctatttatgtatatctgtgctttgtgcataaaaagagtaaggttttttgtttgtttgtttgtttgtttgccactgagaactagttttctcgctcttgggggcaatattgcccctattgacagtgcatgttataatggggaaaaattgctaacattttaatatttagtaaatcttcagcttatatagtctatttgatttggaaggtggctgtaatactttagttgtactaaaaggtacttgaaattaatcttgaaaagtcagaagaatctttacacatgaaaaatcacccaatatattatatttaaaataacaacttgcaaaacaaaacgtaaagtctgatcccatttttgtggctaagaggtacagaaaatgactagaaagatcaacctgtggaatgttgcttctttgcggttagatccttctataggtgttttgctctttgggaatgttataaatattcaccaatatacattatacatatgtataataaatacatattatattcatgtcaagaagaatactatttaaaaagttagccattctctctctctctctttttttttgccttcaacatttaggattaatgggcagtataaattcaatcattcacatgtagcaaaaggagaaatatttcacatggcccattcatgactcctttagatctctagagggcttcaagcctcaaagtttattgttgcattcttcttaattctggttgaatgcatgtacattattttctgcaaagaaataccacccactaaagactgttccttctcttctaacagggttttggtgtccccagggctcccttagtcctatttactttggatatttcaggagttactgtaggtttaactgtggtgagtccttaagccctctttttaaattcataaactgtctctaatcttagcaaaatgtcaggttacacttttgagaggtttgggaacttgacattttgtagcccagttggggtgtaggctgcttctattctgagcaccttgttccaatttatgtcaggaggaattatatacaggtcagggctgggagcaggttataattaatggggtggacaagtggatttttaatgtttcataaaataaaatggaaatcacatgttcttggaactgttgtatgttttaaaatatttacatttattctagtaaacattaattataactgatatatttctcctatgaactcgctaactgtgaggtcacaagccattgttcactgagtagaaagaatgggtgacaagctagttacaagaaaaaagacagtacttgggcgggtatcggtgagtgaactcgtggaagtaatccagtcttaggtctttctcctaattttctcttatgtttaaagcacccccttgccaatatgatccagatgtcagtccttctaagacagaactgggagggtttagcctgtgaaatttctgaatagctcctggtgaagaaggaacacatgaccaatgtttaactatttgtcttttcaaaattaaagtttagaagtagttgaaatactgccagaatctacagcgtccacgttttattcatattagtttatcaaaaatttccaattccttgaagctgtagcagcaatatgttgctgaggaaagaaattttttttaaaaaaaatttgtacttataattgacacctaataattgtacatatttatggggtacaatgtgatgtttcagtacatggatacacagtataattatcagattggggtaattaccacatccatcattttaagcatttattatttctttgtggtgacaacagtcaaaatattctcttctagctgtcttgaatatatattacattgttatttgctgtagtcaccctactgtgtgatagcacatcaaaacttactcttcttgtctaactttgtgtacctattgaccaatctctacccgttcctcccttcccccataccctcagcagcctctgggaaccactgttctactctctactgctatgaaattgacttctttagattccacatatgagtgagatcatgtggtatttatcttttttaatgtttttaaattttattttattttatttataatttgaatttttattttagattcaaggggtaaatgtgcaggtttgttccatgtagtaattgtcttctgtgcctgacttattccacctaacataatgtcctccaggctcatccatgttgccaaaaatgacaggatttcatcctttttatggctgaatagtattccattgtcctaatcatccccataaagaaatatattttctttatccttttgtctgtagatgggcacttaggctgattccatatcttgactattgtgaagagtgctgcaataaacatgaatatgcgggtgtgtcttcgacatagtaatttcacttccagaaagagatctttaagagtcagaaaaacccagattctaaactggtctctgccatgtgccagttgtgtggccctggagaagatgctttaactctgtgtctcagtttcctcatctgcagaagggggaaaatgatacccactatttagggattgggtagggattagacccaatttgtataaagtgcctggcatattgtaggtatttttttaaatgccagttatggatatatgaaggaaagctccaaaaaatgaaattcaaaggaagccttatgtaaattgcatcacatgtcaaccatttgggtgttaggaatattgatgcattctttattttgcctagaattcatcactccctaaataaatattatttccattaagtcaccaaattttatatatattctttgtcttgtatggtgaagaattaatacaagtgcgctactctattagggtataacagttacctaagtaatgtatcatgagacctttttgcccttttctaaggaaaataagtatttattggaaggacaacttcacacacagtcagcaggtaataatccgcagtacttcccaatgctgcttctatgggctggaagagtgtttggtggttctatatggcacagggctacttgtccatacccttgacccaaggatgtcacgtgcacccaatcaacctggaaatcactgtggtgacagaagttggggcccaatcaccctcagggccttgacactgattttgagtataccagtttggaaagtctctgcagaattccccaagacattaagtttataatatcccttgaggggtccttagaaagaaaaagtgcctatgttttggtgtcattatcgttcttcagggcaaggcttggtgaaaagatactgagagaagacagtacagatagaaggacaaagcgaacaaaaataaggacccactgattttatctttgcaagctctaaactgagttacagattgagatctaaaatatatactcaatacatgcatcctcaaaatgttcttcacacatttgtgcccaagacatagtagttgataatattaatacataaatatatatacacacagatatatatgccttacaatacagtcctatttttagtgtgtaacaactgtactattttcaaaatagtcatcggcacaaacaccagtaccacggctaaatctgacattattgatcttttctccctctaagaatatcttttgtaggcccataagtgagagatggcagatctcctgagcttcattcagtcctttatggaaatatttatgaaaaccctactgtgtgctcagtagctatcagagttcttggcatataaaagatttcaaaataaatttgcctagtattgctttgggggatgaggacttggtgatatcttcctctccccaaaagaaaaagtggtgtgtgtgtgtgtgtgtgtgtgtgtgtgtgtgtgtgtgtgtcagagggacagagacagaggtagagagacagagtgtgagagtgtgtgggtattcagagagagaacatgagtcccagtcttatccttatcttccctcatacaatgcaagctatttggaattgtagagctggaagtgatcttagctaacattttcccaatctcctacccaatacaggagcgtcttctacaataaccttcatcaaagggtggaacgctaaaatgtaagactagaggtctctttttgttgggcaataatttgattcaattatggtgtcattatttggtaactcaggtggcacagtataaatttctgtgggaaattggaatggggagcccaagctggactggacatgactgcaccatggaaggaggacatttgggaccagtcttgagctgccattgtgttccactgggaaactaaacactagtgctttctcaattagtttatatatttctcaaagtattccatagtctttagtttgtgctaacaaaattgatcggaagtactatattaaaattatcattcattttttactcttactgaacagcagtgagaaaagcaggaatctttgtcattttgtttagcatgtaaatgcacaaaaacctcagcttacctgaactttgctaaaatgtcaaacctttattaaccacaagttttctacattatacttttcctaaagatttgtgaaatacaaggaagaaggtgatattatgaattactgtaaaaatccatggtcatggatacaattatacattcaagtcaatctcctacgtcatctctatttatgatcaaatgaaaaaaggtctttttaatgatgatctcaaggaaaaataagatttgaaattacctcaaacttttcaattagatccaatatgtgatttgtagttatgcaagtaaagtggactcaagcattgtagaaatgtttcaattaggattttttttaagttaattgagatttgatcatatttttattgtcatctttgttcccacatggaaattaattccatttcagacttatttcttggagggtgtttagcatagttatcaccttaaatgagtagggtagggtgcgtagggtggcttttcatttttggaatttaattattactctctctatatatatacatgtatatatatatgaaaaagaaagagcttgccttggcagaagtgtttaaagaaacatgagtagttaatgccctcactgtgatttgacttccatcttcctttttttaagcacatttttcattttttccccctttaaacctgccatttagagctgaaaagtatttttcaagaaatggagcaatgctttctatcccatttattaaagtaatgcacagaaggaaatgcaccgtggtaaaaacaatttatacgagaaatgataatgttttgctaaagataaccaggaagtgaggaggagaaaaaaacccctcaaatagcagagagaggccagatggtctttttttttttttttttttttttttttttaacgcagtccctaagcaggaaattttgtttgattaagaagacactggtcttgattttcattcagcagttttgaggaactttttttaatggacacacacacatatacacacacacacacacacacacaccacaagccattttcattcagccaaattatcatttgtgctattgtaagcaagattctgctgatgaaaatgtgaagtcttaatgataaagaagaaaacgagttcccaagtctcagttatgaaagaacttggaatttacccactaccctaaagacgctcgatcattaccatatccatcatattgttgtaaggtctggtgttttgttttgttttcttttgatagcctggaatggaagaaagactgtgtaccacagtggctaactagggttttgtgagatacagggtagacccgggggaaaaaatagaggttttggagttcaacaccccagggggctaatgtgcataaagcgactgctccaaaggacctgagtttaatccttggagctgccagtcaggatcaggatgaagaagcacccatgcaaagaattgcttctggatgctgataggcagggaggtgaagggggggaggtgggaagggggaacggagcacccctctttggactgtgatgttttggcagtcggtgcttggaggagggtagctggcagtggctccggcacaataaagctcccttcggtgaagtcaccagcatccttgccatggtctggcaccctttgcccagcacccctggagtgtgcaatttcccagtctgtattctaaggatgaaaatgactaaagttgtgaaactaactatttgcatctgtttcaaagagaaagagtcacttggaatttggaatggaaagaatagatttagacaactggcagaattgttcggaactatgccctgaatcaagagaccctgttgacttatataaggacaagctaaaggagctacgtaaaagagagaaccaacatatctttaccatgaagatgacaaatcaggcattcaaatttgttttttcaaaaatgaaatgtgttctcatatagttgtgtgatactttctctaatcagtattcatatttatagtcaaaataagtataacttcactttaatatagcttagccaccttgaaagctcactgttcttaaagctagatttttttgtaagtgaatttttaagccctagattgcatcttaagtactgagttattttaattttgcctttttttttaatgtttaaaagccagcttcttgtctaatttgattcaatggataaaatgtacaggatgaaactcacacttaaaatgcatttcaatgagaattaaattgtttaaaatgaaacttttttcctttaaattttaaataaacaaataagatgcaaagcaaaataacaacaaaaaactcttaagtcaactcccttggggataagggataaccttagggataaggtcataccttttgatattaactccaaactcatgccttgtattcgtgttttacaaattacatttataatttatctcaaagataacaaggaagcatactttgataatacaagaagaatctctcagactttagcctgccttgagaatatgttttaaaagccattagaagcttcctagcgtttatgggatttgttcttatatagagtacatttttttttacatatattttgggcagaattctcaagtctccaaataaacagtttaaatcttggcttttaggccaaaaagtctttgggctgggaataactcaccctcagaagactacttgctttataacccctcccctggaatgctgcgaccctgtcttcccacaaaccttatttgcttcactgtggaagagtggcacagggcacccaccacccagacttcccaagctcttctcttggtctctgctatagctacaatagcaactttattctcctacaactgagagaagagagacagaccctctcatattgttgtatattgttttatactcagaaaaggaaagagaagcaaaactaaaggcaggtagcccggcgcctaagaaccagacgcgaaaccaaggaaccagacctgaaaccaggcctgggcctgcctgacctaagcctggtagttaaaattccacccctgacctagcaactgatgttatctatagattatagaaagacattgtaaaacttcccggtctgttctgtttcactctaaccaccagtgcatgcagcccctgtcacgtaccccctgcttgctcaatcgatcacaaccctcttacgtggaccccccttagagttgtgagcccttaaaagggacaggaattgctcactcggggagctcggctcttgagacaggagtcttgctgatgcctctggccaaataaacccctttcttctttatctcggtgtctgaggagttttgtctgcggcttgtcttgctacatttcttggttccctgaccaggaagcgaggtgattaacagacggttgaggcagctccttaggtggctttagcctgccctgtggaacatccctgcgggggactccaaccagccggagcgacgcggatcctgagagcgctcccgggtaggcatttgcccaggtgggacgcctcgccagagccgtgtgtggcaggcccccgtggaggatcaacgcagtggctgaacactgggaaggaactggcacttggagtccagacatctaaaacttggtaagactagtctttggaacttgcccactccatttgtgtggaagcgtggtctgatcacccacggcatgcctttatcggcactttggttttggttttgacttggtttgaattgcttgacggaactggtcttgggaacttgcccgctccatttgagtggaagcgtggcctgatcacccacagcgtgcctttatcagcactttggtgttggttttggttttgacttggtttgaattgcttcacaggactggtcttgggaacttgcctactccatttgagtaggaacttgcctactccatttgagtggaagcatggcctgatcacccacggtgtggcagtaccggcactttggtttttgtttttgacttgacttggattgcttgatacttggattgcctggattgcttagttttggttttgacctggcttagatttctggatactctaattttggttttgattctggtttggtgtaaactgcaaaagtgtgtgtgtgccctttttacctgttctttgttttgtggtgtgcgtgtggtgtgagcatggtgttttgtctcaaagaagcatgggtcaggcacaaataagcccaccctactaggaactatgttgaaaaatttcaagaaaggatttaaggaagactatggagtactatgacaccaggagaacttaaaactttgtgtgaaatagactggccagcattagaggtggcttggccatcagaaggaagcctagacaagtcccttgtttcaaaggtatggcacaaggtagcctgtaagccaaggcacccagaccagtttccgtacagagacagttacagctggttttagatccccttccccccacagtagttaagagaacagcagcataagcggctggcagaggcaaggaaagaccagcagacagaaagagagaggcagaaagagaggaagaaacagaggcaaaaggaaagtcagagagagacagagagacagaaagtcaaagagagaaagaaaaagagaaagagagaaatatacaagtagttaaaaaaaaaaacaacagtataccctattcctttaaaagccaaggtaaattaaaaacctgtaattaataattaaaggtattctcagtaaccctgtaacactctaatactactttgttgtcagtgtaaacaagggcatatcccaagagcactgaggccttcctatcaaaaatccttaacccagtaacccgcgaatggcccagatgcattcaatctgtagcggcagctgctttgctaacgggaaaaaaaaaattatgcaaaaaatgttgtataatttaaaagtactcagtactattgaagaaacagtttatgttcaaggtgtataagaaaagtaaaatatacctttggtaaaaggattataaggaggcataagaatgtggatttttacctacattaaaaggttaaaaaaattattgttttgaaagtttaagcgagttttgagacgttaattgtaaagaaaattctgtgtgtaaacatattagctaaagttaaaaaggtatcatccagtttttctgtgaactggacattaaaataaaaatgcaacaggtttttcttaaagcaccaacctgctctttaacaaaaattatgaaaggttaaaaagagtatataaaatcttgcttatggtcaaacattaaaaattagataaatatgtctacaaggttttattaaaattaagtttaacatcaataacactaatataaaggtaaaatttggcttatctagtataaaaatcatacagaaagcattgttaaatgtaaaatggtatttggctttctttggtctaaaaactaataaaaataggtgctaaaggaaacattcattttactagaagatcataaaagttaaaaacttaaaacaaactttggcaattaagacagcataccaagatgcaaatgcctggttggaatggatcaaatattccatgtgcacgttaaacaaaagcaattgttatgcttgtgcacatggcaggccagaggccctgattgtcccccttccactaaggtggtcctccagtcgacaaggcatggactgtgtggtagttcttttccaggattctacagcctggagtaataagtcatgccaagctctctctgctatatcccaaagtccggcaccctgcgggtcagcccccgagggctgtccagcctccgtctcccaacactaagttcacttcgtgtctctcacgacagggaggaaacttagcattccttggagacctgaagggatgcgatgagcttaagaattttcaagagcttatcaatcagtcagcccttgttcatcctcacgcggatgtgtggtggtattgtggtggacctttactgggcactctgccgaataactggagtggcacttatactttagtccaattggctatccctttcaccctggcatttcatcaaccagcaggagaaaaaataagacattgtaaagcgagagaagccccttgtaggtctttcaactctcatgtccatttagacgcaattggagtcccatgaggaataccagatcaatgtaaagcttgaaatcaaatagttacaggatttgagtcaatattttggtagatgacagttaataaaaatgtagattagtaaactacatctattacaaccaacagcagcaagcttttcatgagttaaaagaaaaactcacgtcagccccagccctggggctacctgacctaacaaaaccctttacaccctatgtgtcagaaaaagaaaaacatggcagttagagttttaacccagactgtaaggccctggccaaggccagtggcctatctctcaaaacaactagacggggtttccaaaggctggcctgcatgtctaagggccctagcagcaacagccctgttagcacaagaagcagataagctaactcttaggcaaaacctaaacataaagtccccccatgctgtggtgactttaataaataccaaaggacatcattagctaatgaatgctagactaactagataccaaagcttgctctgtgaaaatccccacataacaattgaagtttgcaacactctaaaccccgccaccttactcctggtatcagagagcccagttaaacataactgtgtagaggtattagactcagtttattctagtgggcccaacctccaagaccatccttaaacatcagtagaccgagagctgtacgtggatgggagcagcttcgccaacccttgcaaagtgactctgaagaagacgacaagccctgcttcagtcacacccagaagctaactggtccatgcacggccgaaacatgaggaaactcatcgcaggactcattttccttaaaatttggacttgtacagtaaggacttcaactgaccttcctcagactgagggctgttcccagtatatacatcaagtcactgaagtgggacaaaaggttgctacagtcctattattttacagttattataagtgtactggaactctaaaaaaacttgtttgtataatgttactctatacaaggtatgtagcccgggaaatgaccaacctgatgtgtgttatgacccatctgagcctcccatgaccatagtttttaaaataagattaaggactgaagactggtggaggctcataaacgatacaagtaaagtgttagccaaaacaaaacaaaacaaaaaaagaagtgcccaaacaagtcaccttgaaattcgatgcctgtgctgtcattaataataataggttaaaaataggatgtggttctcttaattaagaaagaggctatatggcagaaaataagtacatttatcataaattaagactgtgtaaaaataaatgtggatactggtcttgtgtcatttaggctacttggataaaaaaaaaaaatcctgtccaccttcagcaagggaaaagtggcccttcctgtaccagtggtcagtgtaaccccttagaactagtaataaccaacccccttaatcctcactagaaaaaagaggaacgtgtaaccctaaaaattgatggagctggactggatcttcaagtaaatgtcgtggtttgaggaaaagtttataaacgctctcctgagccagtatttcaaaccttctatgatgaactgaatgtgtcagtaccagaaattccaggaaaaacaggaaatttgtttttgcaattagccgagcatatagcccagtctctcagtgtcacttcgtgttatgtatcagcacaagtgtaaatatgtgaatcattatcaatctattgcacaggaagacataagtagcaaaaataagagtgagaactcccactaataaaaagtgagagtctcaaaggggggaaatgagagaagagagacagaccctctcatattgttttatattgttttatactcagaaaaggaaagagaagcaaaactaaaggcaggtagcccggcgcctagcaaccagacgtgaaaccaaggaaccagacctgaaaccgggcctgggcctgcctgacccaagcctggtagttaaaattccacccctgacctagcaactgatgttatctatagattataggaagacattgtaaaacttcccagtctgttctgtttcactctaaccaccggtgcatgaagcccctgtcatgtaccccctgcttgctcaattgatcatgaccctctcacgtggacccccccaccttagagttatgagcctttaaaagggacaggaattgctcattcagggagctcggctcttgagacaggagtcttgccgatgcccccagccgaataaaccccttccgtctttaacttggtgtctgaggagttttgtctgcggctcgtcctgctacccaattttctctgcgattattttccttctaaccctttcttaaagtgatgggctctaaaaaatcatgattcagctgctattgcaattttacctagccagtgaatttatttattttgagatgctttttgatattattgtcattgtcaaatgacattatgacatttcaaaagacattggctgtcagccagtgggatctagtcttaactcatctttggtgctcaccggtcataaagctgtagtcacatgtgtttatttcccccagcactcttccctcatttccttcctttccttcctgaaatttcctcttccagtggtgcaaaagctggtgagtaagtactgacaaaaccaatgcctcttccaatgtctctattcatttccttcctgtccatccctataagcttaactgtacatccatggttattttcaactttgagttaacatcgtagaatcaaacacttaagatattcaggtaattctgaataccatatgctatggtttgaatgtgtctcccaaaattcgtttgttggaaacttaatccccaatgcagcagtactgggatgtggggcttaatggtaaagcccttacgaatggattaatgccgctattaaaagggtttgtggaagtgggttcttcctctcctgctcttttgccatgtgaggacatagcattcctcccttccagaggacacaggcttcaaggtgccattttggaaacagagataccaggcccctaacctgctctctgttcttcttttttttttttttagatggagtctcagtctgtcgcccaggctggagtgcagtggtgtgatctctgctcaccgcaacctctgccgcccgggttcaagcaattctcctgcctcagcctcccgagtagctgggattacaggcgtctgccaccgtgcccagctaatttttgtatttttagtagagacggggtttcaccatcttggccaggctggtcttgaactcctaatgtcgtgatccacccgcctcagcctcccaaagttctgggtttacaggcgtgagccaccgtacctggcctaaatcgctgttctttataaattacttagtctcaagaattctgttatagcagcacaaaatggactaaaacatcatggttcctgcttttttggctcactaagtgttcgtggcttttctctttcaaaattttattgctaaaataaataaagatgtcactactttacaataattcatcacattccatttttttgtaagaaatagtaaaagttggatttctatgcccttgaaaaagaactctatccttgaggcaatctgaaactaagcatttaacaacttgaaaaattagatcacaaccctctgaccaaacaccagaaagttttatactgaaattcagatactctttgcttgtttattggcagggaaaaagccaaaatatcaagaaagccagcacaaatatgagtagtaatatccccttagctaacatagatttgcaccacccatctaccttctatcatgtcatcctttttatttctttcattttatgtatgagtctttgaaatgtttgtgtttttaaaaaccttttatttttttatttccttcattaaaatgtaagctctccaagggcaggcctttatgctcatatttaccaccaatttgctgctgcctagagcagctcctggcacacagaatgacctcaaaaaataccagtggaatgaaagagtaatgaaagaaatgactcatctggttttactccaaaagaagtagttctaattttttttaatgcttaaagaaagccaaatggatatacatataggatttccagtgtcataaaagtaacaaaattagcttactcttccaaactcttattttattaatattttttaataataaaaaattatagaatgcttcatgaatttgtcatccttgcattggggccatgctaatcttctttgtatcattccagttttagtctatgtgctgctgaaacaagcaccaaactcttaaaattagcttaggttcagagtgaagagctgaagttgcagaccagacccaagctgttttgggactatgaaggacattaagggctctgtttatttgagcaaaatctatgggtgaggcttacctgctttctgccaattttccttgtacaacagctgatgtcagagggtggttggataaggagcttggagccgttggtaaggaagttcttatcactttcttgcaggctccttttacctctagtcttctatgactcaagggtcattcagtgccaaatgaaattctgcctctgtggtaactgctagaaagtccagtgatgatctgatttctagtaacaactattggccatatccccaggaggagataagaattgtgtctattaggaaataattttccatggatctatcacctttttgtacctcttgtgagctggagcactgaatgattttattccagactattccccaggatgtttgtatagcaaacagtcttgggagatagaggtagtatctcgcgccaggggagaaggcaggtttgtttgttgttcattatattaaagacaatgtcttcctccagggcaaaagttgggcaggctaacttgcagtccattataaaagattcagatttcctaagcttggagttgcttaggtatgatgcaaatctcctgagtgtgcaaacatggacctaggatgctccgtaggacttcgagaacaaggggaaccaacagaacatgaaacacataccatttgagtaaaaacagcctttatctttgattcaggtgtcttctgccagcattcatgaaacgaaactggcaaatagcaaaaatctgaaacatttcactgttcttgatagtttcacatgctccatccatgccagggtcccttatttcctgcaaaataaaaaaattctgacaaagagtgcatatgggacagggtgaccttcactgggaagcggaagtgaagccccaagttcatggtgggagatcagtggtaatgaacagaggtatgtcatagtgtaggaaacagatgaaattgccaatgtgaagataagtcattagtgttaagaataaaaatgctagttcatttcacattcacatactgtttgttcacataagatgctccataaatgttattgaataaatggatttatatccttcttgcttgcaaaaatggtatgaagaggtttccagtaaaaaacacagataatgaatttattcaaagaagagtgggaagaggcgattcaggacaagaagggaagaaggaccccaatcccccatcccctaccaccctgtccttccataagagtgagaattttgtcaggcattttaaaaagttcacctcactaatcctcaaaggacccttaagattgctctcagataaggaaactgcatagaagataggaagagcatctgtgagtataagatatgtacagtatctggctccgatctgcctttgcaaggaaatggcagagccaggatttgaactcaggttatctggcttcaaggtactacatgttttttgtttgtttgtttgtttgttttttgtttttgttttgttttatatgactgagtttttttactctatcacccaggctggagtgcagtggcgcaatctcggttcactgcaacctccgcctcccaggttcaagtgattctcttgcctcagcctcccgagtagctgggattacaggcacccgccaccatgaccagctaatttttctatttttagtagagatgaggtttcactacattggccaggctggtctcgaactcctgacctcaggtgatccgcctgcctcggcctcccacagtgctgggattacaggcgtgagccactgcgcctgacctctacatgtttttttttttttttttttttttttacaggacaccacattgacagtgtcagcccaaaactagaccaagaacacttgggcacactgagctcagggcttagcccaaagttttctgaaagcatgccagagggaaagctggatgaaatgctttggtaaagaagaaagcacatcagctcatcactcatctgacaatagaaaggactgatcaggaagtggggaaaaggagaatagtggcaaaacatagaaaagagaaaaaaaaagactgaaatttttaatggagcgcaaaatcagacatatttttttacttttttgaacttctttagagactacaataataattcttatgtgataagtccaataagctatgatgatgttttattaaatgtaccatcatactagcagcttttgcagaatttgcatcagaagaaaagtataagatattaccaccatgacttggcaaaagcggtatactatattaatgttagccacttagttgctgtcattgtttctcagcacagtacccattgcctagtttccctgggagttcttgaaagctctattgaaaagttatatttaaagtgtaagttagagtgtgctgtgaatggagagaaaattgtttttctttttgtaaaaaattcactttccttgggactatatactaagttagctcagttatttgacagaaccagtatcttattttacaaagagaaaaacatagatctagaaatttccagaagcagatcactggttgaaagggcggggcgggggggggcatgtgattgaatgtgatttgaaggcagttttaattttatgacactttacagtgtgtgtgtgtgtgtgtgtgtgtatgtgttttaatgataacctaattttattgtcccagacttaaagatctgtgccacctggagaaactacagttcatccattagcatgtaaatctgttaagagtatttttgcttgaatttctccgagaaggctcccggctttgttctgtacagacacacagtcccgacgctgttcttaatatcctgttttcatttgtcagcgctgttgtccttttcattgccatgttcccatcattcctcttctttcatgtggtgctttacaataacattcagaacaaaagagtcactcctctttctgttgcctttaaaaaaaaaaaaaaaagacttcttcccctgactgcagagcttcagtgatcaggggaaatgtttaaagcatgttattcgtaatagttaaccaggagttgtgaataagggttcgttttccttactttttaagatcaggaggtagcttcagggtattgtgagcaaaaggtttttgtgtgtggctgactttgaagttgagggaaaaagcgattttctttgagaaaaggaggcatcatatttgagagaatttccaatctgctcacacaatgggaatcagttactctataacatcgtcattacctccatgagtcacgagactagtatttgttcttgtctttgaacttaagctttccagtgttcagagaacagttgtgaaatgttgcattggccatcatcaataactattttgctcctggttggtaataattgggaaggggagggtgtgtactttctctgccttctaggagagtattatataaataaagtgagaaaaagtttccccaagcggcaagcttttctccagggcacaatctattatacttgctgcaaaaatcccacttgactggtctttcagagaatagatcacttgcgtcattttgctcatttccaggtgaccttttgcagatatgagcaggcagttgtttttaaataaacattatctacaggtttctgtttctgcactaaggaaggaatgtttctgtaatgcagaagggatgctatgactgaggggtttgtgaagagtgaattctagccagtctcaaataattctgaaaaggtgcttttgtatatgtatatgtgtacttatgtatacatgcacattgtatataactacaaaaactaattccattatggacatatataggactttatacagacatagttatatgaatatatatagaaatacctatcaaactataaatacatttgagaaagcattcagggacagcagtgttaaaagcttttcatctgtgactggtttcacagaaattagtgacttccatttctgctaccatcacgctgttggtctgttcaccaggagggttgatttagacttctgccaggagactaggtgtggccatctctcaccctcttcctctctgtccagtctgctatcattgccttcagaaccaaattcttgcatgatacccagtacagcatagacctggaaaacatcggtcattttcaatataatgtaaaataggttctgtgtgcctttaaaactaaatgctttatttcttaaactgtaaaagacatgaaatgtctgagacattcagatagtgggaaatttcatctgcaagttgtcagattatgccctttagaagattgtaattttttttgttgtttatcattttctcttgaggggtggagtaaatatttctttcctgatgtttcaacttcagatgttcaggctaattttccactacagtgccaaaatagggaaaagttaggcctgtagaattttgacaatttaaatgttgttttaacaaaagccatgtcttgatgaaaagttctttagaattctacttgatgatctatgtgtgtctcttccgaggacaatgagaacttcttaaggaagtcatctatatgtgaaattgagtaatccttttattcattgttaaaagacaaatgaagttataatttggagagacataagccaaaaaatctatgtttgcatttttatgtcctaacatgtgaagcatgctttgatttactgtgaagtgttgcaatggcaataaagtagatgttgagacgtgcagactgggcagcccgaggaagcagttcttgcctctgcttcccctttatcatgaatgttccttaaacacctttggtggagtccaaatgtctggattatgaattgaattgtgcaagattctttttttaaacactttcctgatgatttactttacttgcagtttcttgtcttgcatggtgataagcaatatccttcaaagaactgcagcgcaggactttttttttttttttttcttttaggaagactacttccccttcctcctttagtcaatcaaattttaaaagattacttctttccattctcagttcaccctttctttgccattctggagactgaaattttggacacccatcacagatttgctattatatatataccgtgtatgtaatattaaatatatatatatatatacacacacgatgtttttatatatgtgtgtacataatgtatgcatacgtgtgtatgtgaaacctgtgtgtatatacatatattttaaattgtttatcaggatgatagattgctatttaggtcactatttttggaagaaataaatgactgttctttgtgtctgtactggagattgttcttcctgatataactttgaagaaaacttcttccagacattatacattaattcagaagataaaggcacaaaataatgtgtatattatttttttaaatgaacaagccagcatgcagagcataatgtgatcatgtgctcagtacgacactgaaaggccccaaaggcaaatgagtctagtgcctgttcccagccccaggagctgggcaggacggctcctattggtggcattgaaagctagcattcagccttctgccacaggacagtgtctcattcggccaagctgctgctggtccctgtaaggaatgagagtacagatcccgttgccaagtcctcatttttttggaccaggcagtgggtgttgagctgacctgagctacctttccatttgggttcagttgaacattgagtaggccagaggatagggaagttgtggcgggggccgtggaaaaggcagttgattcttcaactcgggcaaccctggcggagtggatgaggtggagctggccttcctggaattgttggaccgattttcctgttgtgtttcactgttgacgcactcacagacacacaggaccgctccagcactgcctgccacccaccgtctggtctcggtggcctgtctatcatttcgtgggtccccatcctctgcctacggcgatgtttcttcaaaaagaactagtgtgcagtccattggtgggtattcaaggtgatctctttgtcagaatctagagaggtgctcaaagaactattaaggaccaatgtactagttcctgtttttaacctgtttatcagtctttcaattgaacaaattggatttctgaaactgctgaggggttttctgcactattaggacagaacaggatagggtggttgttcctccaggaatctgggttgttcttttgcattgccatttgtctttgtgcttgtctgcttgtataaatgaacctcgagaaggagtgtttaagtattctgttaagtaaatttggaagactaggtttcaattaaaataaccagacagtgtgacccagcttccatttccccttaattttgatcattaaagccttcatatccccacagacatctgccatgcttcgaagtgattcttctcaggaatgttcattcattattaatcaggttgcatggtcaggcgagtatgtgattattttaaagaatgtcctagagatccagttactaagaatgagcatgttataggcagatgtgaaagtacagaaaagatttggttaacagtttaatttgatttgcatgaattccaccaggtgggtgtttggcgaaattaaaagtcttccctggttctcacttcagatatgaggtaaaaaaataataataataataataatttcagcacttcttaaagaagaaatgtcaagttattcaaaatatctattgtattaattattttaaaacttgaggctagcatctcagtgctcatctgcttgtcacttttttttttcaaacagtccctctggtcccctacaattttcttggcagaaattcttagttgtctgttactggttgagcaaatgaatttgagtgtgctgacatttggaggctaaatgcagtgataattcagagtaacattctttacctataaaatgttactggatcaccttttttcacctgttcttacttgatgtattatttatactgttgtttttaagaaccactttgcgtttgtactgaaacagcctacattatgctatcaatttccagtctttcagaatgcagttaaatccaactggatccccttctcccctttttccatcagttcatggccctgttttactgtgcctttgctaacccacctgcttctcaaattggccagagtgctaatcagtaaagtaacatttgggtagtgtctttattcggtggtctttatcactcaaagtcaaatactaaatggcataattgaatatgcagatgctgagtgcttgtattatgttattcaaaataccctatgatgaattcatcttggatgtagcagccagtttttattgagtttgtgttagacaagtttttgagttgagaaattatgcttatttaagatgagagcaagtcccttctgagttgggtccccgttgcaatctgcctcccaaactcaggttgatttccagtgtttcacacttcagtagttttgagtcctctgaaagtctgtatttctgctggtccaagatagaaacatcactctgcagtctttaaaaaatatttcacctatagttctataataaagataatctcatagcaaaaatccaaacagcaatagtcaactaaatctaattacccaggtgaataggggttaagaggagcggacaatcaagtaaattgacttgatttcgtttctgaaatttaggactctcaaataattcatttgtacattttcaatgctatttgttgtttgaaatacttataggagcttcctgttctgaaaccattttcgtgtggcttgctgtaacatcgtgcaattttaacagtgtgtttgtcatctcagttatgttttggtaaatttaacaataaagttagtctctatagtccagaggatatttggaaaagaactagaggaagtgccttgggaatcatctgggcagtggctgacagccacgtggtattaacgattaatcacaggccacccagtgttggcatacaagtttattccttggtctaatgactcactaatttccctggtagtgaaggctttagagttgtacaaagtgaggggctggaagtaaaattattgatagaattgatagaattgcatgttctttttcatatactccaaattagaaaaataattgtatttcatggagtatgcagacataacctagaatacttgtaggaaagcattgagaggtgggtttaccttatcattaaaaaggtcaatgcctccattaagggaaatttgggataaaaattatggatgatgtgctgatgatgggcgatctccttattctaatggatgctgtaacaagttagcacaaacctgatggtgttaaacaatgcaaattcattatcttacatttctagagtcaaaagtctgacacaggtctcactgggctaagagtaaggtatctttagggctgtattccttttgggggcccttggggagaattcatttccttgccttttccagcttctagcctgcattccttggcttgtggccccttcctccatcttcaaggccaggcatggctggtcgagtctttgtcatatctcatcattctgactctgactcttcttcctgccacttccacgtttaaagagccttgtgattcctttgggtccacctagatgatccatgctgctctccccatctcaaggtcagctacttagcaatcttaattatatcagcaacagtcagtcccctttgctctataacctaaaatattcacaagctctgaggaggaggctgtggatatctttggggaccataattgtgcctcccccaaagagggaggagtagaaactgtggtgtctgctgtctggtgaccaggaggacagaagccctgtgaggagacaccaggagccctgtagagaagacaaagacaggctaatgagggaagaggataaatcccacatcatgtgcattccaagtctgaggcacttgcagtacatgaagcaaagaactgtcagtgctaaaccgggttccagaaaggggttctcgaccatcttgggatacaagcctagcagtcattctcagagaggcagtacatgaaacaaacaaaaaactggatggccctgtcaaaggaaccatagaccatcagaaaacacttaggctttgattagcaagaggtagaagtcagcagtggttagacagaggaaaactaggaaagtacagtttcagtgacatacagtgatgtggtttgtttgtccccaccaaaactcatgttgaaatgtaatccccaatgtggtggcattgggaggaggggcctagtgggagatgtctgggtcatggggatggatccttcacaaatcgcttgatgcccttcttgaggtagtcagttcttgctctcatggagactagattggttctcacaggagtggattagttcccatgagaatggagttgttataaagcaaagttccttctcttgagcagatgccagtaccatgcttcttgtacttcccagcctgtggagccacgagctaaataaacctcttttgtttataaatcgcccagcctcaggtattctgttatagcaacacaaaatggactaagatacatattatgagagaggaaaggaaaggaagaagagggaggtgtgaaaacatttacatcattattttccagcaaaacatctacttattaattttccattttaaagaagtactttcctcataagtcttgaatctataagaaagttttttcaaaagatgtatccaatgcctcccacgatgtggggcttcactgtaatctgtcactgaagactctcctgcctaggggagtgattagagtgagtgctagagggactgtagggaacatctgtggacactcacccatggatactcagacagctaataagtagcagaactgcaggatgtcttagattatcccgtcacctgtccagctctctcccctttcattcattattctgtgctgtgttctagatgtttaaaccatggacaggcagaggtgtgagctgtgatttgttgccattcccagtttgttgcaagggactctcaagattatctagatcctcttctcaatgaggaccaatctgcccattcacaaaaatgttaagctataggatttcctgacaacaatatgcatgtgtgatttccttttattgaagtagaaatgaagaagtttttttttttttttgaggcatggaaattacattatgacagttaagaaaaggcaaaagctgctgttttatgatattggggtttttgttgttgttgtttgtttgttttgagacagagtcttgctctgttgcccaggctggagtgcagtggcatgatttcagctcactgcaacctctgcctcctgggttcaagtgattctcctgcctcagcctcccgagtagatggaatcacaggcgcacgccaccacacccagctaattttttgtatttttagtagagacggggtttcaccacgttagccaggctggtctcgaactcctgacctcaagcgattcacccaccttggcctcccaaagtgctgggattacaggtgtgagccaccatgcccggcctgatactgttattaatgatataaataacaatgtaagctatatatatatgtgtgtgtgtgtgtgtgtgtgtgtgtgtgtgtattagatacatatatatatagagagagagagagaaagagagagagaaagggagagagaaagagagagagagagagagagagagtgaaaagaaagataacattttgcataaaattcccacccatgtaccactatctgcttggtgaatccctgttcatcttttaaaacccacttcatactttacctccttcaggaagcttctccctgtctcctctccccctatatagagttgattattccctgtctgtctttggcatgcatctttttttatgttgcattacaccttgttcatttttttttctcgatatgggctcactctgttgcccaggctgtagtgcattggcatgatcacggttcattgcagcctcagcctcccaagtatctgggaccacaggcatgtgccaccactcctggctaatttttttatttttattttttggtagagatagggtctcactatgttgcccaggctggtctcaaactcctgggatcaagtgattatcccacttcagcctcccaaagtgctgggattacaggcatgagccaccacacctggccttgttcatattttctctctcggaatgaaccataagatcatggagacaggggccagctgttaccagtacttgtctcaggaccaagtacatagatgaacttaagtatttggtgaaagaatgaatggcaaaaaaaaaaaaaaaaggaatgaatggcattttaatttctccaaaaagatattttaaagaaagctagaaaataaaccatactaagtttcttttagaagaaggaatggaatgagtacaaataagatactgtagagtcatttaacaaaaatgctatctatgccattgtaaaatctgggtaaaagtggaaaaagtgggatgcactatagatatcaaaccaaaaccccttcctttttggtagcatacaggcaaaagatttagaaaattggctgaaattcacctaccacatctgagtattgtgtcttcacctaatacaattaaccatttacagtacagacacttgcataaagcactatgccaggtgctatggcagtaaaagaaaatatctagttttgagcagctactattaattcgttcttacatgagttgcccctaagcactcgagtcacataatttccattgatgtcagattcaaagcccattgcatatcatttcccattagcactggaaacttgtaagtgcttgttcaagtcttgctccgccatccttgctgctgttgcccacacagcattttattcatacctctctgagaatgattttcatttatgttctggttatctgtatatgcctctatcttccaatacatggctcaacaaaataagatgtgcaggccaatgctggcctgtgacctgtttttctaaatatggttatgttggaacacagccatactcattcctttatgtattgtgtctgattgcttttgcactacagtggtagattgagtagttgcaacagggcccctttggcccacaaagccaaaaatgtctactattttaccctttatagaaaaagtttgttgacctctgttcaaatatattgagagatccttaaagtcaagggctgtgtttgattctttttggttttagctgaaaagtcagtacatttaatggaatcaatgaatgtttgagtcattttgtgtgctgagtgctgttctaggtgttggtggtacgttcttcaaagagcaaagcaaaatctctgctttcacagagcttatattctagtgttgaggacagtggggacagaaggagcaataaacaaactaaaagaatatgtcagtgataaatattataaagaaaaataaaccgagatgggggaagaattaccacgatgggtaggtggtatagtggtagaaggggaattggttttatgtgggttcagagagaaagtgacactggagcagagagtcatgtggattctgaagaccttgcaggggcgagcaggggattgatgtgcttggcatgtttgaggagtcagaacgaggccatgtgctcagagcagagaaaggagtgggtagcgtgggaggaagtgagctcactgtctgagtctgtgttttctggggctggtttattctggtgaatttctctctgggtgaaatgggaagcccttacagggcagagcaaaaggagatgcatgttctgtcatgttttaacaacaggctctcttgcttctgagtggaggatagactatagggggaagggcaggagtgaacagaagccaagagaccatttagaaaggtcttatgatagtccacataagagatgatgctggcttggcccatgataatagagatgaggtgatgtgaaccccagattctggcttcttcatctaactcagtgcctggcacacagtaaacatctgttgaaggaatgaataaaatgtcagtatttccactgaggtctccccagtggaatcctttctagaaattctcatcacacctctctgggatggaatcctggcacctgcattaaaaatatagtcatcatagctctccagacataatttgatgctcatccttctattcagattcattggtaggcattcttgttttatctgagaacagagcagaccaaaagggctacatttttcctttaatttatatgcttctgatgagaaggtaaaagaactttgatttaaagataattctacattttttctatgattaaccaaaataattattaataggtaaaaacctttccatttcttctgagccatctgtaggaagaggtgacagaccaagtggggatgatatgtttcttacaacagcaaccctagggtttccattgcaggttgtagaaagatgtacaagctttaatatttcaagtcacagttgctcttttattctttcctatataataaatgctagtgaatggttgaagattttttaagataccaggcttttatgaagccagtagctgtttaatttttaacaggctcgggacatactttatacttttaatgatcagttaccattcagttggtagcaagatgagcattaatttcaccaaagcaccatattggtatttctgagggatgctatttcagaaggggtcagggtattctagaaaccgtgaattttgtaaataagcggaggtgtgaatacaaacgattgattgtcagaatcactaaacatagctttggatgtgaagccttcccataaatccggctgagaacgctctccccaccacccccgtgggtgatttgaacctcccgaccactgggtgaactgcactgttctcccacagcctgcaatgggctgcatgtaatattcccatcactggtctgcagacctctgctaatggtcttgaaagggagaaggttcaaagcggcttggttcccaggcctgctaatgagcatgaggcctcttcacccttaatgaactggggtttgtgtggaattctttctactactctttttgatgggaaggcagatgagagttcacaaaagcactcaggtctttatggcaaggggagcaggcagctgggccaccctcgggtggcctggaggagagcaacatagctagcagaggtcgtacccaggccaacatagctctgagtgtgaggctggacctcctgccagcctggcctgttgctggcaacagtgacaagcccgtggtgggagttttttggccaaaagggtccctcagcagttttgtaagcctccttaaattgctttctcaactgtaatcattatcattgtcataacataacttatcacatgaatatgatgaccactgaaatccttgttctaattaactaaatcattgctctaaatattagtcattggtactcaaacttactgcagccactgaaaaagcccccagatatttttctccacttcgttctgcctacccacgtcccactgctggattaaacaatagaattattcagaaacataatgaacacatgccaaaaatattgcctctatcacaatcatctttgtgaaagtcaatgttttttctcaggaatatattttggaaaatgacatcccacacttaaacacgatcatctctgctgaaatccccacatttgatttcatgtacatttcatgcccatttctatagttactgccttcctattgttctgaaacctggtttggtattgcagagtaaaagtccttaaatctcgtatacattaatacgtaagtttataaattcaaatttataaaagactctagtttattgatgaatatttctacattttaattttctgtgcgaggttaaacctgactctgacacaataagattattctgattaaatacaaattatggaaattacagtttcaattacattctagttttgaatgaagccttttaaaaaacaaaattgaaaaaaaaaattgcacattttcagttactgaactttgagaaaatgttaactggtatatgatggctcaggatgctttttcctccttttttccccagtgaatagaaagagaattatttggaatgtacacacacttaccctttcatgacctgtgtttggaattattctgagatgcattcaaagctgacacccccctatggttgacctccctgtgcctaatcaaatcttacattcttgtttccagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaaggttagtccgatccgccttaagccaacccctttctgccagaaaatgtcatggaaataaaaagtgtattcactgctagctacatggcaggtgaaggttttctcctcacctttgttatctgattagttttagcatgtttttggcaacctataaatgttacacaataagggtatcttgtaaaagttgactgctgcttgtaattttagcgttgtcaaggtgagggcaaattctaaaaatctggatcattttcaatccatgcagtttttctggatcattttcaatccttacagttcttccaaagagagtgctgcctctctctgagagagagggagagagagagagagagagagagagagagggagagagagggagagagagggagagagagagagaatgacagataaaatctggctttgggcatttggggaacacttacttttctcactcatctgggaaaactaattcactctcattgtacctgtatctagttactgcacaaacaaaagaatagagggaagaatgtctgtagcaaatgtgggattttagaggacacgtgaccttttattccttgtataaacgatatccagcttattggtgaaattcagtgctctgacaatctcaggtttcacgaaagaattccttttcgtgtaggctctttattcagtaaggttacagtcaagactatttgaacttcattttttacatgaaattattaacctaactccagcttgggggataatgattaatatgactatatgtgaaataaaaggatcactttctaggcagggcgtggtggctcatgcctgtaatcccagcactttgggaggccgaggagagtgaatcacttgaggtcagcagttcaaaaccatcctggccaacatggtggaaccccatctctactaaaaataaaaaaattagccgggtgtggtggtgggtgcctgtaatcccagctactcgggaggctgaggcaggagaatcacttgaccctggggggtggatgttgcagtgacccaagatcgcgccactgcgctccagcctgggtgaaagagcgagactctctctcaaaaaaaaaaaaaaaaaaaatcactctctaagtatggatagaaagcactagggaagaaataataagccaagtctccacatgtttgttcaatttcaggcaacagtgggtctaattattgaaaactcagctgagagagtttgagtgagatactatgttcatcagctaattttagatcacaagacaccaattaaaagaaaggaagtataaattaaaagctctaagtaaatatatattgaagtccttcctctcaggaaaaacacataccatgttgttgagcaaacaaaatgaatcacatgatcaaaagagtgttatcacttagaaaacagtgtcacctttaacaaatggtttctatcacctctccttagcgctaatgggtggttgtgtttactgggaccacatagtttattctgtgacagtgggattaacggaccacatctgggatttggctttgctatttcttgacatgttgagggaagccgacatgctgaagtcaattcctgcttctcaatgtcacttgggcaacaaaagcatcacctgggcagcatgtttcacttcaagtatccaaagaattactggtgcaaatccatctttaaaccatgtagaggaagtcaagcacaaggactcaggtgacacagacaacagaagacagccgctgacaggctttccagaacagtgcatggcagcacaggagaaaagtaccaccaaagttaatcatagcaaaggcaatgcatgtatgagctgtgcctctagagcaaattctgaagaaattgcgaaggctattaatttttacaaaccaaggtaatctttttttttttttttttttttaccccttttttggttggtggtggagctgaagggagaatatttaggataactgaacagagatgtttgatttttgttttccaaaatgtaaacatgccagatctttgtttctttattaaaaatgttcctttgattggatttgcactaccttttaatgattgtttgttaaaacaccacaatcataatgatgttcaatatttaacaactcccaggcttgatatttatttaaatcttgtggtcaggttctgctcaagtactcatggcctgtcacagcagagttattaaatatttacataacatctccaaatttatgaagaattcctgtcatgctctagccctctttgtgataaaaacaaaactcttcagttacgagccctgcacactttaattgagccagtggcctatcggttgttctactgtcacatggagggcctgacaattaatgatgtggtttctttttatttcctagttacagaaatataagcatataaacagcatccaatgcaccgaaacacatttacagccgttcaataagatgtacttatgagcatttgaacaaataacttatcgacatagcatgtttgttttaaaacatgccacttacgttagaattttaaaaataataattatgacatttggatgtctgatatttcagttatcgcatacttatgaacatatgtacatccttgttttatttaaaacctaagcacaatataaatgttgatttttttgaaggaagtaatagcataccaagaggaccaaaaccaaggaagtatatttctgttaattactactttggtctgaaatgtgctctgaacatgcatttttctgtagctctaggatctcatatagatgtggatttgtgatgatgtgagaacacagataaagcatggaggaatttgaggatgctttcattgataagacaatagatttgctttattaatttgcatatgtaaggaccctggtgtctttggaaacatttttgtccttctgttagtaaaagtttattacctgaagaagggaattctgcaattattatgaagaataatttcttgcaataatactaaactttgggggacatattttactcattagatctcagtataagagatgtttgtttatacaaaaaatcagaatatcattttgtacattacaatctttttctaagtgtaaaagaaaaagagataaaaattctaacatgttgaactcgtacaaataaaatcatccacatcatgtaaaatagcatcatgtcagtaatctaacgctttcggagactatgcattgagaggcactcatgaaatattgaagcaaagagaaaattaaggtagcatttcctgaactctactaagataaaaagagaaaagttttcctgccaagtgcaaaggtctctaagtggagcgtatccataatgtggatatttctttacatcgttttaattgaattttaagaagcctctcagtccttcaaacttggaggaaaaatttgatttgtgaaccacataacatataagagaatttaatataattaatgcattccagagttttcaaggaattaaaatgcagtagtcctctttttctgttccaacatacaaggttggagctcttgtttcttttctctaattatacctataaaaatatacaaattgaaaaaaactgacctttccttgcctttcagtttcagcatagccccttcaaattagctgaagctgaagttccaaactattgttttgctattcttattctaaaggctggctgaggaagtttgtttgtataatgcatgtttcaacggatcatcccattgtaattttttaatagtttgatttaaaagttcaaattaaagctcagcatttctatgtagcactttttatctggaagtgaagacatgagatttcattcttgggtttaatttatagattgtaaggttctatgtttgaaaaatctttcccagtttgcaactaggaaagttgtaagtgtatactgagctagacttctttttattataatttctataacttgtttcttctttgaaaaccagtagcaggcatagtgcaggttctagtgctatggtgtgtgatgcacacacatacttgcatatacatatacatacatgcatttatttatttatttaatattataatcttcctgaatctaagttggagacaaattcaagtgaccagtattttcattagggatatttcattctgcaggcaagagatgacaacaaacatagcaataataactatattcccatcactcaaaatattttacctgttccttgaatgtttggtagatggatacaagtcaactttggacttggtatattttttgtgggaagagtcttatcttgaaggggtttttttttgaagttacaaatatgtgtattttttaaaatgtgtctttctgtttattggtttctagtttaaatcccttaagatcagggctcaagacaattgcatatggtctcacttatggatgcagtatgctttaagaaatattagaataagtttattgtatcttcaaaatttccatgagctcattaatgttttcagtctgtgtaatcaattaatgactaggagaggtgcacttaggccttccactcagagagtgaaattttcttttttttttttttttttttactttaagttctgggacacatgtgcagatttattacataagtatacatgtgccatgatggtttgctgcacctatcaacccatcatctaggttttacaccccacatgcattaggtatttgtcctaatgctctcccccgctcgccccacaaccctgacaggccccagtgtgtgatgttcccctccctgtgtccatgtgttctcattgttcaacttccacttatgagagagatcatgcggtgtttggttttctgtttctgtgttactttgctgagaatgatgggttccagcttcgtccgtgtccttgcaaaggacatgaattcattctttttcaggcctgcatagtattacatggtgtatatgtgccacattttctttatccagtctatcattggtgggcatttgggttggttccaagtctttgctattgtaaatagtactgcaataaacatatgtgtgcatgtgtctttatagcagaatgctctataatcctttgggtatctacccggtaatgggattgctggatcaaatggtatttctggttctagatttttgaggaattgccacactgtcttccacaatggttgaactaatttacaaccaccaacagtgtaaaaacattcctatttctccacagcctcgccagcatctgttgtttcctgactttttaataatcgccattctaactggcttgagatggtatctcattgtggttttgatttgcattttcctaatgaccagtgatgatgagctttttttcttcatatgtttgttggctgcataaatgtcttcttttgagaagtgtctgttcatatcctttgcccactttttgatggggttgtttgattttttcttgtaaatttgtttaagttctttgtagattctggatattagccctttgtcagatgggtagattgtaaaatttttctcccattctgtaggttgtctgttcactctgatggtagtttcttttgctgtgcagaagctctttagtttaattagatcccatttgtcaattttggcttttgttgccattgcttttggtgttttagtcatgagatccttgcccatgcctatgtcctgaatggtattgcctaggttttcttctagggtttttatggtttggggttttacatttaagtctttaatccatcgtgagttaatttttgtataagatgtaatgaaggggttcagtttctgttttctgcatatggctagccagttttcccaacaccatttattaaatagggaatcctttctccattgcttgtttttgtcaggtttgtcaaagatcagatggttgtagatgtgtggtgttatttccaaggtctctgttctgttccattggtctatatatctgttttggtaccagtaccctgctgtttttggttactgtagcctcgtatagtttgaagtcaggtagtgtgatgcctccagctttgttcgatttgcttaggattgtcttggctatatgggctcttttttggttccacgttaaatttaaagtagcttttctaattctgtgaagaaagtcaatggtagcttgatggggatagcattgaatctataaattactttgggcagtatggccattttcacgatactgattcttctatccatgagcatggattttttttccatttgtttgtgtcctctcttatttccttgagcagttgtttgtagttctccttgaagaggtccttcacgtcccttgtaagttgtattcctaggtattttattctctttgtagcaattgtgaatgggagttcactcatgatttggctctctgcttgtcgattattggtatataggaatgctcatgatttttgtacattgattttgtatcctgagactttgctgaagttgcttatcagcttaaggagctttggggccgagatgatggggttttctaaatatacagtcatgtcatatgcaaatagaaactatttgacttcctctctcctattcgaatacccatcatttctttctcttgcctgattgccctggccagaatttccaatactgtgttgaataggagtggtgagagagggcatccttgtcttgtgccagttttcaaagggaatgcttctagcttttttttgccgagagtgaaattttcaagtcctcttcatagttctgtcattttgcttgctttaggccttttgaacctatgttattaagaacgatatggctgggcatgggggctcacacctgtaatcccagcactttgggaggccaaaaaggagcattgcttgagcttggtcgtttgagaccagcttggacaacatagcaagaccctgtctctactaaaaataaaaataaaaattcaactgggtatggtggcatgtacctgtggttccagttactctggaggctgaggtgagaggatcattgagcctgggagatcagggctgcagtgagcagtgattacaccactatgctccaacctgggtgacagagcaagaccctgtctcaaaagaaaaaaaaaaaaacccacaatgaaagttaatataggttttttgagaggtcataaaaaattaatatgtgtttaattaattaaggtaatatgaacagtaacagtccctgccttcatggagcttatagtctagtagggcattccaacagctactaaatactttctctgttgatggtggcaggaagcacattgtgcccaaagcaaaggtactgaccccagtcctgagagatggagaaaggcttcccagaaaagggatcactgcacctaccatttccaagccttgtattagaaaacaatattgaatttactagatgtctgtaaaatccctgttatcagttattcctttttaactttttaccacgtatgatgttctttgtgtaaccctatatagtttttcaaacttgttcacagtaattcccagttgattttaatctaaaatacagacagactatatgatgtttcaccatgtggtatgtgaataactcagacacatgtcttctaaaatgttgtaattttatggagtttcaccagttccaactgactccaatatgcaattctgtttgtactaattttatggcagcatttgtttagtctgcaatatagatatgtatttttttccttttatctttagttggacacttaataattgcacatatttatgagatatagtctgatatttccaaacgtgtatacaatgtgttgaaatgtatattttttaatagtttccatgtgattaaaataagatttccaaatatttgtaaaatgtattaaaactatattttaattttgttagtttggtacaaggatatttatgatagatggaataaaagaaagcatctccaggcatatgttcttaatgggaaactcaaggcagcttccttttcctcctcctcacctgtctattttctggatgagtcctctctcaactccttcacctgcagagagcaatgtattattgcctagtgatttattattgttggaatcattcttggtaagctcagagagttcgaaaaatgcacaaacaagtacacatggtacctcttcatcatgtggctgtgtaaacgtaattcttgggcaccttgttaacgttcttgtgctatattttactcgtctataaaacagggctaatgtatagtacttactttcacagaaaattgggagagcaaaataaagtgtttcatgtgccttagcattgtgcctggcctacagaaagcctgcaacacatgtcagaacgactgttagaaactaggaggcagaatgtgtaatggttaagtgtatggacattggatgtagactgactgccaaatattttttaaccactgtcttgtattatgtgtatgtgagataagagtatatattgttgctttaatgtgttttgtagttttgtttctaaagcacctgccaaagggcagagacgtgacaattaataaacacttgttgatggacatgtgcagaattgatgcattagacgagtgttttgggattcggaggaggaagagatgaatctgcttttgagtagacaataaaccttgcttcagggtggtgggatttaagctgctttgacagatctgtggattatgcatcaaagaagagtgaggtgctctgcaggagtgagaccagcagagacctgtcggtaggaataggcaagacagctttggaattttagacaatcctaactagagcacagggtgccaaatggggagccaggaaagaggatgttggaagagtcacctggagggaaggtcttgaaagtctttaaatgcaaggttaagggtttaggccatttttaccattttctatagagtaatagtgaagtgttttttttttttttttaagagagagaggttaatgtatattttctgaaataaatttcatgtgagaatataagaatggatagggttactgtgttcatggaagaaataaaagggggaagagacattcacattactttagattttgtggtctctcttttaattggcagaaagaagtagtatcacaggtcaaaaaccaccaccctgtcaacagaaacatgtaaaattgtgagattcaaggtcctgccccttaaaactaggaagaaataggagatgtcgttgctgattggctcttaggtacagacacaaatgtgattcttttcctgcttttctagtgcagtaagacacagtggggacaatgcatggttatttcttctggctttttgattcacaataaggagaatgctgttcaaacctccgaatgcccactataaaccaaaataatgttttagagccagaagcaaccttggagctcatgtcattccatcctcattctgcagatgaggaaagtagggctgagagtagtaaaagaagttttccgcaatgacctagtgggttagtgactctgaactaggactagagcacagttcccagctgtccagttttgtgtctttcctgctacttcctacagcggttaacagtgccagccagcacaggcaggattgccttttgagtggttctgaaatttctgaggtctcttctgaggttttcaggagtaaacacaatgattttacggtaatttttaaacgcctgcttggcctggcaataaaccagcatcatgggtgtaggatgatgccttaccatgctgtctgggaattattgcagagatgtggctttgcaatgatgcctccagggccaccaaaataagttgcctagaagatgcccccatgctgacattttctatagctgagccagtgtagatttggccatcttgaagggccagacttcatgcctggagctgtgttcatgtacatggacccagacaacctcggggacactgcaaaagaaagcagagttaggacagtgatgtcaatgaggaaacaaaggaattgtggttgcaacttaatgggctcactaattcccttcttaggattattgttttcctgaatgtcttaatatatagattattcttagactggtaaattttttgacattgccataaagtgggcatgagtagtctgagaaactgaatgtggctaaagatttaatttattttcagtatgtggcataaacattctggaaaaatctgatacaaatgcaattgtaaaaatccatttaaaacttaatcactttatattctggacttttgggtatgacacaacgttgttgcgtacccatgaggtatggactttaagctgacaaaggaaaacacattttgcatgtcgcatcaaaaaggaaaatgcttgtaaagtgccgagcatggtgactggcacatagtaagtgttggatgtacacgaggtattattttatctgggcatttactgttacaataaaaccttcattggtgtaatccaatggtggatttcttgacagtatcataaattactcagtggttatagggttgatatgtgtttctggctgacatgggaaactttgaacaactctcaagggaattataattgggtggaaactttgatttgtcctttctaaaccaagctaagtagtgaaatggacttttaagaagcagtgagtggtgaattgaaagaaatggctttaaaaacaaggcccaatttgaagtctggggatgcgggtggcaggggtggaggggagcggctctttcatgtttctggttaatctgattggatcagcaccacaggtgccatcagagcacctacagctgtttccaagaaaagaaaagctggcattggtttatactatggctgtcacatttatacacatctagacagatgaggaaaagatgggtgacatgatacacagtaagcctagactagtcagacgagctcagggggctagctttctttttttttttttgtagggttgcctttggtatgtgagtaaatgatgaagcaagttggccctgggctgtgtgttagcagctgtctctcttagaataggaagaggaaggaacttcggtatcgactggggctggaggaggaggaaagcgctgaagtgaaggagctgtacaagaaggcagcttccaactcctccactgtaggggccctggggtgttttgttctctgtgctctcttctgtgccagttgtgcagggtgcctagaatagcggtatcatcgtctgcctcctcccttatatctcttttgctatttattgagggggaaaatccggaaaatatggtttttatttttatttacattgggatagactaggttcttattactgaaacaatatggaaatcatgagcagcttctattccttttgtgcctttataaatattcttttccctatctgctttatcagatcctgcttttaaaaaaaaaagaaagaaaaaaccttatttgtttactcagggaatattttatgtagctactatgagataaacactgagtaaattctgggaatgcagaaatgaaaaacaaagataagtcgttgcttccatggtctagagctcattataacatgtaataagaatatatagacaggatatgaaaagagctccatggagctcaatcaatgagataatttttaatgtgaataataataaaaaaccactgacttcggtgttgatatctggaaattgcctaattccaaaagctgaagtaaaaatacatttcaataaaaagcaacatttacagagaacagtgacattcagtcatttggaattgcaaattccactgttcagtcatttggaattgcaagtaagggcaaaatatgaagactccaatccatgaaaaaagccggctggatgctttcttatgaaaggtctactgttcgcgggctggactgctagcccttctcacgtgctttcctcagaggtctccatttccttcctgaacagggctaataggtcagataaatatccaggctcacaagcagtttatgtcatttccactctgaaaggatccatccctaggaagatattatgggagcaaacttgcggaagtgctattgtgttaaccaagccagctggtgggtttgctttatctgttatggaatttttaccaacttaggtgttaggatgaatatcctgacctggtagagtgtttatttcccccttctttgacccttgacacagctgtttagagctcagtcactcttggttgacatggtcagattcaaagccaagaagagtgaaatgggcaggcttttagactcacacactgagtatggcctgtgtgagtgagtctgaaagatctaggagacatggggaagccgtatgcacttcacttaaggagcttggagggagatgctatttttgcctctggattgctgatttaagctctagagggtcccagcaaacaagggcctcacttatttatagtgtccagcttgttaactggttccagtagctctttcattctaaataccctgacttgatcattacagattctatgcatgtaacaaaatatcacatgtaccccataaatatgtacaaatattatgtatcaataaaacgttcatctgataacatattaggcaaggccatagggctgcttccatacctctagaaaactgcctcgtaggtcagggctgagtggtagtacaggaaggtggagtaatctgtcaagatgctgctttaagttgttttgagatgtggttcaagggtgtttgttgatcaaacaccaagagctagctattaccaagaataataactagcatttgtaaatctccagattgacagtttgcaaagcactttcaagtattatttgatccttggaacaaccacgtatctcctgcaaaaatatgggaatgataatacctgctcattagggatcttgggaggattaaatgagataatataggtccaagtgtctagcctagcatttagtgggtgggagcagctgggtaaataggaaccatctttaacaatgcagaacatgaggccatggaaaattcaaaagcataactgtagtcagatgactacgttttggagctcagacccagggaccccattttgcccttgactaatcgtcacctatgattaaagcagaaacaactatggtccaaacataccacccttaaaaaattagcgagaaagaaagagagagagtttgagtatggagagagcaagtatttttgccttcacttttgacacacaggctccctggactgagcaaagaagttccctttgaagtggtgactatgattgaggatgagctagtttccactctaatataaataaagaagtaaaaatacaaagttgaaatatggaaatccatatggaatcattttatttacttacagcaatattgaattatccaatactcaatagtttctctgtacctaagtgttaacataaatgaatgaatctctgatgatccctaaaatcatttcatcacttgaaatgtgattatttacttaccctggctaaaaatgtaaatttatagtcttggtctatgagttcaacatttcaaatttcttaagagaccaaaacgagttaatattcatatttagttattcatgccaaagcgtggatacatataaaaatgatcaccatgtgttagtcaataataaaactttttgatctgttatccattcctctttctaggatcgctaatcagtcagaattgtagatttaaattggtttctaaaacaaagatatctcaaacatggttgtgcacaaagccactcagggttcatacgtatatatatgtgtgtgtgtatacatatatatatatattttttttatttctttttttttttttagatagagtctcgctgcatagcccaggctggagtccagtggcgtgatctcggctcactgcaacctccacctcctgcattcaagcaattctcctgcctcaggctcccgagtagctgggattacaggcatgcgccaccacgcccggctaatttttgtatttttagtagagacggggtttcgccaggttggccaggctgatctcgaactcctgacatcaggtgatctgcccgcctaggcctccaaaagtactgggattacatcatgagccaccatttataagattcagcagatctgagacaggtttagagtctgatttcaacttgtgtcctggcgttgccattttagaattgtgcgaacttaagggaaaaaaaacaaaactaacttttcaagcctcaattcctcatcagtaaaacagaggtaataattcagtaataactccataatgcttgtcccctaggaagccctggacaaaggatagtggttcctctttccatcactattgttattccttgaatgcctctatctttaccccgttattctaaattttaagccttttctgtagttatatggacaatgcagttggccctccatatttgtgggttctgcatctgaggattcaaccaatcgtaaatcaaaaatatttgaaaaaaaaacaattaaaaaagataaaaacacaaataaaaaagtataacgactatttattgtattattaattattaataattattgtattattataagtaacctagagatgatttaaagtattgcaggatatgggtaggttatatgcaaatattataccattttatatcagagagttgagcatccatggatttttggtatctgtaggagggtcttgaaaccaatcccctgtagatattgaggaatgactgtatatgttcttatacaaagtcaaacaatacagtttatgtaagtgaatcctcagtccttccagctcttcctctaccaactcttgattattcttaaaggatcaactcaaatctcatggaggactactctaatttaacttttaataaaattatctgatctccgacattccctattttttttttttttaccactccttcataattgcatgctgtttgtgtattatttcatattctttgggccggattcacaaaggataggataaagtaataccatgtacagtggcttacgtttgtaatcccagaactttgggaggctgaggcaggagaatcgcttgagcccaggagttcaacaccagcctgggcaacatagtgaaaccttgtctctacaaaaaaataaaaataaaaaaaaattccaggcatgatggcacacgcctatggtcccagttactctggaagctgaagcaggaggattgcttgagcccagagttggaggctacagtgagccgtgatcacaccactacactccagcctgaatgacagagaaagaccctgtctctaaaacgttaaaaatgtaaaaataaacctactttgggcataagtcttccctccccaatagtgtttcaatttctcaagcccagtggctgtattttgtgttcttttatatctgattactcatttttcaacaataagagcattctgaaaagctacaaggtattttatcagtagtaaatagttgttgaaaccagttgaaaaaggctgtaatgatttaattagattacagtctgtattgtgtaggtagaagttgcccatcagattaaaaaaaaaggaaaatcctagcccaccagccattctttcaaattttaaatacatagtcaagcaaaataatgcctttcaggtctctgcacacctttctgaatctacaagtttcttctcaatgatttctttcaagaaagtcttataaagagaccatttgaatttttaaaactttaattcaggcagcagtgatcaaatatttgtgattcacaaaggataggataaaataataccatgtacatatacaatcggccctccgtatctgtggatttcacatctgtgtattctaccacccgaggactgaaaatattcaaaaacaataaatggttacatttgtttgtactgaacatgtatagacttttaaaaaatctctaaacaatacaatgtaacaactatttactaagcttttacattgtattaggtattataattaatctagagataaagtatatgggaggatatacataggttatatgcaaatactatgccattttatataagggacctgagcatctgtggattttggtattcataggggtcctggaacgaatcccctacaggtacctcgggacgactgtatatattttgtgtgtgtgtattttcttccctattgcctcagaatagagtttaattccactttgagacaggatggtaaggtatcatgaggaccatagggtaaacttagcaatatacaattgcttagttttcgaaacttgggagaggaaggggctgccactggcgcacaatgggtcaaggccacggatgctgctaaacatcctgaatgcacagaacagccccccagacagatagtcatccagccccaaatgtcattggtgccaaagcggagataccctgagtcgaagcaaagcatctttgttaatgacataagagaaatgctcagttttactcttacagacatttacttgtttgtgtgacccctaaaccaaatctactttgagatgtagagagctgagacattgcagaactcccctcccgccatctgcagatgccctgagtggcagcctggcagcctggcagcctggaagcagccccagagttctttgcacagcgggcttctctcacccatgcccccagcccaactctgagcagtctgggcccgcacatgccagccttcaggctgtttcaacagtatttaaacctccaaaggcttatgaaatattctttaatcccttcccaaaacatgatttaggtgtatttgatattatctgctatcccctagatttcctagtgtttgcagcttattttcaggactaccttccaggtgtagccgtctgtgtcagagacaggagagcctgaggctttcctccaagtggggagtctgcagagaacaggctggcagctgagactttcgcccaaatggcttatatttgatgtataatagttttaattgtgatattattaaaagtgaattatttccatagatcaaaagttaactcattaaatctgttagtctattttaagttggtcttccaaaggaaccatttatatttatatagcattgcgtctttatccttgcaaaactgtggattctaaactcctcaagtcagagacttggaatagcataaatcagatgtgagtcttcattgctgaggctgaatttattcagtcataatttccaagcatttgttcctgctggaaggtactacttatttcacaagaagttcatgtcatgaaagcgctgagctcgaagggccatcacgcatatctagtccagtggttctcaacctggctgcacagggattaccttgggcagaagcccagcccaatgggacaagatcttctggggtgcagctcaggcattggggtttccccaaaactaccccaagtgattctaatgtgcaaacttggtggaaaaagtttattcttttccaattcctcagttacaatgagtaaactgagggtcagattaattcataaaggcagaagtcagcaaacaccgtaaaggactagctactaaatctttctggcattgcaggccatatggtttctgtgggaactgctcaaaagcagccataggcaattcagaaacaaatggatgtggcaggctgccaatgaagctctataaaaataggtgactggccggatttggcccatgggccatagtttgccaacctctggtttagatctcacagttggttagtagaaacccatatgctaggccacagatagactaaccttcaacaagtgatcttccttctactagatgcagttttcctgtttgaagcagtgtctataacatacccaacttctgtagaggttaaataataattatctttatgtaagttaaggcaaatatcttagcataggtactcatagtctagagcgcagaaattttcattatctgtgtctttatgagaggtctgcattttgatggtatttaccaaatttaaagtaataatcacagtatatgtgttttactaaagtaataacccagacaataatattcctatccaagaaattttttcagctagaaagtcagaaaatgagacagcgtgatcagaccaccaaagcaagcaagaaaaaaaaatcagctaagaaaaatggagatctgattttcttttcacccagtaaaggaatcagttgaaaatctcttaattcttccttactgtgctgatgactcatggggagatactttatctcagatttcttttgaatacatctgagtaaatttgaatatgaattatatctaatagctagagatgcttcctacgagtccttgggaaacagcatggactaaggctgaagaagtggaaagaaagccatcacaattaatgtggagagttatgtgtttggtacttatgaaactttgggtatttttcactgtttgtatagcctttcttccaaagtacactcataaaaatagggttcctgaaatgttaaaaagccactggatctggtcattttccttggagattaatttatctctatttggcaattacttcgtatctatgtttttcagagaaagtcactctacctcttcccttttttatctaaataacacattcaataaaagtgcttcatgtcctgaaaaaacaaaactgtcttatttacgattataaaatggtgttcaatcaatgatttccctgaggggataaacactagagatggaaaaacaaaatcaatttgtttttcacaaattgacatccctctgtatgatgccatcattgaactgaagttattgaaaggggccttatagagagggcaccatagagggaaatcatagagaataacatcatagagaggggtatcatagagataataactgcatggagaggagcctcatggagagggagctttgagaggggacatggaacacacagtggtagattaaaataatccagtaatcaatttggccacataaataatagtgatcataatttatgagggcttcccatactaattaaaatatgcataataacaacagttcattttcataattgtacacttaagtcatgctattttttctctttttgcctagttctatggtatgtgtgatcatggccttacaacttttagaaggtactggcaaatgtggttgcagtgaactgtttttctctgaagctttctgcagtaatcctcctggcattattaaggtttccttaatcatacttggttagaggtgatttgcggtcctaccaaccttaatttgaattttctctctgcctcagataagcttgactctggggaggtttctgaacatctttaaatttgagttcccaaattataaagtgggttcagcaatgactgcttttcatggcttatttgagaatatatgagattgtgctttaaaggattgagtagaatgcctggtttgttcattagttttttcttttcttttcttttcttttttcttttctttttttcttttcttttctctttccttccttctttctttctcttcctttctttaccctcccttctttccttccttttttttttttttttttttttgagacagagtctcactcttgtttcccaggctggagtgcaatgatgtgatctcggctcaccgcaacctctgcttcctgggttcaagtgatctcctgtctcagccttcccgagtagctaggattacaggcacgtgccaccatgcctggctaattttgtatttttagtagagacagggtttctccatgttggtcaggctggtctcaaactcccgacctcaggtgatccgcccgccttggcctcccaaagcgctgggattacaggcataagccactgtgcccggcctccttctttcttttttgagacaacatcttgctctgtctcccaggctagagtgcagtagtgcaatcatggctcactgcagcctcgacctccccggctcagcctccagagtagctggaactacaggcatgtgccaccatgcccagctgatttttgtatttttttgtagagatggggtttttgccgtcttgcctgggctgatctcaaacttctgggctcaagcgatcttcccacttcaacctcccaaagtgctgggattataggcgtgaaccactgcacctggcccccaaaactttcaatgatgacaaattattccctgtagtaccattactattattctaccctttggcataacatagcctaggctgcatgttctgtcttcttcaaggaagtgtctatgattaggagaaatgcaagagggaggaacatactggaggatgattttatctctcgcacatatgtgaggacagcaacacctaagtttgctcactccaccctagtaaaacttcactactggcttaatccttgattcttgagtctcagtggggagtcattttctagtactgttgagagttatatagccctaagggattttatgaaataaagtgttcccaaggagtgttctagaagatgagtgatatgagttaataccaagggtttcttctgacagggagtgttaggtgataagacaactgctgaagattgaactgatctttatccagggaagttctgcacttgagattgtctttataggacaggcaacaggcataaaaaaaaagtgctataaaaataggtttgtttgtttcacagtatcattgagaaaacagctataaagaagatatataaaaatatataaatctatcatgtggtcattaaatgccagcgacttattgaacgatgatttataaatggctgaaattcaaagaattttcatggaaccaaaccaaagcatttcagaacatctttcgttctttcaaaattgaatcaactgttcttcattttacagcttctaaatattgtttgtgtgtgtttttgctgttgttgcacaggaaataatttttaccttaaaatattaaaaacttttttttctaaataataaactccatgcagtaaaaggcaacaatcagagagtgtaatgctagaacatttcaggcatgcccaaaatgcccatggcaggatgaaggaggcaacctcatggggcccagccatttgtcttgtaaagtcttaaactaccataggaaatccctgtaggatgttctattgtgtaagagttccatttaaaatacattggcaatatcctaaaaaaaaaagcagtgaaaatctaaactatgtcttgtagcttattcaaatctattattcatctactgcagcagccaacactgctgcatagagctaaaggagaaaaaaaacgaagataaaataagcaagagaatcatgactactatgaactgataaataaaagtgttaaaaaagcaataaaacaaaccaccagcttgttattgggctttcaaataggtatgtttccgcctcctcctcctcctcctgctccttctccttctccttcattcagaagcaatcatcataccacaagcaaacaaaccattttgaaggtgtttaccaggaatgtttccctcccttttaattttctgacctgagtattggtacaattttttctttcatcctttttgcaggcaaaggggttactggatgtgctaaaggaaagtatgattgtagagtgggaaaagggtgaagaacaatgttttatcttcttatgtcaattaggcaggacaaaagacacaggctcccaaaaataccttcagagtttgtcatcctggatcatgataaccttcaatatgttgaaagtctcgttcatctgggttcaagatcccacacttaacgaaagaaaggccgaaatttcccgtaatgttctttactttgggttttacaaaaacacttctatccaggtattttttcttgttgaaattctgaagtaactcaaggtgtacacatgtaatttaaaacttagctttgaagccgggtgtggtggctcatgcctgtaatctcagcactttgggaggccaaggtgggcgaatcacctgaggtcaggagttcgagaccagcctggtcaacgtggggaaacctcgtctctactaaaaatacaaaaattacccagcatggtggtatgtgcctgtgcctgtagtcccagctactaggtaggctgagacaggagaatcacttgaacctggtaggtggaggttgcagtgagccgagatcacaccactgcacttcagcctaggtgagacagcgagactcagtctcaggaaaaacaaaacaaaacaaacaaacaaacaaaaaacacttagctttgaaaggaaatagcctatgtttccacaaattagagttcataattatgttgcatttctactatataggacagcaacattttcacctgatctgagctcatctattagcctttccttacaaatttgaatcaaaactttcgccaggctataaatctccctataattggtagagagctagataagaattatcccataataagagtttgggagaaccttgtggtattaaagggatgctgacatggaatactgtatatatttctactgttaaattagatgcagtcctaatactgtttgtgaaactaaattaggtcaatgactcagagctggttttatttagagtgagctatatattaaaatgtagcaatatttcccttcttctgaaaagccttctggtaaggatttcaattcattgtagaaaaacatttcccaaattaaggtattttaattaagtcctggtaagaaattccaagcatgcttttttttcccctcctcaaaagaggccttccacattgtgcatttagtgtttactaagatttcaaatctctttggttctaaccagtatcacttagataacacatttcacttttttttttctcccttaagtgtaacctgggaaatcccaactttccctttgatgcactaagtctttggcatctcaatctgttaaaccagtgcaacaatcataacaggcattttctggagatgttacaagggatgaaaaaaaaaatgaatgaaatgagttgactttttaaagaacgatgccataagaagcaagacataaatttgctccagaagtcaaatggtgtgtggggagaacaggctttgaaatcaaatggaactggtttggagttccagcgctggcatcactagtcgtgtaaccctgggaaacagcctgagtacattttgtttgtttgtttgtatttttgagacagaatctcactctgttgcccaggctggagtgcagtggcacgatctcagctcactgcaacctccacctcctgggttcaagcgattctcctgcctcagcctccctagtagctgggattacaggtgcatgccaacacacctggctaatttttttttttaaaaaaacagagtctcgctctgtcacccaggctggagtgcaatggcataatctcagctcactgcagcctttgcttcccgggttccagtgattctcctgcttcagcctcccaagtggctgggattacagatgcacaccaccacgcccagctaatttttatatttttagtagagaccgcgtttcaccatgttggccaggctggtctcaaactcctgatttcaggtgatccacccgcctcagccccccaaagtgcttggattacaggtgtgagccaccacacccagctctgagttcatctctccatcactagaaatcagggtaatcatacattccttatcacattattaagaggactagagatagaatatgcagaatactgggcatgtagtatgtgttcaataaatggtagctgctattgttactgctactactacagctgctgctactactaaactgctgctattctcattgttactattatgactcctactattatttctactgccaaacaaggaggactgtggaaaaagaagccactttatccagctctaaacaaatgagttgttacctcactgtagcccacctttctagcaggaataggagaatgaccaagtgttttggaatcagataaacccaagagtaacttaaggagaatgataggaccatcgttgataggagagcctgagtacattcccagtgctgtacttgtgtggctgtgaaaattattgttccaaagttgaatattgtcaagggtgttgagatttatctcatggtcaatatttgatctttcaaagctgacctatacctaacacacttcaaattggttcagtgtatgtagcccttgttacgtggatattattgtgagcacttatataccagggaatgtgtcatgaggaagaattattatgtgtttggtatgtagtcattgaattaagacttccacataatgaactggaatggaattgcattagaaattctttttttcatccaaaataaaagtaaactcaaatataattatgatgttgccttctaatgtgacctgattgccatatctttgtaatgttccgttactcctgccaacctaatgtcagtgtgtactccaattcaattcagcaaacatttattgatcctagtcagggatgggaagacactaagattagcacaaagatacctttgtcattagtaagttactacccagtaaatctggctagtatattaaatctatggtcattttttacattttgcttttcattctaaacatgtaaaatgataataaaaaaagaaagtatttagaacagtaaaggttcaagtccaccccttttttcttcacctttttgtttagacactatttctgacgttaattaccacattaattgggtcttaagttccccttccagtcctcattatgacttccacatttcttacaactggcagaccttgctaagtcgtgaactataagttttttttaaaggttcagagcatttagtccagcaacacaaattaccctatggagacactatatacactagtagcaatgagcaaatgtttcttttatttttataattgttttggaaaatcatatgattgccaaagacagcctacacatggtcaagttggattcatcccagccttaaaaagtctgcgaaacacattaatacttgtgatgtatagagttgagggatgttttgttttgttttaacatgcttcttatatgtacattggtaatgtttaatttaggttaaaattctatgaatgatttaattgatattatccaggtttgttaaccattttaaatggccgttgattttgccaaattccattctatgccattagaacgctgtccacactaagttccgttaatgggggtaaaactcccatcatttgactcttaagtatggtaaaatagctgtctagaaataaatgaaccagagtcctggaaaatccagtggagatgcctagcaatgggggtccccaaagacttcagcgtaaggtgcttatcccttgaagcccccaccctcccacccttcctctatttgtttcttaattgcacattgttgttcagaaaattcacacttgggatttttatattttgtgatttgaactcatttttgcaatttcctttttacatttctagagagctgcttgaaatggatgctaaactacaattccagccttatgtgttaggaaatactttttctctactacaaagtgcaaagaactggaaactactttagtagagttttcatttaaaaaacctctatcgtacttcagtactggaggaaagaaaatgcttgtcaatcaacagccttgtgtttttcagtcttgatatatgtaattgatatatgatatatcaattatatgtaatatcaaaagagatggtgtgcacaaagcctgcctcggagtacattgaataatattttattcagatattcattttaaagttagtgatttcagatatggagaagttgtagtcaccagctgtgatttactggggggtggtgggagggcagggggacctattactggcacctgaactggtgatttctgtttacctgtaatccaaaaataagtaagtgtctgctaatttcacctgctaacatgtgacagcatctttccaggcaaagagtagaggtagccctgagagtgaggcctttcttttcggctcatgtatgggagagaattgtgttttttagcagagaaggagatagcttagacctattgcatttggtaccttccgtagaatgtcagtatgacaagtaactggactcttccagacagatctcaagagaacctgagtgcccattcaagagaactggaaaaactttcaactcccaggcagcacccgcatagctctgaaatttgagagcactctgcactctcaattcattcccaggatttgaaaccaaagtgccaaattgttttctcaaactctgtaggaaccgttatccacctactcacccatctacctgcccatttctttagcaaatatttgttgagactactatgcagcaaatactgtgttcggtgctttgaatccaatggggagggagagcaacctgggtcttgtcctaaggatgctttccttttaagggaattcatgagtcttttctgccctaaattgtctaactgtaagaagaggcagggagaacctcagtatgtgttactagagaacattggcactagtcgatttaattttcaccaaattgactatttggatgagatcctcattatgcacagtgcacatccaacttagatggaaccatctaaattggaataatagacctttgtgatctgtgactccacggatgaaatattgggtctcagacaatcaaagacagactgactctcactttgaagcaatgcatcaggctttataattaaactagtttagtcgcaaacttcttactatgaacctcaggacgttctgcaggtaacaactagaattatttgtgtggaatactaacagcccaggaaacagattaaagtcacaggcagaattctttagccttgttaagtacttggtgttaggaagaatatggaaatttcccagatcttgaaacattgtaaaggccctgggatatactatctaaaggcctgcaggcagtatccagaagtcttccacgatccttttttctttttcttttttgagatggagtctcactgtgtcacccagtctggagtgcagtagcacaatcttggctcactgcaacctctgcctccaaggttcaagcgattcttgtgcctcagcctcctgagtagctgggatcacaggcatgtgcaaccacagccagctaacttttatatttttagtagagatggggtttcaccatgttggccaggctggtcttgaactcctgacctcaagccatctgcccgcctaggctaggattacaggtgtgaaacaccgcaccgagcccaggtgtcttccacaaaaattagccaggcatggtggcacctacctgtggtcccagctactcaggaggctgaggtggaaggatcacttgagccagggaggtggaggctgcagtgaactgtaaccacaccactgtactccagcctggctgacagagtgagactctgtctcaaagaacagaaagaaaagaaaagagaagagagggtttgatttttttttggctattgaggaaactgtagctgtaaatagtgttaattctcagaaaaccagttaaatggtaaaattcaggagatcattataatcaactttaatcatgaagagatagttacatatgtggctcagtttctttttttgtttgtttggttttgttcttgttgttttgaattcagaagcagctttattttaagaatctcaatttatagtgaagtctcaatctctttagtcatcattatgtaaaatagaataacattgcaaagaaaaatcaaataaaagattaaaaatcctagggctagcacatgattgaagcaatattgaaggtcacagatagtataaattctctgattattaacagaggtgagctttgttatagggagatggatcattattaagtcatctgtctgatctagagccagccgcacgatctaatgatttcattcttggattatttttaatatgtagaattagagatgtttgggaagtgtttgctattatcttgatagtacagtttcctcctaaattacttttgtaaagtaaaataatgttacattggaagaaagtgtgtatttcttagtaatgcttcacaattcctcatcctacatttcaataaatcatcttatacctgtcagcacatgtagtctaagatttattgcatggtccattgtgaagcagatagctccttggccagagagcaatttctgaaactaatttaatcaaaatgtttttataatacagtgaactatggcttgatgtcttaaatatgcattgatgtcttcagaaccatatgattaaactctatccaattttgaaatggaattaagatttggcttcatatgacttctgttatagtcaggaaatctttggttgcattaatattatttatgtactgttattgagcaaacattcatcagtgcctctatttgcacagccaacccgctagatgttaagatgttgtgggggaacaacaacaaaatactagtttagtagaaagacgtaactgagagcttggaaggagcagtagacatggcacaatttattggccaaaaaggaatccagttttgctgaagttgaatgttcattttgcagggtggtggtaattatagctgccttctactgggaaagttttaaacctatagttttgatgagtttgcacgccaactcaggagtttgaacttcatcctttaagagttgaaaaattttggagttttgagagtgatgtaagcttactggaaagattacgttgacggccatgtgtggacccaactggacaaaaattagaggaatgaaaaccagtgattcatggaagattgttagaatggaaaccttgggaagaaaagggaaaactgaagtcaaggagtcttttaaaaaaacaactccccaaaatctttagagagtgattagatagaagacatgaagagcatagtaatatcttttgtaaagatcgaggccgggcatggtggctcatgcctgtaatcctagcactttgggaggccaaggtgggtggattgcttgagcccaggagttcaagaccagcctgggcaacatggcgaaacctcgtctctaccaaaaatgcaaaaatcagactggcgtggtggcacatgcctatagtcccagctacttggggaggctgaggcaggaggatttcttgaacctgggaggtcaaggctgcagtgagctgagatcacaccgcagtactccagcctgggtgacaaagtgagacactgtctcaataaaaataaataaataaataaataaagggaaggtggggagaaatttcaaaggaacagatgatgcatttaagacagttgagtttaaaataacaggggaccagcaaagctgaaagttggtattgaactgatagtgagagactaaagcttaggtcagagttgagatctgagatcaaaatctgaatcgtgtcaggacagaggatggagttaaagctgtgaaaaagaatgccattgctgatggaatatgtacatatgaagccactgttttattataattgtttggatagaacatgttctggtgggaaactcacttgcagtcaaaattgcacagtgctaaagtctgcctttaattatagtaaatgcattcgatttgagaatttgttcattacctgtatcagtgacactttattcaaataaaaacagcacactggagaaagataacagttgtggaaggccaaaagtcctctttgtgatttactatcaccatttaattattaagctgtctgatgtcatgtgacactgcctccccagagtgtcctatcacagtgatagacgaaggtcacagacatttggaaatcaaattataaaagtcacactaaaaagtcctgagagcaaagtttaacatgtttgttttcagctttatatattttctgtcaagctgaattttgaattttgaagaggtacactgagtccaaccaatggttgggggggcattattttttcatcataaacagatgagtctggatcctctgctggctggttgccctctccccctttcaataccacttaatttttttttttaagaacgacgtttataagtaatcaagaatacactgggagcaacttcagcatgactgtttttttgcgtgtgagagagggcacgttgtgaacatctgagttctatcttcatttttattagaaaaagcaatttagaactgccagtcagatgggttaaaaagcacagctgatcgaggtgcagcatccatgcctgaaccttctgtgtggcatgacattggctcataacccccttacaccttctctagctctctcttcagttctgcttcctgttccgcagtagagactgaaggaactcgggaaaggcccaagaatgggacctgattacaaagccttagtaagtaataagataacaaaatgtccacaagaaagggaaagtggggagagaagcagagcaattgcttacttcctacttagcttttcctctctttctgttttcccaggggaaggtgcccaacaatttgtatttttaaccggctccccaggtgactgctgtggttgggccaagctacattttgagaactcctggtctaccttctagattctacagaaaagatgagactttgcaatttgtaattgttataactggcaagtctccttccacttctgagtattggacagttttctctcactggattaaaagcaaatggcttggtttttaaaagtttttgaaagtaacatttattatttgacttccgctttagcaacacgttgtatatgtaaactcaaatatagttcagggaactgagagctagttcacttccaaaatacagtgacccataaattgtctttagtcatgtataaacaaatgaatgctattgggaaaatgccttagtaaatattttttgtaaaacacagcaaattaaatcactttctagaaaatctattttttttttccccaggcaagtggccatcaatcaaagaagcagaatactaggtgtggttttctttgtttttgttttgttttgtttgaggcagtgtctccctctgttgcccaggctggagtgcagtggcacgatcatggctcactgcagcctcgacctcctgaactcaggcgatcctcctgcctcatcctccggagttgctgggactataggtgcatgccaccacgcccagctaatttttaatttttttttttttttgagacagggtctccctatgttgcccaggctggtctcaaactcctggattcaagtgatcctccagccttggcctcccaaagtgctgggacaggtgtgtgtcaccatgcccagcctcagaatactttatcactttggtttccaaatattgggaatattttgcaatttaccttttagactacacaaggcttcagggcaatgctcttgcctgagttgacgtttgaaagtgaatagagctgtaaatctattcttttgtcgtcagaatttttttaatgtttttcctaaatatttaagttaaatgtgttaaaatattgttgaatgataaacatctgtagtacacttctgttgtgtttctggtgaaagtaactactgttaaggtcaacagaccaaatttgtatacaaatgctttggcaaattagaaattgaggtgaccattcagtagctctttttaggcattgggaatactcgaatgcaagaaagcattcccttatattttcaagtataaaaagtcctctaaattccttaacagcaacaatcagtgtttccccgctaagcactgttttaataaagttgctgggattttctatgataaaatcacataaatttatacttctacatacatctatatataattttattcctgtacttgttatatacatataagctgcattacaaatatatttttattctgaataaatcctaaagtataaaagtagtaaattgaataaattattgattttccttcactgtatcacagaacctgtttctccattttgagcaatggttctcgaacttggatgcacattggaatctcctgggtagctttcacaaatcctgctccctggacctcactcaggcgaagttatttatactctccggttgggaagggaggatagatccaggtgattgccatgtgtaggccagaatgggaactactcccctagtagacactcctcatcttctttccttccatgatttccacatttctttcaactcagtcgaaatcatcttgaatagacaaaggcagtgtcggtcctactaaaggttgaggaaatggctgagtaaagatgatgaagtcagggacaaaggatgcaatgaattttaagaatttgagattcaaacttcaaaacttaggcaagggtctgtttttgaaggttcagagctgaaaaacaatggcatgctttcatattcttctttgattctgtaggatgtcccaaatggggaattctcttacataatattgattttgtaaattcctgacagatcgtacccactttggatggaatggaattttaatctatttttttgagccaaagagtgtgacctcccttggccttaaatatttttttgtaccacacatgtggggatatgagtattgtgaaagctacgaacctttcctttgaatgccacaattcaagaacaaagctgatcatgtattgaattttaataatcattttcagcagctggtccagaaaagggcattttcctctaaaacctaaaaaattcagaagataaattcctatagaaaaaaaggaaatcatacttatctattcaaaattattagatcaaagactttcaactattttagcttcaaatatgtttaatatattgagtttaactgacatgaagtacctgcaggatgcgtggtgctggcttagaaaaagatttggttttcctacagtatctgaaaaacaaaaatgtattttcatccatccaaggctaagcatccactatgagactaatttgacattcaggtctggtaaaaatgtttgatggtatcagttaaaaccctgttgaagtaggaagaccagaacatgttcattagtgagtatctggcaatgttatcatctacttaagatggaagaaaggggataagatcaaaattattcaatccctgagtgatggaggaagtaaagcttgaaggggcctatacagacaacatgtatgacatccatcagtatcaggggattttatagacattaattatctagtgctctacaccctccctgcctgccttttaaggtgtattttatgattgaggaaaaaaaaaaagaccaggataatagaattgaggaagatagcaatcaatgagtaattccttatccagtcggcacttaaaactcaatgctttatatatttatttgcagagtggtaggaactaactaatcctcatgctgtgccttccttactcacttttgaccatgtttttgctatagcaaccttgatacaattgaagattgtcatttcttactcttcctcagtttgaagctcctgctttcctggacaaaagacacaaataaaacaggaatttattcaatcattgcattttatccataatttaagacatcttatctataatttttttctgagttaaaatttattttggtggttaacaaaaagagtctttagaattttgagtacctgaaggattggaatttgaggcatcctcctacactcccatagtaggtgttgaaaatgttaagttaattgaattatattgaaattttaaaatggcttggagcaacagaaaaaaaatgttatgtataaattaattaaaaactacatggactgtttttttttttttaccatccacatggataccagggatttcttttctttctctttctttctttctttctttctttctttctttctttctttcttttctttctttctttttctttctttctttctttctttctttctttctttctttctttctttctttcctttctttctttctttcttggattattaaaaagagaaggttgttttttaaataaggaaaacaattttctgcaaatggccagatagcagatattttggtctttgtaggtacaagtcctcaactttctcattgtactgtgaaagcaacagtaaacaatactttatggctacagaaatgtgagttttgtatacttttcatgtgtcataaaatgttattcttttcattttaaaaaaaattatttaaaaatgcaaaaatgagggcgggcacggtggctcacacctgtaatcccagcactttgggaggctgaggcgggtggatcacctgaggttgggaattcgagaccagcctgagcaacatggagaaaccccttctctgctaaaaaatacgaaaattagctgggcatggtggtggcacatgcctgtaatcccagctactcgggaggctgaggcaggagaatcgcttgaacccaggaagcggaggttgcagtgagctgagatcgccccattgcactccagcctgggcaataagagtgaaactctgtctcaaaaaaaaaaaaaccattcttagctaacaagccacacaaaaacaggcggcacgcaaggtttgaccagtggaccaaccatagtttgccaacctctggtttaggacattgaatatctcctgatttgaaagttttcacttgaacaaaaataattaactactattagtctgttctacaatatcctcctcaccatgtaattcttaactggcaagtagattgcctcttttgttttatttatttatttattttaaaagacagggcctctttctgtcccccaggctggagtccagtggtgcaatcataactcactgaagtgttgaactcccaggctcaagcaatcctccctcctcagcctcctgagtaactgggattacagatgtgtaccagctgtagtctacaaatttgacctgtacccaatccttggcttaatattaatttttaatttttaaaaaagtttttgtagagatgggggtctcactatgttgcccaggctggtcttgaactcctggtttaaagcaatcctcccgccttggcatcccaaagtgttgggattacaggcatgaaccacagtgccctgcctgtggcctcttttgatattgctatggcagcccagagtactgtgttgagaaggattcagaagttgaacaagggcaaatgagcagagagggctgccagagagttgcccaattggaccatccacagctcttctagctgtgttatagtcttacaaaatgcttcctttatgtcctgctgataaaagttatagacttattcttagaagcatttttctgcaggcataaattttgcaactgagatcattgtttttaagttagagaatttgaaaggattctagtaatatagcttcatgtgatatccattctcaaaaccaacaaatgtatttattggtcatttgctcacctctcttattataggcagaaatggggctggggaggaggagtgaataaaaaaggccattcacatctctaatacctggaaataactagtcgtcattggatctgctaaaattataactaaatgaatagaactatactaagatacctatttatctccattaaaataaaagctcttctagaccatacacagtatttaaaagttgttctctgtatgttattgactaccaggttagaaaaataaacactgaactcctaatgatggaatttataaatatatggaacagattctgtggtgttaatatagaaatttcaaataaaacctgacaaggtaaacactgtatcacatatcaaaatgacttaaattgtagtccatggaatactagacttaaatttatatgcagattgtattttattaggtttttgaagttccctcggcggcctgtcttgccagggcatttggaaatggtagctattataaccaatgaaaaaaatgcattaaaaaattaaaacaacctaaattacatgtatttgcggtctgtcgagtcaaacctgaagatagtctcagcctcctgcagtgcaattaaaacatctttaaaatttagttacatataaagaatttatgcttttatacaagtggcatgtgttaatatgggtgtgttttcatattaactattgtgattaaagtttcttagaagaaaatatatgggtcgtggcacttgacgtgtccatatcctgatcacgctggagtggtggtgttgggtgccagggctccgaatacagttgctgaatgtcactctgaatattatggaatgaaacaagccagatctgtgtttgccttgaaaggtatccagacctaatattgtactttaaagacattctgaagtattgacttcggaataagagcaagcattctttaagtcctgggcaaacccaaaaggaattactgaaatctcctgtttcaagcatacattttaatagtagtgctcaatgacaagtcattaattccctgcaacctgactcttaggttcaggtctccaaaggctaaaattaggggcatttgtctgcttcccttgctatttgattgggtatcactgtatgtagaagtacaaagctcatctgttaagttggatttactattctctgctggtgtccctatccatgcctaaaggctcatattgagattggtgtaaaatcagctgtcccaacatgaattgttcaattatcagctcaaataagccttactaaaaactacctaacatgaaggaggttgactgtggctctgtgaagatgcatccaaaatgtgtgcattaaaaataaaaattataagaaaaattaatcaccctttttgcataaagtatgtaaggaagcctcattctttaagcaacacatgttttataactttgccttccacaaatttgacctatacccaatccttggcttaatattaagaaactaaatctgcccacaggtatccttgccttttataaggaccattttgaattatttgtatttcttttctttggtggtagtggtgggagggtagtattgaatgccaccaagtcgtaaacctcacagaataagagcactatgaaaaaatcacttggggaaaaggtaatgaattaaggctgggagcaacttgactttgggtttagatggaacttgaagttgatgtgttagtgataattgctatagcatctctctatttttataaatcccggtttggaaaaatttgtttgataatgttatatttgccttcacaggaatcctgtgctctggacagtgttatataacattcctcaaaaattcttctaaactctcaaggccctcttcttggggtcagactcaacggtaccaatgagaaaagcctgaaagcatggaagacttctgttgtttagcaaagctgagagaagacattgtcttaactatctacactagttgttaaattaactaatcagttgatttactacattggatttcagaagggttgtccggtgaatattcagttttccatgctaattggaaatatcattgcatatttaagggtgtacggtgggaagggactaagcaatgatgggtatacagcaagtactcaatacatcctgtggctttattatactctctttttgctggtagaattttctgctacacacatgcattccaggcaaagggaagagactgcgcccatgctcagacccagaaacaagcctggatccataaaacagcttgttcacaatggcaggagcacagcacaggagtggggaaagtagaggaaaagaggtatgagtaatactgaccacgaaaggaaagggagttgcccattcaaactaacagatgagaagggcttcatggacgagatgacaacaaatagtagcattagcattcattgagatttaggacattgcacaacattttagaaatatgtacacttagtctaaaacagggacccgcagtccagatgggaattctgacaataatcacatcatgagaaagctgagcaaataggattcagtgtttttggaaaatgtaatcttagggggaaatatattcttgtagctatgtactactaaattgaaaatctacagaacaaatcatttatgaaatgtgtgggcatgcttttaatttggtggtggtttaaatattttattaactgtatgggcatgcttttaatttggttgtggtataagtgttacaaattaagctttttttaaaaatcagtctaaactcgaaacttgaaaaacaagttttttattttatttaacaagcaccgatacaacacatcgtgagccaggtactcttcctagggcttccatgtatctcctcctctaatcatcttgacagccccatgaggaaactgaggcacagaggttaagaacttgttgaaggtctcagagctaggacttcaaaccaggcagactggcaccaggttctgtgtacttaaccattatgctccttaaattagaatatctacgagtcaaaatgctgtttaattttcttcagattattgtgggttctgtcaagctaagctttctgcccataagtgaaagtgctcttagcatcttgtacagaaagaattcttcctagaggttcattgagtggcatctatttcagacttacacaaaaagtttgggacaaatgttagtgtttaacagaagcagatgtttatcagtggcccagacaatattatcattttgagttttaccttctaggctgggggcgtggcaaacaacagttgtgggtcaaatctcactcaccacttgttttggtaaataaagtttcattgaacacagtcctatccactcgtttacatgttatctatggctgctttcatgctaaaacagcagcagaattgagtcattgtgtccaagaacatatggccaataaagcctgaaatatttactacacgatcttttatagcaagtttgccaccccctgttctagaccagtgaggtagccaccagccagatgtagctcccaagtgtttgaaatggggctggtttgagttgagatgtgtcataagtgtaaaacatatcagattccaaagacttagtaaaaagaaagaacaaaatataaaatatctcatcagttttcaaatattgattgcaggtggaaatgacaattttattaaaattaacttttcttggttctattttttttaatgtgactactagaaaaatttgaaatgtgactcacatttgtggctcacattaggtttctattgatactgctgatctacagcctggaatttggaggatatgtgacctctaggaaaagcagaaagaggaaagatggggaaagagagaaaacctcttgtatttgcaaatgtctttctaaagcaataaaatattttctgatttggctcttcctcacagaaaggcatacgcaaaaatgggttaggtggtctatggagatgatcgtagatgagttctcccagaagcagactctgactcagaatttgaattgggaggtgatccaggaagcacctggagggagaggggatgcaaacagggaagagattgaagaggaaagagggttaatgagcaggttgttgctgtggacccatgtgctgcctcccaattgcgccctgtgggagattttgtagacagaggctcagagtggttccacccaggaggtgaaaaagctgggctgcatatccaccaattgccagtaattgccacttgagggctgctcctaggaacatcagcttcttcttactctccccagcacctgccttgcctgaagccaggtaaggccctggggtgaaaaggcacaggtgcttgcaggaaaaagccatgagcaagctggagaatggtgcctcccagaggcacagggttgggcccttctagtgtctggaactgtgtccaaactaaatgttccatcttctaattcataatttcaacagacattcatgtagttctctggtgaatgtgttcattttctcatttgatcttaacaatagtatagataggtagatttatcattatccatacattatggatgggaaaactgagcccaagacacatccagtcatttgccgaagagagtccagctgggatggtagtcccggtctcctccctcttcatatgtggtcactgactccttggatttctacaaaacttgccttgagtaaggagatgtcaatatattgatgttttcaaggtgagaacaggaaactaaaaccaatttttcttgtgctctgtagaatttttttagatatccatagggcagtatagaaactgatatctacttaatcccatgacttttatatggaaaagtatgatctctgttttgcacaagtcacaatcaaaatcaagagattatggagactgctgaccactaccacacaggatgttagtgatagagttaatttccagaaaatcttcagagaagtccctgtagtggaagcttatgggtgcatggctcattaaggactggattttgttatcttcccattacccaggttcccttcaaaggtgttgtcagcccctttggtaccacttggaaacaagtctctctcccagcttaatttccctttattatgcttctaactgactcggtaattctttgcagacttcagtaacacttgtactatttaaatttgaataaccccaaaggatctggataggtcaatgtgtttaaaccacaggctttagtctatgtattagttgattaaaaacagatttgatgcatgatgtatacttaataaagggagggggaagcaagcagatgtttgtaaaatctcaatgtgttggattgcatttctttggccctcttttgctgactaactttagaaaagtcatacttatgacaattgaactgtaaacagttagatgatgtatttccctagaaatttcctgctgtgaagggtcagccaaaaagaaaagtatcccctagtattaacataccaaaaaagttgacaaatatacgttataatggttatgtctatatcaaggacattgaagaatgggatgcttcaaaatcatcctctagtctctgaccataaagtgattagcagttgcgattcatttaatccaaacaataaaaaaaaaaaactttggcttttgttgttgttgttgttgttgttaaaagcaagtttttctttgatgcaagcataagatcaagttgtacataaatcactgtgtctagttcattctctgactcttcagcctcttgtatcccattctttaagtgaaaaagttattcttcccctttaaaattgtcatatttgaaatgttttgagtgattccaagacagaattgaaggtttcttgttggttttccagtccagatgaaatgtgcacaaagccttcctctgaagtttgaacacatgagaattacagataaaatattttaaaatgtattttagtgaatacataaccaagcataaacatatgtggaaagcctccaaggaccggaaatgaaagaaagtgtagagtggtgagagaagactgacactgggctactcccaagaagtggagatgacatggggcaatggtgacttcagtggacacatagggaagtgaacatcacatgtggcaagagccttgtacacctggaggccaagacccccatgcatagactggactcaaagggaacctgacatcttctctggaattgaagccagacacagaactctcatggaaggaagcagaggcactgagtcaaactaggatctgtgcctctgttgcacacgagtgccttgtgggagcgtcttctttgggaaaagaacctcacgccctaacctcagaatatgcttcttatctggctgggctatgtcaatccccaaatcacagcacagggaacaaagtttacatcgtatgagctgtcagacaaaaattacaagacaaagataaaatcagatccttgagaaatagtcaacaagcacagggaaatacagaattgccttttctcaaaagagcttaagaataagtaagtttagttgttttgagattatggagaagagaatcgtgtttttgtaataggaacagagagaaattcaataagaaaagggagatgtgataaagaacctactagaaatgaaaatgcattcattaaaaaattttaaaatcagtcaataggataaacaccagattaataagtttaacttgttttaaaaataaccagaaagttctgcttttgacatatgcattttaagccttagatgaaagtggttcttttccttaatatacttttctaaataaaaaatttagggaagtagaatgagctaaaattttcataaataaattttacagcataatgaaattaacacctttatgaacttgttagttttcaaaatccctcaaactctttctaaatcctctttcttggatggcattataaatttgaggtctgttttcttttccatgaaatttcctgttgttccgtatctttgccatacttgtggaactgtctatatgctaaaacacagtttccctaatcttttgccctctcaacctctctgatgttggcatacgacattgttctattccctgcccatggaagattcttccacatgctcacttctttctttccaagaagtttccactgttgtgcaacaaaaaacccctggacatccttcaagcctcagctgcaagacttggccctcttggaaacctttaaccagcagccatcaactctttcccttctcttgtttgcagcatctttctcccagtttgtacagtcatccatttccttgtggacagggaatagatattaatatttttatttgatttccccactgtctctttcagagtctggcatattgtagaagcttaataagtacttgttgtatgaacacataagtaaatgaatgaatggtaggaacacataagtaaatgaatgaatggtgtaaatcaagcttgtccaacacgtggcctgcaaggccacctgcagcccagaagcgctttgaatgcagcccaacacaaattcataaactttcttaaaacattatgagattgttttgtgatttttttttttagctcatcagctgtcattagtgttagttattttatgtgtggcccaagacagttcttcttccagcatggcccagggaagccaaaagattggacacccctggcaatcaagagcatgtgaatgagaaggaacagagaaatcttagtgagtcttacccagaacagagagctattgtgtttgaaaataggattaaatagtcattccagagaactttaagtttgatgctctaaaggaatagggaataattctagagtcttatgcaggataatgagtggtaaatacagtgttcaaagaaatttgatctggcattgatggacaaagaatagaagcatgaacaataaaatgtacaattgtttgttggtatccataaaggattaatttcagggtctctcatagatactaaaatcatggatgctcaagtccctgatataaaatggcctgttatttgcatataacctaatcacatcctcctgcataccttaaattctctctagataacttatattacttattacaatgtaaatactatgtaaatagtagttatattctatggtttagggaataatgaggagaaaaaagtctgtacatgttcagtacagatgcagtcatccatttttttccaaatatttttgatctgcagttggttgaatccaggtatgtggaacccagtggatacagagtcaactccactacaactgaccaaatgtgtgtgtgatgaggacttatcataaatgtctataaatgaccttattgtcagcaagagctaaacaattcaaaccttcctccaagggattagcctcagcctgcccataaaaggataaatctgaaaaatccaatggtagttgatttgatgtgggaatatattccttatgttattgccagctctgattcaagtaaagggatagaaatccaattacctcctttcttcctaggtcgtgacctagagataacctataactaattattctgttaagtatccctgagttagtgcaagaagcaggaacaaaaagaataaagtctgagcgtgtctaaaaggttcttttaaatgcaacttttgaaaatccagtttaaatctataaatacttgaaattatgtcgatttcactaaggtttctgaaaaatgtatcagtttttcctgagaatgagtaattttgtgtatctgaagtataaaagtatgcagaataatatttttcctcttttttttttttttttgaacagcaaaacttagagagtaacctcaccaaccttattaagaggaacacagaactggagacccttttggctaaactcatccaaacctgtcaacatgttgaagtgagtatctctgtatttctgtatggtatgtttcatatgaaaactgccagatcaaggttttgatatcctcatgctttataattttaaaacaagaatctttcttaaaattaaatattttgcaaaagccaaaataaaagatggaggaaattaaaaggaattagaacttcagagagtctttcccatccagggctgcttcccattcccattatagctcttcctgatctagcattacatagcagtcctaatgttggagattttaattgcccttacaaagaacagtcaaaaaaggtattgtaggccgggcgtggtggctcacgcctgtaaccccagcactttgggaggccgaggcaggcagatcacgaggtcaggagatcgagaccatcctggctaacacagtgaaaccccgtctctactaaaaatacaaaaaattagctgggcgtggtggcatgcacctgtagtcccagctactccagaggcggaggcaggagaatggcatgaacccgggaggcggagcttgcagtgagctgagatcgcaccactgcactccagtctgggcaacagagggagactccgtctcaaaaaaaaggtattgtattagtgtactatggctaccataacaaattaccacaaactgggaaagtatgaaacaagactaatttattctctcagttttggagactagaagtctgaaatcaagattttggcagggccatgctccctacaaaggttctaggggaggatccttccttgcctcttcccattttctggtagttgcaggcaattcttggagttccttggctttcagctacagcgctctaaacccttcctccgttatcacattctcctggtgtgtctctgaatatgtgtccaaatttccttattgttataaagagcccaccctactccagccttacctcactttaacttgattacatctgcgaagactctattttcaggccaggcatggtggctcacaccctgtaatcccagcactttgggaggctaaggcaggaggatcgcttgagctcaggagaccagcctgggcaacatggcaaaaacccatctctattaaaaaatacaaaaaattagccaggcgtgggagcacacacctgtggtcccagttacttgggaggctgaggtgggaggatcacccaagcctgggaaatcgaggctgcagtgagctgagattgcaccactgcactccagcctaggcgacagagtgagaccttgtctcaaaaaagaaaaaacaaagattctgttttcaaataaggtcccatttacaggtaccaagggttaggacttgaacatacctttttgcggacacagtttaatgcactgcaggtgtatattaatgcatcttagttgtcagatatgtttccatgaaataaaccacaattgcaacaacagcagaacctgcaatgactacactgaataaggaaaaaatagatgccacttcctttatgtgattttcaaattcctcttccatcttctcccaaactgtcttttttaccaccccaccccatgaactgaaactaaacaattatcattcattacacttttaagccttctggcccttaaccaagcagttccctctgactggtaggcccattcctctaacccatgtctatttgtcagaatgcttcttgtgtatcctccaagtcctaagtcaaggggcacttcagttgtgaacgtttctctggttccctggaccagagtcatcgctcctttctctgaatcacgtaacattttatgataccgtgtatgtgattcagagaaaggagagatgtccccgccccaatctcatgtcgaattgtaatccccaatgctggaggtggggcttggtgggaggtgtttgggtcatgggggcagatccctcatggcttggtgctgattccatgataatgagtgagttctcacaagatctggttgtttaaaagtgtatgacactcctcccccaccgcccgcccccctcccatacacactctttctcttgctcctaatttcgccatgtgacgtgccagttctggctttgccttctaccatgtgtaaaagcttcctgaggcctcatcagaagccgagcacatgcctggtgccatgcttcctgtgtagccctgcagcacccgtgaaccaattaaaccccttttctttgtaaattacccagtatcaggtatttctttatagcaatgcaagaatagtaataatcttctcatggctttatcattctttcatgtaccagttccatttttccaaccagaatgtgaggtcttagaggatgggaatcaaatctaattcgtctttgtatctcacagactctgatgcaatgattttcacacagtaggagctcagggaatttgttttagatgaatttgcatgatgactctccaaatggcaaattttgaacactatttgaatgcctgcaagttcagctcccctaaaatatctaaagttggagaagcaaattattttgagcaggcatttaaaaattttgacagtaactccatttttgcaataagaattccttcaagtccctttgatcgtctacgcagtaattataagtttatagcctcctatgtgcctataactgtcagtagatgcacaatgtagcaaataataataaagattacaatatgttagagaacagtgtacacacatataacaacatatttaaagaacagtagagtagccaatcaggtgctcagctagtagaatattgcatttatggattctaagattagcatttttttgaagactaatattgctgaaattgagctgcaacttaaatgaatggtgagacagtttaatgggcaacatttgtttgttcctactggcacacaaaatatagatgagacagttgctggtatcttagattagatggagtatggtttgagaaggggggattaaaagagaaaaaaatgcgaatacaatttttctgaagctttgtggaagagtcaggacttgagccagttcttatagatttcacaactattatttttcagtaccctaagtattgaggtgtcagcttatttatgcaacacaatgatgtttgtcagtgatacattcctcagcatagcagaaattagcaaagattgctttcagaaagatcctatcagtgtaaaagcatgtctactatgcaaatactggtgctttggtggaaggcttaaaatactttgtgtttgtaaagtctgtgcttttacttacaagtgctccccttgtgatcagaaatgtaaaactggttactaagagaaacacatgagttagcaactttttccaactccaaatttgttgtgttttccaaggataatatccagggagacagaaattagggatgttctcatctcctacctaagccatctactccagctgttcatcatttgaggtgctgatggaggttatgataggtggaagagggaaaggcatacaaaaggaaagaaagggaggaatcagagtaaaacataggtgagagagcagattaggattgtccagtgagcttattggttcacttagtagaccctcttgctttaaaagctacatgattgtcagggtagaatcagtgtttcatcatgttgagatgaagttgagagtgtgaaggcagcagtgtgttgcagaatccagaccttttgaaccctctgcttagactggattctcttttggcaagcctcttgccagggaacatgttgagccttgttgattaaacaacattggaaataatagtgaacaagcataatgttttcattattatagggtaaagttaatatgtattatatgaataaatggatgaacaaaatggaataatctgtgtgccatattttatttttatgatgtgatggcatttgatgtttaggatagtaagaaagaattatttctcttcagttaaaaaaaaaattacctgagctttatggtaaatcttataaatgctttatggattgggtgattatgtcattcaatttcagctagttactccttaaagcattaatgtctggtttccattatgacctgttgtgatttcagaacaaatgcattgcttctaatgcaatattattatggcttgaatttacaagacgctattcatcctaacatgatgtaaaattacattctaagatgttcagtaatttcaaatgatagataaattgaagaaatttacagggagattttagttttattttaatagatcagatatgattttagttgcaatacaggcttttcaaataaagctattactgaattgattgtagtggacttgcatttacaaggaataaagaatattcattcttttctctgttgtttttgtataaatccttgggaatggaagcacatgtttatgggtgagtaaatttggtatttgggaaatttattctagataaaaattaaagaaaattatgagtacaaaaataatgatacttacagtacttatttttacgtttgtttttattcctaattattagtattctgaaagtataattttcaaaagttgaacacccaattctcctataatgaatgaattagtccacatcaaagatttttttaacttcttaatgaaggaaccagcaagatgataaagctgcttccaaggaggatgccagaaacggatacatataaatgtggggaagggggtagtagggggaaaagaatgccagactagcatagctaatttggatacaaaactggttagtgacctacagggcaataaacctgaaacatttggacaaaataagttgcatattactgggtttctctaagttaacatctaacttcgcagagtctaagccctaaccactagtaaatagaaagtcagactctgttacatcccagtctggagagtcagatgaccctgacttaggctgacttcatggaatatgctctcgtgggactttggaagggctcacagtcttctctttctcttttttccatgttttggataattttgcttaacatgactttctgttctagagactgttggtctaggagcagtgtttgctaaacaaatatttctgggaggggatgtacatttttgcctgtggacagttactttaatttgttacagtgtcttgctagtttgttcattttggtagtgcggttggagtacccactgtgtgtgtgttgcactgtgttaggtgccaaaggaccctgcccacaggaagtttactatcttcactaagacagaagagcacttataacacaaaataaagtagaaagccataattaccatgaagaaggtgtggattatctacttcaaactttcagagaaacaagaaattatttctagctggggactggggaagcagcgcaagatctgagcctgccttcaagggtaggtaacatttgagtttatggaagcagcactgcttgccaggcaaataaaggcatggggatagaaagacgaggaatgtatgtacacaaagcaagtagttcattctggagaaatggaaagcatggaagaaggaaggatctgtaggaactagtttgggagagttgagagctggaaaggctttcgtgttgcatctgaatttgaactttggttttgaaggtttagtgagggttcaaggaacacatagacctgtgtgagtttcacagtgacaactggcatttccaactcttttcaggaaatgacatttttggttattgagaaaataatatggatattgtcatgcaaaacaatctcatgtccaagggaaaccttcacagcactaggaaactccaaaaaggccatggagtttgttaggcaccagcatgctattcttttaaatcagtgcagtggaaaagaatttcctggtccacatccttggttcctagatggtacttcttccttttcctcttcctgaaggtgtccttgtatttgggtatgagcattccccgggaaaataattcccatgccagctggagctaaaaaaaactcacagcacagaggcacctcctaattgttgtaaattaaatcaatgaattccttcccacgacccatgaggaaatgccacatccttataagtccacatctcttcccagggatttacctctgcttttcttcagaatggaaaacagtttgaaggttccccttcagccacccaactctccccacccctgccacattgttttcataacttgttttttaaatgagggtaagcaaatgaatggctttttgattgtaagtgccaaacatttttaaaacggtggataacagagaatggcatgctgtggctcatgcctgtaatcccagcatactttgggcggccaaggcaggaggattacttgagcccaaggattcaataacagcctgggcaatacagtgagacctcgtctctacaaaaaataaaaaaactagacaggcgtggtggtgtgcgcctgtaatcccagtaacaaaggaggccaagactggaggattgcttgagcctgggaggtcgaggctacagtgacccatggagtgcaactgctctccagcctgggtgacagagtgagaccctgtctcttaaaacacacgcgtgcgcgcgcgcacacacacacacacacacacacacacacacacacacacacacacacacaagagcagagtatgaaggccaagacagtttgggactcaggaggcagagacattgaaagagcaacttcaggccaggtgcggtggctcacgcctgtaatcccagcactttgggaggcccaggtgggtggatcacgaggtcaggagatcgagaccatcctggctaacacggtgaaaccctgtctctactaaaaatacaaaaaattagccgggcatggtggcgggcgcctgtagtcccagctactcgggaggctgaggcaggagaatggcgtgaacccgggaggcagagcttgcagtgagctgagatcacactgctgcactccagcctgggggacagagcgagactccgtctcaaaaaaaaaaaaaaaaaaaaaaaagagcaacttcaggtagactcctaagaaatgtttgtctaggattgtaaaaactaatgggttttcaaccactctattttgttttcttcaggagagaaataaggtagaatggatgagtttgtagttacactagacaagtttggagttaattatatatgtagtgaaagacaagcttatgagaaatgatcaaaatttgggtcacctgtagaacttaacttttctaggtcagataaggactgtatctcttcatcacatttctctttccattttctttgaaaaatcagaagacacagtttattagctaagcaaacacttggaatcactgatatgtaccaaattttctgcacattccaataatcaagttcttttacagcaaatacaacaccttgacacttaatagatgttcgttttggaaatgataggtgccagtgactctaaagatgatggccaagaacaactgggaaagggtggccaattgccataatggtttcaagaggataaaggctcagcagtccttaccattcttgctcaaggtcatcctagaagggcattttctaatccaacatcacttcaaagttccagcattggcccctttggtttatcttgccttgtttgtaatcacttcttaaaattctttttgccattatttttctcactaagtttttaatctatctttgttgttgttttattttaatggaaagtttgctctcatacggctttctctgagtttctccagtgctagttgtcatgtaaagtgacaaggttcttgtggaggaattaaggctgtttaattagatttctgctcagatgatgagttttgtaaattgaaaaggatgagagtgaggtgttacttgggtgatatgtaccttgtaagaaattgtagaaaatcacttggcaaaacagatgggagtctgtagaagacttttccagtaattcaccaagccctaaaagcattcatttgtaaactttgaaataatgaaaaatcactgggttaaaaagaaagatgaaccatttgtttaattttgttgtgcagttttgtaatgccaaagcattctctctccgtagaaaacttggcaatggcttcatccggagtcattggatgaagaccagcatgcaaacaccaaacgagctatttgtgtcttgtgaacgtgtgtctgatcttggatgaagtatatcctgctgggggccgacatgaatgtccaaagttataatccattttcacttgcagatgagggtcagattcccacccgatctgaccccctgtgagaatgctttcaaggtataattagagtcagattctgggcctcattaaaccacatcatacaacccacagtcagctctggctctccatgtaataggctctagaattatgataatgtgatagtgcaaatatggtggctttcagaaactggattatgacgagccactataataatggttgatttcccaagttcacgtcttaggattcccatgacaaaggagaaaagaactgttggtctgcacagaaatttatcatctctggagaagatttgtttttactattgcatttgaataatgtctattcatatgcaatagtaagacagttgaaacagtttactctaccaagtttactaaaattgacaactcatgaagcaaatgtagtttttcttggtagaggttaaatttaattattaaagtatctaacacatacttgaatgtctccctttggattcagtgcccttgacttagaaaaatttgattcataacaggcattggatcctgtttctttcttgggcatattcataaggagtaatgagaagatatcagcaaaaatctttgagtattttggaatgagattaatcttatgaataaatgaatataaggcttagtaagctggtattacttttagaatgacattcccaagtttcagttttgaaactttatataaaacattatccaaacctttcatcgtctgcaaatctttctagtttgggtggtatgacctattgcatcatatacagaatcctacctagtggctcagattggagtatgaacacttgtacgtgcctctgaagacaaaccctctaatgtttgaatttggtagtgcagatttccaaggttaatacttaaatgtgaagcaataggccttaattggaggcccaaaggctgagcattagaaagttagagagaaagtgtgcttttttctgatatatcttattgtgctccctccctccacacaatacaagaattccttatcctgtctccattacagtattccacacacaaccttctttacctggaaatatttacttgcgtgattgactagagcagcagagatgtttctggcatgatataaagaataataggaacaggtagtgatacattttttaaaatagccattgttggccaggcacagtggctcacgcctgtaatcccagcactttgggaggccaaagtgggtggatcacctgaggtcaggagttcgagaccagcccggccaacatggtaaaaccccatctctatttaaaatacaaaaattagctgggtatggtggcaggcgcctgtaatcccagctgctcgagaggctgaggcaggagaattgcttgaacctgggaggcagaggttgcagtgagctgagatcacgccattgcactccagactgggcaatagagccagactctgtctcaaataaagtaaaataaaataaaatggccattgttatttctaactcaacttttatatgagatggtcttagctggatggtttcaggtgaaagagtcagaggggaatggaatgattgcaggtgagaaggtaactctcaagtaaaagctttggttcacttattgctcccattcatgacattcagaaacaagaataatcctaacaatcaatccaccattttgttactgaaccaaccttttacttctgggtctaatatctagtttaaattatttttctcaataaatgaacataaaattgtcttccaatgacaatcaagttgaaattatctctgtgtataaaataattacagattatgaaagaagccagacatatcattttttacctgattcggttgacttctatttttaatttgctaaattaaatgttgtaggaaaaaatgaagagctttgttctaattttgaaattccacagcaaaataattgagtcatgcatataaaatgtccgttaacaagaagacaattgtagtactggttatttttgtttgaaatagaaatatgaaattttaaattcagctatttaaaatgcccgaggctaccatggaatgtacaaggctctcagtgaggagcaacacaaagatttttacaaccaagtgaggtaacttcttggcctaggaatttatgatagagcttttactatgcttttaaaagtattttccctagatataacatcaagttcatatatgtaaagtcgtgaaaactatatagtggtctaattctctgacaaggcaagcttggtattgagatgtcataagttcattcaaggaagccttctgtcaatttccataggattgggaaggtggtgccttgtccatctttgcaggtgttggaaggggagcattattgcatagatctgttccagtttcacagcaacacatagactgtagtgtaaagaaagaaaaagtgataggacttatgtagatatgcactacaagcagttatgaccatgaccagctcttactgtcacttcctgatttaattatcccaacagtcttttgacataaacatcattcaaataaccacagatacgtggcctgaagccagatataacaagaatcagccagtaaagaaataggttgaatttaaccaagtaataagtaactggagttgttactgaacccaaaccaggtgattagaaagttagattcccaggggaattctcattacaagaaccatcttatcagataggtaattggaaaccctgttaaacccaccataacaaaggctcagcaagtgtacatctgcagtgccagtacaatcagtgagtcttcagttcttatgaacgttctgaaatcttttattattaaccattgaccctctaacctcaacttctttgagatgataaatttgtttcctttagtaaataagtaaattcctttttttcctccttcccaggaagtttgagattcatgtataaagatgaagaactaaataatactggctgagccaccctaatttgaaaatccaaaatccgaaatgctctaaaatccaaaactttttcagcactgacatgacgcgagaagaggaaaattccacacacaagtacttaacacaaactttgtttcatgcacaaaattattgaaaatattgcataaaattaccttcaagcttatgtgtataaggtgtatgtggaatgtaagtgaatttagtggtcagacttgggtcctatccccaagatatctcattatgtatgtgcaaatattccaaaatccaaaacacttctggttctaagcatttaggataagggatactcaacctgtagcataaaatcaatattttgggttatgactgggtgcagtgactcacacctgtaatctcagcactttgggaggccaaggtgggaggattgtttgaggccaagagtttagaaccaacctgggcaacatagcaagaccctgtctctactaaataattaattaattaaccaactgtgagtggaggttcttgcctgtagtcctagctactcaggagtctgaagcaggaggatcactagaacccagaagaagttggagattacagtgatctatgattgtaccactggactccagcctgagtgacagagacagagaccctgaacttaaaaatatatatatattacaacttgggactgaaatatttgtttgtatgttaatagttcatagcatttaagataatatgacatattacagaaatttgacagatttgctttgaaatgctaatttgaaacacgtaatttttttttttttttttgagatggagtcttgctctgtcacccaggctggagtgcactggtgtcatctcggctcactgcaacctctacctcctggggttcaagtgattctcctgtctcagcctcctgagtggctgggatcacaggcacccaccaccatgcccagctaatttttgtatctttagtagagatggggtttcaccatgttggccagcctggtcacgaactcctgacctcaagtgatctgcccgccttggcctcccaaagtgctgggattacaggcatgagcgaccacgcccagcctaacatgtaatttcttttagaactgttattttaagttggatctgtaagatagtttaggtttcaaagcaatattgcaatgttcaaaaaaccttaggtttcagcattttcttttttttttttttttttttttttgagacagagtcttgctctgttgccaggctggagtgcggtggcgtgatctcggctcactgcaacctctgcctcctgggttcaagcaattctcctgtctcagcctcccaagtagctgggattacaagtgtgcaccaccatgcccagctagtttttgtatttttagtagagaccgggatttcgccaagttggccaggatggtctcgatctcctgacctcgtgatctgcccaccttggcctcccaaagtgctgggattacaggcgtgagccaccacgcccggcctgggtttcagcatattttttaagtttagtttattagatttataagagctacttaaggacttgggaaggtataacgtgttaggattttaattttatcctgttagcatttgaagtgcttataaagtaaatcaaatgtgttaaattgataaatgcagtttaaagtgttacaggagtaatctgaacagtgattcctcataggggtgaggattgacctgaagagcggctcgagggtactttctagggtgatagaaatgttttatgtcttgattgagctgtcggttatcaaaatccattaaactgtcccttaagatctatgcatttccttgcatgtaaattttaccgcaatttaaaaatatgtgtgtaggaacttaatcagctaatgtatagacagaattgattgtttaatggagttgagtctattcaacttgagttaatcaaacattgattcaaggactcccgagagtgattattcttggtttcataaaatttattagatgtatgaatagaataatgagatcataatttgaacttaaaagcttaagggaaactacatagtgaattgttgacatagatgcagttcttgaacaaaaatcttgatggtctgtaagtctgtgtctattccttctcctagttggttggactcctgggtaaataggacagtcttcctagtatgctgcgtttagcatgcagcacttgactattgatgagtgaatggaacacctctagaggccaactacatcatccttctgtcctccttgtagcactagctcatttgcatagatcagcatgtccgataagctcacaccttgaagggcagaaaggacccttcttgagaagactgtacacagcactgtgtttttatgacagcaaacctcagtagccacaaatccctggaggatcagtaatgctagtgcacacaaggagctccctcccagcctgagggctctgccacccaggtagggctaagaggatggagttgacaaagggaagtcaaaaatgagagagctgtccatcaggagtgttgctgagccctgaatagagatcgatcgaggtgggtctttccttcccccttattataaacctgtacctttccttttattctctaggataccttctctatcttttctggtttgcaaaagaaaaaaatagttagatagtcactttgaatcaggcttgggaaaacacttataaataataattccacacatgtaagatggctaatcaacctaggtctgaaaatgacttaacaggaaaacattttcaatatcagtctctcatgattcccaaacacacacacacactcacaaactcaccacaacttcaaaattagcaaccaaaagacatctaaatgctgtgatctttccttttctcttccagatcagattagctttgctcttcactgtccttttgtcaaagcccctattgtacagctctccagtgtccttcctgcctgcccttctactgccattgtaacttttaccagccccactaccatttcagaagaaaactccaggaaagcaagtaagcatggatagctttaaagatcaatgctgaaggcccactaagaccaggatacaaagggagtcaattagaaaaaggtgggggtcaaggaagaactccccactcccaagttaaactcctcaatttgctgttttgttttagccagactctatggagctcagtcatggctagctctctgcaaatggcccccaaaaggcttttcacaaggggcagtaagatataactggcttcggtatttctgtctccccattcccagataaccaattcaagatgcatgcccactgtaccctgcatgttgttgaaacagaattttaatttcctctgtcttgcaaaaatgttcttttgcctctcttccctggtgccttttctcatcttcctcacccctgggtttcctaactctgtcttgcctactctgatctccaaagaccagtctctccttcatatttggcatgaaaccttcctcagctactcacacagtaattgcctcatttctcaaactctccagagtcacatcatccaatcaaagtactgtgtaatgtgagccacatatgtaattgaaaaattttcaagtaatcacattttttaagtaaaaataatcaggtaaaattaattgtactaatacattttatttgaccccgatatatttaaaatgttatcatgtcaacatgtaatcaatgtaaaaatgattaatgtatgcatttcatattcacagcacatctcaattcagactaaccatatttcaagtgctcaaaaccacaagtggctagtggtggccatattggaccacacagctctagaacttctgtagcccatggtttagcagttaattatgtgtgcacttggcatgttcgctgcttgttctctagtgaagtcattctttctagcaggccaagttctgtttctaccacaggtcctagcatggtgctttgcacattgtgggcactcaacaaatccctaagatttgcttcatagatgatccctgtacattgatagcatcttcctcattcatggaataacaagaatgacctcatctcctctcactttcattccttagctactaacactgttgcaaagatctctggaaaccggaaactttggtcacctatactttaaatggagagagaagtaaaacttgctgctgagaagcaaggactgcatagaaggtttagtttgctggtagaatcaaaataagcactgaatgaagatgtgtgtggttcccagttttataaataggttttgcaagaggagagtgtttgcttctttgtttttggtgcgaaacatttcttcttttagcatgttatctgaaagtattgctgccaaagggatgatttgccagagaaagatggtttctgtccagttccttcatatgtcaggcataacctccaattaatctgaatgaaagagtgggtgcccatgcagacaatgccaacaaatgcccctgtagagaggacacatacagatgccaacctgaaatcagacactggctactgaaacaaaggattgctttaatttttgcagaataaactatttttttcttctgcttttcacgaagtggccctaaagaattcctcttgtttgtggtctcgaaaaaattagaactatgccaatgaggcctgcctttaagggttctattaaacaataagaaggctttgttcttggcaataaaattaaagcaagcagtgtttccattacctggcaggctgccctctcccttcccacaaccctgaccccgatcctgacaaacctcaacagaccattctgtttcccaggtaggaaggttagatggtaacatctgtcaggtttgtttatagaaatatagttgaccttaatgataatgtataaagagggagagatgggggcggaggggggaggaaaaaaagggggtagggagagagagggacacttctccaaataatccttaactcaagctttaaaaaagtcaagtttactgcagaggcttcaagttctcaaaccattgttccagaaagacaataataatttcacaatgagttgaaatgatggaagttaggagtcactagatgaggaaatatacattttggtctgacacgctagatgtcacgtgttttctttttcagggaactttgcctaccattgctcaaacttagacccacttacagtcagttgcaaatgagtgcttgtaggtagattgtgaccctgaagtcaggaatgaccaaggccagtacagaaagcactgtccgatgcaaattctgtttagccccacagttagtcacaagtcattggaactgaaaaattggatgactgtgatgccagctctctctgtcctccatgagagctcaaaatggttatattgtagtctcctctagtgtaagagctcctgcctacagctgtcaaggccatacccatattgcactcacaggtcctatctccctggcctgggaactttttctgcccctcccaggaccaactaattccaaagggaagttaatgcctaccttcccccaacagctttcaaccagctcctgatgggagatgttacataaatactctgcttcttccctattagctggaatgttctgtactgtttcccagagttgcccaatggggttaatctccagttgcccaaggtggtcttggtaagtcacactttactggcttcgtagttgtccctgtttcacttcctacccagtactggtgttttctggcaacaatttgaccatccattcttgtctcatatccttcttggggaggatacaactgccaaccatgtctaaaatgaaatgatagcacaagtctctttttctagtcatggctatagctcacatgttcaatttctctaaactcaagtctctttcattgtgtttgaataaacgtacatgtgaatcactggacatcaaagatatttaaaaatcaatctactcacttctcctgatattctagaatgacaacaacagggcaagatatttcatagatatcacttgtgggtgcgtcatgaaggcagaacaaagcttaacattttccagttgtacctcccagttaagttctatcagtgacgtaatcacgtgtatttcactcactgtacggaataccaaagagcagaaacccaatgttcattttccagaactttgcagaagcagatggcttctatacctgagtaactgaaacccaaaaaggggtccaactcagtatttttccagtacatcacttttcaggaatcatggcacaacaactaaaaggaatgtcacttaatgagaaataacatgtaagattgaaagtgattaaggtaaagtcatagagtagaggtttcctctttccattagaaataacttcccttcccttaaacacgtcacctccatctttcctggcactccattaatggtcatctgctaaaagttattgtttaccctctgaccacaacatcaaatgccaaacacatttgttgaaaattatttaatagaaatcgctacttttcagaaactttatgaaaaagacgtgatagagacaaacacccatggcaggttaagtagatttcttttcattcagtgtgcccagcccaaacggaagggtgtgaagcatttgttttataaagtgtgtaattaataagagaaaggaagggaggagtttattgtttttcaatgaattatgagcaaccccttccattctgcttcttcattttggaactgcttctaacaaagttaccattaaacacaaaaagaaaaggctgtgatattgatgccaagaatataagattgaagtcagttgagtgtagcctaggaaaaacattacagaaggagtaacatttattataattgtgacagaagtcagcaggacatcatggggaaagtgaaaaccataccgcaagtatgttgtcattttcaaattgaaattccattaattcagtacttgtagctattcatgccttaaaagaagaaaactaatatttattgagcatctactatgtaccagattgtttacagatattttcatcaaaagtatgcaaatgaggaaacattctcacagaaattcaaatatttttcatacctgcagtcctctgaatataaagtccatgatttttcctttatgccagaggtcagcaaactgtgacgctcatgctaaatctgactgtttttgtaagtaaagttttatttgaacacagccacgtccatttgcatccgtattgtctatggctgctttcacactacaatagcagagttgagaagctgcagcagagaccgtctggcccacaatgctaaaataattactatctaggcctttacaaaaaaaaaaagtcccccaactcctgctctgtaccacggaagaatgttctctacccttcttcttcccccatccaaaattgcatcaggaggcagccttcaaggaacccagttaggatttaaaagtagcttcaaaaattctggagttaagcctcatgttatagcttccaaagctattattttgatgatgtagatgcatcaaagttttgattcatgctagaaagtcctcaggtaaccagcacaggctgactggtcctagaacctctagttttaattatctatggacattccagataaaaagagtttgttagcaatagtgatcgttcacatttatgtagtaattattacatgccaagcatttgtcaagggcttttcatgttttcactcatttagttctcaccacagtctaacccaggggttctcaatcttgacactagtgggatttggggatggacctttcactgttgtgggggctgtctaatgtgttgtaggatgtttagcagcatcgcacctggtctgccaggtaacaaatgttattttcctcattatgcaggtagggaacttgagatgtagatagttgaagtaaatgcccaataacatacaactagtaagcaataaaaacctggtgtttcaatcccgggaagacttcctcaagtccctgaaccccaaaccactgcctccattagcccttgctccctctaaattattttacctgtttgaagattttgctttactgaaaaactaacagcgacatcaacaacatcgtgaatggccatgttctgtatgctactattggaagtaaaactcctttatgtgaagtttcaaagttttaggcattagcaatggcattttttgctaggcagttttattgccttattacagttgtatttcattcataagaaagaatttaattgctctactcaccacagtgtgttgccatttttgatagtgtcttgcttccttgtccagcactcaagcttcataatcttagaaacctcaagaaaagaggatttatcatgaggttcctcggagctatttttttagtcccatagcaaattcccatctggataatcaatatgtagaattgatctcctctggtccaaataattttccactacgtcactatgctaaagcaggattacatgtagcttctagttgtatcactatatcactgctattacttcccaccaaaagcactttatgaaaggattccatttttaatttttctgaaaagcctttcttggagtttaaaaagatttgatcaaaaatgttaaatattaaattaacacattaaacattaaaaatattgtcccgtactctggtttgtcctccaaagacagagacctcaggagccaggccattctctctctctctcattcacttgagccaggtccacaagtatttgactttggtgtgaaagagtttcagagtgaagattacatataaacatatcagatgaattacggtaatattgtctgctgttcctcaattctccttggctcagttttatatacagactgaagtattagaatccctttcattgttcctctggcagctctgtctaacttttgccccagagtctggaatgttcatcacagctgtctttggcaataaaacccaaagcaccctcatatcatcatatttctttttgcacctggtcagtggtacacagcggggtgtagagcccacttgcatacagttttctccctgtaccctcatccacaggccaaatatcagcttatataaagctctgttttgtttcagttacttcagccttgggcaaattggaattaactcctccaatgtttttcctttggagtgagatgggatggttatgccacattatgtagtaccactaaccccttcgaatttggatgcagactcaaaattacatattcttagttatagagaaaagtccttttgagtctaaacaataacaagaacatcaacctagcatcatgtataaaaatgtttcagcctttctcaagatcaccttaatttgtgaccttggaatggaaggtcacatttattcaccgtggcatgaaacagcttttgtttttgccatgaggccgaatctaggcaaacttgtaaagtagacatttgtcttttaaactcccaactccttggtaatggtttcaaagatggcaaggttcagaatcttaaactaaagggttcacagtttgatggtgcaatttcaagagtgcagtaatggtgggccggggtgagagaggcacaactcaaggggtctaccattcttgcggaattcaaagtgaatagtagcctccggatttgtgcagtgcagcaaccctcttctcaacacccagaaatagaatatcctgtctccaacacgttggggttatcctgtcccaagcttacttcagtgtttccgtctgtgtacgaataagaagtgatatatcaagtcagtgtgtcattttcacaagaggaattataaggctgtattctgaaagtctatggatggctaacttatttcaataaagcactgcaaagtgagaaaatgagagtttctaaaatgcatgctagatcaatttcacctgtgaaaactggccagatattttttttccttcactcatgctccatcctaagagttccaaatatttctaaagattttaagcccacacatgtctgaaatctaatgatgtttatactctgcactgaacatctcattttgcagttgaatacaagtcaaattaaaagagccaggttttagaaataatacttaaaaaccacttacagactgctaaagaacatttcacagacacctagtccaatttctagtatatgtatgtaactaaatccctttaatgtttatacatatatgacaaggaaaaaatatttgtcctctttaccccacccattcctcaaaacactgtaacactattacaccataaaacttagcagggagactttgggcgttgctaaccaagtgccctcgagaaaatagctaatccatttatgtcatcattaactaatctggggaatgattacgcgtaactgcatttctagaaagggaaggtaaaccgtgcacccagtagcaacttacatgggactgcaactgattattggtggcagatatgagcattaatgaagccgagtgaccctcaatgctgaattccatctcaggactaggcaggccagatatgattgttgtgcttctacattcacatcattattcaattttgtaatatctctttcatcagactgtaaaggatcagaaagtcattggcagagagaagcagcagtattaccctaggaataggagaaagtgggtcagcaactccctacaggcaagactgatggggagaagatgcatttcaagacgcgaaagaaaactgactctagatgtagagaaggtatgtgctgagcagatgggtgaggtcaaaaatgagatgaggtgaaagtgactgagtttctcatactggtgggctaatgtgatatttgctcatgagtgtacttgaggtgagaaaaaaccatagtattgaggagcctagcctgagatctcggctcactgtaacctccgactcctgggttcaagcgattctcctgcctctgcctcccgattagctgggattataggcatgcgccaccacacccagctaatttctgtatttttagtagagacagggtttcatcatgttggccaggatggtttcaatctcctgacctcgtgacccgcctgcctcggcctcccaaagtgctgggattacaggcgtgagccaccgcgcccggccaggaaggcctaattttaagctgtatttcatcctgagaagtcaagtgccccatttccagtgtggtccaaaggcaggagacagtaattacccaccactggacatcattcctaattatcttcatctcactcttgccgttagtttaggggccaaggaggagactgatggcacaaaagtggaaagaagagtttgaacttgttttctgcatccttagattggccctcctcagagcacttccatcagccacaatgatttctgaatcaaaagatgtgaatcagaaatgaaagcaaaaatcataaccaggagctgctagcttccaaaccaaacctgggaactagaaacaccagaacataactgcaagtaaccaataaaccctgccatatttgaactaatagaaattaatgagaaagtccaatcaaatcgttaattctttgtttaagtgacacatgaaacagcaaaactgtggaaaacttctttgtagtagaaaaaattctgaaatatagaatagtatttaacttgttttattgtatcttttggaatataagaatactagagttacaagaatttggaaattcatcaaagtagaaaacaagattcaacttccctggtttcaaaaggaaagctaaatctgtattctctgaaagatctaggaaaaatacttggcctaaaatgaatagatcctgttcccaaatttctaggaatttacatattggggtgatggtgattgtgataccagttttctcaaaacacatttgcctcaacaaggaagatttcagcccacttttttggtaaagcaaacatatccattctgtaaatcaaatagtcaaaatttggattaaattgagccccatattacaatggcaactgggatactttttctaccatgcagtaactcaactcccaatgattgtgagagtgaatggaccctaaactaaatcataatctgtttacaaaatcccttctcaatgcagacaacagtacctcagatttgtcaatggcttcataagtttaggtgtttcttcatatattatttcatgtattcaccacaataattccacacggctaagagagcagatattattcagctcattttacaaaataggaaaactcataaatggagatagcctaagattttcctaatgtcaccatgtgggtatattacacaccacatttcatttcacagcccgtactctagaattagcagtgggttctcactggacttagtcaaagccagaagagcttgaagtgtggaatatgttagtgacaacattaaaacttgaggacctcacaatgtggtcaattgatttttgacaaaggttctcagacacttcagtgaaagaaagaatagtctttcaaaaaattgtgctgagacaactggctatccatataaagttagaagcctaccctcacaccatacacaaaactgacctcaaaatggctcatagacctaaatataaaatataaaacttatagaggaaaacagaacagtaagtctccatgaccttgggataggcaatggtttcttaggtacgacaacaaaagcacaagtaacaatagaaaagtagataaattaacttcattaaaatttaaaaatgttttgtgctttaaagggtatcataaagaaaatgcaaagataacccacaaaacaggaggcaatatttgcaaatcacatatttgataagggacttgtattctgaatatgtaaagaaataatacattctattaattaaaagacaatgacccaattacaaaaggagcaaaagatccgaatagtcatatctccaacatagatacacagatgtccagtaagttcacgaaaaagatggtcaacatcattagccatcaggaaaatgtaagtcaaaaccacaatgaaataccacttcacacccactaaaaataaaataaaattaaaaagacatacgataacaagcattaacaaggatgtggagaaattggaaccctcatgtatttctgatgggaatataaaataatgcagccactttgaacaatagcttggcagttccttaaaacattaaacacagttatgtgacccagcaattccacccctatatcaaagaaaaatgaatatatatgggcacacaaaaacttgtacatgaatgttcatatcaatattatttatagtgaacaaaaactagaaacatcagtgtgcatctattaaagaagagataaaaagtggcctgttcatacaatgaaatattatttggcatagaaaggaatgaagtactgataaatgctaccacacagatgaaccttgaaaacattatgctaagtgaaagaagccaaacaaaagattatgtattatttgattccatttatatgaaacgtccagaacaggcaaatccataaagagacagaaagtagactagtggttgcctcgggctggagctagggcaggtagggaaaatgtggagtgactgcacacattatgggtttcttttctgggcactgaaaatgttctaggcttagattgtgatgacgattgcacatgaaatcatctgtgaatacacgaaaacccacaaaactgcacattttaaatggacaaattttatgatatgtgaaatatattccaataaggcagttttaaaaaatcaattcctggccaggtgcagtggcacactcttgtaatcccagcagttttaagaggccaaggtaggaggaccacttgagcccgggagtttgagactagcctgggcaacatagcaagacctcgtctctacaaaaaaatacattttaaaaaaatttagccgggagtcatggcatatgcctgtagtcccagctactcaggagactgaagggggaggattgcttgagcctgagaggtcgaggatgcagtgagccgttatggcaccagtgcactccagcctgagtgatagagcaagagcaagaccctgtctcaaaaaaaatcaactcccttcctccctccccctcaaataaaacaatccttaggtcataattttgtgtctacacagtccttggaaaccaatccattacctgcatgttgagtgattactagtgataactacttgctccattacatttttgccctgtctcttcttggaaggtcattttccctatttatttattcaacaaatattttttgaatgcctattttgtgccagacatggcaccaggtgcttggaatagataccttatttaatacaacagctgaagatccctgcccatatggagcttacattctatcagatttaactcgtattctcaagtacaacttagctcttcgggtttattctagtagatacttttcaagtgtggggtctgtcaaagaaaaactagagctggacagtagttaaagctgtaaaaacattttattcaggactattgtaataaggggaaagagacctcagtatagaatgggactcaactcccaatgtcacgtggaccagtggggatttacagccaaggagcagggtgatgataagtggatggaaaattactaagaggaaacatcaggggtaagggagattctggttaaactgacctaaaaggattcttgctgaaggtaggccaagttgatcagacatcctctggggcatggtgaaggatgaagaacccaatcagatactgagagtgatcagatatggagatggaggattctggctaaaccaactcagcagggttcttgctaaaactggtttacaagaaagtgcgcagaagggcccaggagaaagttcaacactaaagtttggtcgagcaaagaagcttcgtcagtgctactttctagaaattttacttcctccatcataatgtgctcatgttatcaatatggtcccatccttttcataactcagttgtagtcagttattaaattcagtttgaggtcaaaaggaaacagaagaaatttactgagtgtaagtttcaagtaaatatgtcaatagctaaatttatttgagaaacctcaaggggagctagaaatgatgacataaaaataacaataagagaaatgaagcctaatgattatcctccttgaaatattagcctgagttccacatttgtacttctcagtcaatgcatttttaatttttctctttgttcattaaacaaatacttagcaaataactctgtctgctaaactgatgtaggacataatctcatggtttactgcaaatggccaatgactatcatcttctcaataagatgtcttgagtagtctctatgttatgtctgaacaatgatcaggaataaaattcaaggaatcctgggcctctggaaacaggacatggtttctgtgaacagccatcagtggatttttatcttgaactcatgaccctacttccagtttatctcattcatagagaatgaaattactccaattaaagccttccaaatcaaaaaggctagggactgggccatgtctcctccctgagatatgctagaataatcaatgccattgtcattctttgtaacattgcaacttctcctgtggctgtgttaaaataataaacctcatgcctgctatctccatctctcacagctgtggtttctgggtttctgtttgtgaataagcatttcagaattgccatgagatggaggaaatagcatgtgcagagtatttcccaggcctagttgccaagaatgagctaattgtaagcctcccttgaatgcaagtcacaaaaacttcaaatacaagccactctaatgatccacctttccacatgaatgttatgctttcgttgtagaaccttgatctttcagaagtatactaggagtataattttaaattatgtcataagattaataaactattgaaccatctttttgtgctttttatgttttatagtgattagatacaaaattgatgtttgtatttaagagaaatgtcaaatgtgatacaggcttgctacattgcttacggaaaatttgtctaaaagagattgatagtaatctgtcctccataaaagaataatattgattttttttaacttactttttttatgtttaacagggcaaatttgatactttttaaaaatataaaagtaggaattgcaaatatatttcacatgacacatcattttccaactaattggtaatggctatgtacatgttatgttaaagattctgcagctgagtctggcttagtagaaaagactgctgtcattggataataatgttttccaaggatgcaaattaggaagtggccatgtaagtcctatatttgcaatccttgcgtaatcggacaaagagttaacatttaaaatatcttttcagagattactagaaacatcctagtatacattaaaaatagcacttaactgaaaaacaaaggccaaattaacacttaccattgtacttatcctgtaggtcaatgcatcacgtcaagaagccaaattgacagaggagtgtgatcttctcattgagatcattcagcaaagacgacagattattggaaccaagatcaaagaagggaaggtatgatttctagggcagaagatttcatattctctacctggagaaaataaatcctaatacactccagggactttggaaatgttgagaaccctctttttctatacattctataattccctcttaagtctttaagacttagttaaaaggcctttgcttggcagttttttctccatccttttctttgtactatggtctcctgtgaagacctgtgatacaagggctgctccattgcccagcgccaggaggtagcataaaggtcttgtctatcatggccattgttttctatctcacttgtctatgagaaggtgggttctgtggaggcagagtttattttgtattcattgtgatatcctagaaactagcatagcattacataaattaaaaatgaatctgactttatttatagaaattatgaagtactttcccatgtttttgaggaaatgtatacaggtataacttcatggtcccaaaacccctggggtttcactatatcatatactcctttgtggatatagtaataatacttcttttctaatgttctaatgtttctatgttttaatttcctattgttttacagcaaactatatttttaagataaattgacatacattctttatagctgctttcttatttattcaaaattcattcacaaactgttggtcactttataatccatcagtttattctattttaaaattagtcatgtttttattgaaatacttatgatccttttaattttacccaattctctgccacattcagggataatttttctttcttttttcttcttctttttttttttttttttttttgagacagtctttatctgtcacccaggctggagtgcagtggcacgatcatggctcactgcaactgccgcctcccgggctcagacaatcctcctgccttagcctcctgagtagctgggactacaggcatgggccaccacacctggctaatttttatattttttgtagagacagggtttcaccatgttgtctaggctggtctcgaagtcctgggctcaagcaagtcacctgcctctgcctctgcctcctaaaatgctgggatgacaggcacgagctactatgcctggccaaggataatttttctatggatttttaaaaatagaagcgtttatttatgatccaataaattcatccatttctattattattgttcatagttgtactttaaaacaaaatatatataattaaaacatactagcaagttttaagtgaaacacagagataaccgtggctaatgtatgtggttttctgtgttttccacaaaatttaacaggtaccttctaatattgtacaatgttttagattactctgtctatatagattacaaaatatttatacacataaattattaaaatgatctaaaaaatagtgaaatcaaatagttattgatgctggtatagtagattaacagattaacatgaaattattccctggccaaggactcacatgtgccgaaaagctacttttccccacatacgaattgtccaatttagaagagcactgagtgtccatctggaatccttacaggatatatttcatcttccatcatcatcgtgcatcataggtgcacatctcttaattctggaagtattccaggttctcagacacatggccacctgaagtacagtcacaattaattattcatatgcatacagaaggtaatttgctatctttacatggttgcatgcagagattagctctcagtacacatattagtttattttcatttttaattttaaattgacaaacatttatatttatggagtgcaaagtgatgttataatttatggatgaaatatggaataactaaatcaagctaattaacatatccatcatctcaaagccttttcttgtggtgagaacatttgaaatttacttgcttagtgattttgaactgtataatacgttattatttatttgctgttttcaccatgccatgcaatagatctcaaagtaaaaaataaataaataaataatttttttgaaaaagcacttcctcttcctctctaattgaggttttgcaccttactcttactagtttcttattgctgcaataacaaattaccttaaacttggtggcttgagacaacatagatttattatctcagtgtgctgaaattcggaaatccaaaaatcgatctcactgggttaaacaaaatcgacagtcaaggttttggcagtgctgtttctttctggaagctttaggggaaaatccattttttcttgccttttctagctcttacaggtagcctgcattctttggctcatggtctctttgcatcaatctgacctctcttcccatcctcacgtcttctctgacacaggccttcctgcctttctcttataacgacccttgtgactacattgggattacctggataattcagggtaacatccccatctcgtgatccttaatcatgtctgtaaagtcccttttgccatgtgagtaacatattcaaagattcctgagattaggatgtgggcagcattgagagcccttattcagcctgcaagggcactccaccacaacttcctggctagcttgccttcccttctcttacttagcttggacttcccaccaccagggtttctctcatgagctagatcagagtagtgcaggtgtccccaagttccagccatagtgatgcatggagtttatgcttcggtgcactcgttctaccccaaatacatgtcagtaataaagaacttaataaaatgcaaaagcaaagacatatagctgaaccaaaaacaagataaacatctccacaggccagaaatgagacaaaactgaaaagccatgactgtggctgaggatacaggctactgggatttggtctggaagaggccaaagtagctttggctttagctcctgtggataaatagttcttgaagctttggggaaaggacctagaagtgctccagatgggatggggaatggaaatcaggctcattatttaatgccatgggctatagaaggcttcatgcttcagtcaaaaattattgccaacctttccctcatatcatagcttttagcaaagtcacattgttagcttgaagcctgtgttcacactgtttctgatacccacacagaacaggagcacagagataaggatgggattcctgaataatgacctcaagggccaggtgaaggcaactggaaaactatcagagcagggtaggctgagcaaggagggtgagagaggaaagaattataaattacttccctttaaaactgaaactctaagtttaatttcaaagtatataaagaaatcttaaatttctaaacatacagccagcaaaatcagcagacaacattatcttaccccagataaaattaattttataggaaaataagaaaaagactttaaaagaagtagtcttaagatgttcaaagaaagaaatgaaggaataacttctctttcaaaagagcaaaaaaagtgaagccacaaaagaaggaaatgaaataaaaaaatagataggaaagcaacaaattagcagttttggagggaaaaatatagatattgaaattagaaagaaaactcagctgcagtggaaatttggaaactgagttttggtcaccaccttgggaatgccataaaacgcattcttttacgtctgagtgacattaaagtttgacaaatgccgactgagtttgaactcaaaagataggaaagtatataggaaaacctacacatggggcatttttaaaataataatcatgcacttggttgaaagcaagtatttcagcaaatttcaaaaactgaataccatagaaccctgcctctaagaccacacactgtatctcattagatattatcaacaataaaataatagtttctatagttttttgacactaaaatctattcatatataaatatatcttcacagtaatattttttaaatgtagaagtaaaccacagtaaaagaactataatatatcataagtagtaagcagcaaaaaagtatctgaaggcaaacttacaggctttaattcttttgaaaaagaggctgggcatggtagctcacacctgtagtcccaacgctttgggaggccgaggcaggaggattgcttgagtccaggagttcaagaccagcctgggcaacacggcaagaccctgtccccccacccccaaaaaaggtaatactaaaagtaaaaaattagctttcaaataaagctagaaaaagcacaacaggataaacccagtgaaagcagaggaaagaaataaaggaagaaaagtaaatgaaagaaaaacaggaaacaaacaagaacagctgtcagcaaagaacaactcgcagcctaattttgaaacatctgtgaataaaaaaagtgccttttcccccatttttaaaaggttgttaaaaaaaataaagaaaaacaatatatgtgtgacagagacagtatgtggtcttcaaagcctaaaatattgactatctggtcctctacaggaaaagtttgccagcccttaatcaggaggagttttacttgtaaaaaataatttaaaagaccaatctgtagttaaggttgatgaaggaaaaaagagtgtggggccccataaacaaatataccataaatacagtagagacttttttaaacataagaaaattgtgtaaatgtcttcatgccaataatttgaaaacttacataaagaagtagcggaaaacctgaataaaccaaaaatttaaaagcagaagacatttaataagtcattgaaaatgtccatcaacttgcatttctgccccaaaatggcaccagcctcccacagttctatagcttactttaacagaagttccaggaactaataatctcattctcatataaactacttcagaaaatagaaaaaagacattttatgtagagtgtatgatcttgataccaaatacatacaacattaaaaaatctagagtgagagaatatcacccatgaatatagacacaaaaattttttttaatatgagaaaatgtaatccatcagtgttttattaaacacatcaaaatagcctttattcttataatacaaggatggctcaactacagaatatctgttaacagaaccacattaacagaaaacatacatatgatcccagagtaggagggatttttctttttagaccaaacaattttaaaaaaacaaccataaagcaaagactgaaacatctgacatagaataagatcacaatacaaaagccaatttcatttcaatatattagtaacaattgaaaattgaaatttaaaaaaagaaattccatttaaaacagcctcacaaatatgaaatacttagtgataaatctaacaaaagatgggtgagacttgaaagaccttgaaaactacaaaatattgctgagagaaattaaagacgactaaaaaatgaagccatgtatcatgttatggggtaaagactcagaaaagttatgatttctgttctttccacatcaacctgtagattcaacataatctcaatgaaaattccagcaggttattttgcagaaattgacaagccgattctaaagttcatattagaatgcaaaggatatagcataatcatttaaaactttgaaaaatagaccgggtgcggtggctcacacctataatcccagcactttgggaagccgaggcgggcggatcacgaggtcaggagatcgagaccatcctggctaacacggtgaaaccccgtctctactaaaaatacaaaaaataagccagacatggtggcaggagcctgtagtcccagctactcaggaggctgaggcaggagaatggcgtgaatccgggaggcggagtttgcagtgagccgagattgcgccactgcactccggcccgggcgacagagagagactctgtctcaaaaaaaaaaaaaaaaactttgaaaataataacaaagttggagaactaacatcagctgatttcaagatttattataaggcttcagaaatcaatataaggtggtatttgtataaagatagacaaatagatcaaaggatcagcaaaaagacttgagaagtagattcatacatatatggacaagtgattttcaacaaagatgcaaaggcaatttcagtggagaaaggattgtctttttagtaactggtgctggagcaattggatatctgtatgtaagaatatgaagtttgatccatacttcacattatatacaagactttactcaaaattgattatatatctaaatgtaaaaggtaaaagctgtaaaactcctagaagaaaacgtggaggagatcttgaccttgggttaggcaaagattctttacatacagatgacaaaagcattatccataaaagaaaatatttatatgttgggtttcatcaaaattaaaaacctcttcagaatgcactgttaagagactgaaaagaccaaccacaaactaggcgaaaatatttacaaattatttattttaataaaggattgtatccagaatatataacaaattctcaaaactcattaataagaaaacaagcctttcaccaaaatgcataaaagatttgaaaactttaccaaagaagaggtgtggatgatgtattacttagggttctctagagcgacagaactaataggatatatatatatagagagagaggagtttattaagtattaacttacacaatcacaaagtcccacaataggccgtctgcaagctagcagggagagccagtccgactctcaaaactgaagaacttggagtccgatgttcgagggcaggaagcatccagcatgggagaaagatgtagacggggaggctaagccagtcttgccttttcatgtttttctgcctgcttatattcgctggcagctgattagatggtgcccacccaattaagggtgggtctgccttccccagcccactgactcaagtgttaatgtcctttggcaacaccctcacagacacacccaggatcaatacttgcatccttcaatccaatcaagttggcactcagtattaaccatcacagatggtaaataagcacgtgaaaagatggttcagtatcattagtcattaatgaaatgcaaaataaatttcaatgagatactgcttcctacctactagaataattaaaattcaaaagatggcgcataccaagtgttggcaaaaatgtgaaggaaccagagcctctcacaaactgctggaggtgggaattaaagtagtacatgctggaaagctggcagtttcttaagtaagcatacacttaccatatgatccagccatttaggtatttaccaagagaaaggaaagctatgtccatacaaaacttgtaggtgagactggtcacggtggctcacacctgtaatcccagcactttgggaggccgaggcaggtggattgctttgagctcaggagtttgagaccagcctaggcaacatggtgaaaccctgtctctacaaaaaacacaaaaattagccaggtgttggtggctcactcctgtaatcccagctacacaggaggctgaggctggagaatcgcttgagcccaagaagcagaggttgcagtgagctgaaatgatgccactacactccagcccgggtgatagagtgagaccctatccaaaaaaaaaaaaaaaaaagacttgtaggtgaaatttcatgttaattttacttgtaatagccccaaactagaaatggcccaaagtccatcaacagatgaatgggtaaacaatttgtgtcataatcacacaatgaaatactctttggcaataaaaaggaataaactagttacactagttataatgcaacaacatggatggatctcagtataattaaggtgcgtgaaaggagtcagacagaaagtagtatattctgtatgagtagattcatatgaaattcgagaaacggcactttctactaatctacagtgacaaaaagcaaatcaatgattgcttttagggatgggatgacaggaaaggatgggcacagttaattacaaaggggcaggagtaaattgtggggcatgatatatatgtttattatcttgactgtggtgactgtttcatgggtgcatacatatttgaaaaagtgtcaaatttgcactttaagtatgtactgtttatgatatgtaaattctatctcaattcagctgtttattagacatataaattgtgtattatataatgaaaaagtcttcagaaattaaaattaatgaactagggtgatatgtattagcacggacaaatcacaaaaacagaagaaagttatataattatttgtacaagcattatataaaatttaataaactaccaaaaaatcccatacattgtttaggtatgtgtacataaacatgtttgggagtgatcagctctaaatttgagagggtcttttcttctggagagagacatgagtgagattataaagtgccacacagaggctttaatgctatcaataatattttaccaccaggtgtggtggctcatgcctataatcccagcactttgggaggccaaggcgagaggatcacttgagcccaggagtttgagaccagcctgggcaacatagtggttccccatcactacaaaaaataaaaataaaaataaaaattagccgggtgtagtggcatgtgcctgtgatctcagctagtcaggtggctgaggcaggaggattgcttgagcctggaaggtcaaagctgcagtgatccgtaatcatgctactacactccagcctgggtgacagagcaagaccctgtctcaaaaaaaaatcttttttacttccttttgaaaactctgaagctcatatgatgaaaatactgagatttagtaaacctggtactatgtacaggacagttcattatattcttaaattttttgtatgtatggaatgcttcactttttaaaaagtatacatttgctcagcaacattatctcagaaggcaatcttagaaagcagatgttacttgggaaagatgagggccgcactccttttctcttgagctagtactttggcacatgaccaaggactagttcattccaaaccctgaaactcacagtgactcaagtccctagccagggcatattgtgtcagaggcctgtttttaagaggaagggtgtgaatgccaacccgtggaaatctgaggtgccagacagggagggcaagtgtggacttggggttcactgggggacttgggtccctgcaccccaggatggcagtggcaactgagggcattgagtctaaagaacggatggtggggccttctgacaagcaattggaagtgggcaggtggagcaagaaccaggcagaattgtggagatcacaaaagtgagtttcatcaactgccttattttgcccctgtctatctctgacactagtcactcagctgtcaaactcacctcaaattctgcaattgacgaggtcaccaagcaggtgatattattacacgttagtacctactgatgattcctgctcttggaccattgtacattctctgaaacaaattaactcgacagcctttataggtgggcggactggagagtcttaagccatgaggctccctggaaaagaattttcttctttttttcagtagtcggggataagtttcatgtcaacacacaaagagctaaattcagattgagttcattcatttaatgttcagacacagagatctatggtagacttctgaaggccaaagctcaacaaaataagggtcccttttcttcactgccttttatgtacactaaatcttaaaagtttaagaaaattaacttggactaaatgttgagctctccatggccttaaagagatggtgagaacaggcctcattttcagttcagatacttgtgtgaattgaggatgcattgtttggacctaattgttttgggttgtgtatcctacatacatataaaaagatttatataaaaataagtgtttaaaacgcatttcaagcaaaataaagcggcttttaaaagaatgtgtaaggtataataaacagcaaataaaatgatataaacagccctgtgtccctgctaaaaggagattccagcaggcaaactatttccatgactagtagagagtaaattccaaaagttgcaatgtggtaatctcacttcccaaaggaaaaatgaagagttgactggaaaatatttcccttgcagcattaaggcagacacatacagaatctttttatgtgtcagtatctaatttttttaaacatcaaattttattcaccttgtcaacttttaaaaataatacattaaaaagtgttgtctaatagaaaactaagtacttcgctccatgctgggtgtctgagtttgaagtgctgtgacaagtaggacagtgtttcagagtgtgctgcaaatcagggccatctgactgtaatcatttaagccaggggttagccgacttttctgtcaagggccagataacaaatattttaggctttgccatacggtctctgttgcagcaactcacttctgcacaacattgtagcaagaaagcagccatagattatgtgtaaccaatgagtgtggtagtatgccaataaagctttatttacacaaacaggctgtatgctgatttggcccacagatcacagcctaggaacacctaacttagagcagtgtttttcttttttctttttttttttactgtaacccgcagtaagaaatatatatgacatcacaatacagcgtgcacgcatgcacacacacaaaaggttttacaaaacccaacttgccttttctaccaggaatgcactctgctatttgcttttctcctcttctatttggttttttaaaggctagtcctgactgtcctaatgattcatcacctgcaggcttaaaaacatttgttgcttgttgaaatggaaattcctcctgctctgcgaattacaactccttaactcaaatattggagcgtagacccaaacatctactgtttttctttcaaaatgatgcccagctgattcttttacactaggtttgcaaagctcaaatcagatgtatcagatgaaattgtacactaacctataactaaaattatgcccaaaattgttctctgtagaacattccgatattttcacaggcgactctcattttgtcttgctttaatttttgcatgatttagggctcttttattctttttcctgttatgtcacttttaatgttcaatatcatgatagaaaaagaaaagaagaaactggagttcaagcatcatcgcatttgaaatgtgtgtggtctttaataggcatatctaaaggataagtagttgtcatgaagttattctaaaggaatattttgaccttattttcttttgctggaattgtattaaacatctgcaattcggccatgtaatttaaatgattctttatgctgtgtgattaaatattccattcacttggtttgtcctgtggactgtaaattagttttccttctggaattttccttcctctgacagtttcttatgaacatgttctaatatcctgcgcgtactggatgccttccttagctttgcctccagatagaatgatgccagaggctaaattctatttggtgtaaaataagtgttattttattccactaatgaatacaattaatccactggggacagtaactataattataatgcattaagtcttttaccaggctcacgatcctatattatttgccctaaagttttgacacttcattctctgactctttcaggaatttttttcacccttgcctgaaatcttgtgcctgctgcttctaattcagtatgaatttcctttgtttgcttatagtacatacttggaattggatgttccttagaggcctcaagttctgacatctctttccttccttttcttagattagagttatacagggatggtaatgacgacttggagaaagaaagaatttcttggaattagcaggaattctggagagagccttgggccagccttgtctgtaagacagattgactggtctcctccgtaccctttcacccagggctattttccattccagaattatcataaagccggttgaaacctgtccctgggtgtgtggttgggggcagtaggcacacagcaattccaattagctgtctaattttaacttggcttctggctagaggacttcatctcacagcacatttcaaacacaagagcgaacggtcaagtgggttaccttggacttatcttggcctgccccggaggttatggtcaattatgtttgagggacattttcaagcgagacagaatcaggaattggaatggaggttgtgaagcaatcatgcgtttttatcccaactgggaaatgcttatcaaaatagttcctagttatcaagtaagcacaaagtgcctggaaatgacgttcccagtgaggggaaatggcccagctgtgctttttttggctttctctcatctgctcaacaggaaaaatattaatcaatgggaaaaatgctccctttctgttaatttaacacatgagttttaggtagtgtgggaaatagtaacacttaatgctttccattctcgattttattacatgaattacaaaaaacactttttagaaaatggttttcatttaaaccatagattcaccacctataaagatgttttatcttcttgatgaaaagaagataaacctgagatagagaaagttccagggttccctacagtcttgcagtcattgtgtggaatagtccagggaagacgtctggtgaccctttgtaagttgccactgggcaacacctttttttcccatcaacagggaagcaattcacaattcagtgtttcctcgtaaaacgaattagcaatgcttctccaatgagataaggaatatctaaaccagagtcccataacggagctttccatattttgatatatctctatgcctactttttgaacttttatggaaggataacacaacaaaatgaaggatccagcctgatgccttttcattaagcaagaccacccatgtaaccatctctctccatgcctcttttgttcaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagaggtgagtgcaggggcccctgggaatttctcggctgctgggctcttgtatctgcgctgtgattggttggtcttgccctcgccttgcttttattttcattttcaaggctcagtaccagagagaatagaggctttgagctgttttgttccagctaaagatgcttccttttgacatgtgaaagccctttcagtaacagcctggagtctggagttcaaggcctttgaaacaagagtccaccagttagaaagaataaaatcaacctgcttttggacgaggggggagcttatgatggcacaaaaacagcatttattgtgactctcagatgtgatgttatcgtacacttgataacaaagagtcaaaatgaaggcaaaaacattaaagggaatattttcttccatcacagggctcatctatttttttttaaaatcacacaggtgttgttctctgttaggcccattttcatttggttgaggagcttggcctcacctgaaaaggtcaaggccaactcacgcaggagagaaaggaccaaactgtcaacctcatacgggcttcttttaaaatactctttattctcaggtagggagctttaatgtgatgttatctgaatggttggctcagcagtaaaactggcaaagataagtattttttcggcacacatacttggttggtataaaaattgctcatcttcactgacacaaacacctatagcaattctagtggatccaaagaaaagcactagccgggcacggtggctcacgcctgtaatcccagcactttgggaggccaaggcgggtggatcacctgaggtcaggagttcgagaccagcctgactaacatggtgaaacctggtccctgctaaaaaaaaaaatacaaaaattagctaggcgtggtggcaggcgcctgtaatcccagctacttgggaggctgaggcaggagaattgcttgaacctgggaggcggaggttgcagtgagccgagatcgtgccactgcacttcagcctgggcaacagagcgagactctttctccaaaaaaaataaataaatgaaaaaacaaagagaagcactaggctgggccaggtacagccaatgccacataaatgacatctctaactcaggctaatggccttgacttcattcattctaattttcagagtcaactgccctttatccaaagcaataatagaatcctatctctagaagaccccagagagctcatgcatgctgatcttcatcctagagcagagatcagcagactttttctataaaggatcatcaagtaaatatttttccgctttgcaggttgtaaggtcttggtcacagctactcaactctgccattgtagctagctctaaagcggccatagataatatagaaacaaatgggtgtggctgtgtgccaataaaaccattacaaaaacaggcagtagaccatactttgccaacccctggcctaggaaaaaaaatactcgccatcttatgactcaaatttattcaaagaaagagaaaggaaactaacatttattgagtgcttgcttgtttcggaaacttgtgctaattctcaaaatatcgcatagaggaggagtgattgacatctccattttcactcttcttaaagagtaatgtatcgtgtttttacaactctggtctactgtccaatcggcttgactgtattatttcttatatttgaggaaaattccttttgtagctgattagatacttatctcttctaaaaggcatggataacagctggctatcatccctgttatgtacttaagatgctctcctccttactctgagaggcccatttctttcctcctgattccttggttccaaatgtttattttccctgggccatatccagttgctcaatattcaccctaaagttaaaaactgcaaatagcactaatactccagtgtacctaggacactaatagatagcgtttacacttaggtcacggtttccaaccggaatccaggagtacttttctccatctatgaactttgagatgtccagatgaaatggctattatgaactgcattcctcatcaatccctgaagattcaaccaagtgtcacatgaataaattcttacctagtgaccagggatgatgtgaccccataacagttattgctgaaagaagatatgcatctgaagtatagcacaggtgtgggaatgcccacatacaatctccctcagttccagtgggacgtatctgctcccattcagctctctctataacaagcccaactcatcaagagcaggaacatgactttgatttctctttctacaaagaatgtgcttctgtcaagtttgaattcacagagcctgtaaaaatttgccaagagccttgtctctgtttctgcagtcccctctcctcccatcactatttgtcaatcctcttggctaattcctgagcctttctatccttccagcagctaggatatagaaaaaggacactgggcttagactagaagttggcagacctgggttccagtcctagcactgccactttttaactatgggtctttgagctattttctacttagaaaattgggttcaggaacagtttggaggttcctcaaaaatccaaaaattaagctatcatataatccagcaatcctactgctaggtacatacccaaaagaaacgaaatcagtatatagaagagatatcctcactcctgtgtttgctgcagcacttttacaatagctaagatttggaagcaacctaagtgtccatcaacagatgaatgaataaagaaaatgtggtacatatatacaatggagtactagtcaaccataaaaaaggatgagatctagttatttgcaacaacatggatggaactgcagatcattaagtgaactaagccaggcacagaaagacaaacattgcatgctgtcacttatttgtggaatctaaaaatcaaaacgattgaactcacggacatagagagtagaaggatggttaccagaggctgggaagtatagtagggagttgtgggagtgggggtgggtagggatggttaatgggaaaaaagaaagaatgaataagacctactatttggtagcacaatagggtgactatagtcaataataacttaatcgtatgtttaaaaaaaaacttaaaaatgtaactggattgtttgtaacccaaaggataaatgcttgaggggattgataacttattctctgtgatgtgcttatttcacattgcatgcctgtatcaaaatatctcatgtactccataaatataaacacctactatatacccacaaaagaattgtttttactaataaaaaaattatttaaaaaaattggtttcagaatagctgtcactgttgtgatgacattgctttaagttcctaagaacaggtcattagcattatagctactccatgagtgttagttggatctctgttttcacgtttcaacatgtcagtctagcccgccttgtgtgtcttttttccaatgctactctctgtctacctgcccctattcatcaacctgtcacttaacattcttctctaggacatgacttcttttttctgtctcctattgtgcctgccttgggctttggctcctgtatacttccaaacaatctttattcttcaattcaggtgtggagcccagaacaaacttttaatcccgcaggcattcttgaagtgagacttagatgagattttctgcatcgttaagcgacttaaagtggatatgtcctcctacaagctgaatcaaaactgtaaatttttctttcatttcagaaacatcaaacaactccaaaaggggagagagcctcaagctttacattgtaggagatgcttttgctttggaaccggttgtttggctctgtgctaattgcttagtaattatagatagcattgaggctgctcattaacattggctaattttgctcatatactccaagtaggcaggtaccctagccaccttgtttttaccattatagccccagcacattgcgagctgcctgacatgagtgaatgagtgaatgaatgaatggatccataaatctgtaagacgggactaattattcctacctaagatggttattgtggggataaaatgcaataatgtagtaaaaacattagcctagtttctgtcacaagatgaacatgcaacaaatactagttctcttccttcccactcactagatgaatgcaaatgtataatgtactatattctcaagctacactagtagataggtctttggtgtgattgtatatgcacctttatagcattattttaaataagcaaagctattcactaagtccaggcataagaaagttggtctgcttatgaagaatctagaattaaaatcccttatagcagtaacttatctgtatcaagaaggtgataaaaagaaacttccctctgaatagtacctattgttcaaagcacctaggaggttctcagactcctcaaggtgatccttctgttcctcactacaataggcagttcaaggatcttttccagaatacaaagccaagaactccagttgtcaattctgaaaagatgttgcttggttcaaagaattagagcatatctgatcagtggttttggaagtgtgtctgcagggtgttcataggcattaagataactgcacgttttcaaggccaaatgtgtttgggaattcctgggctgaccaaagtaaacctatcttgttactgtgaggcctcactgggttttactttggtgatgcacattgtttggcagaagccttgtgagcagcatagctccagacacgtccaccttctggaaaactggccccatgtgtcccagacatggctgtaaagcaagaagttgagaaagtggcatagcgctaacagccctagtggatttggcaacttatccaaaaggccagaagatgggcaataaggatttgggaaataaaaacatggcctaaaatgttgaatttggcagatttccccttgcctgtcactccaattaggaatttgaagttgtagccaaagataagtatctttccttccatcaaaaaacaaatgtgtaggtgttaaaagctgcagtaatctccactgattcttgctgtcagcctttacctcccaggctaggaactttgatccttttggttcccatgtaacaaagttcctaccatcaagatggtagacattattaacagtgtcactcaatttaaaatgttttatttaattgtttgtagaccatggaaccaggagaaacttgggaacaaaatctattttggatgagactgaataaagaggtttctgccagtgggcagggaaactgctaaagccagggaaatgcaattgcaagtttggtgcttgtttcccagtagctcagaacagttctccctgccagacattatgatggagaattaattggcgtttcactttgcgatatcttttaagggttcaaatggcaccttagcatttcttttaacttttctgcatcgaatgcatatattctgggctctttggtgtgtagcatagtttaagggcttcataaatatttgttgagaataatcctaggacctctatgaagtttaaggactttttgtgttcatgggtcataaggaaagcatttttaaagtataacttgaccatcaatcaaaaatgcctagcaaccatctccgtatccatcagtctaaattagcagctgttggtaacaataattagcccaattccccagggtgcaatatttagtcaacaaaagcactcaactctgctattcactacttcttggtgaaagggtcaggagatgcagttagattctctaccctcattcagacacttgaaactcgtttccagagcttagacctcttcacttgcatctctcaatcccagtatcattacatttatgacattgttgattaggctctctccttccctcctgtacaacactgaaaatctgccagaaatacaactatagaaactgtatttctatgaattttgagcattttacaggtatattcttttttagatgggtgaaatttacacaacataaaattaaccattttaaggctgggtgtggtggctcatacctgtaatcccagcactttgggaggccaaggcctcccaaagggtgatcgcttgggcccaggagttcaagaccaacctgggcaacatagtgagactctgcttctgaatgcacgattcagtggcatttaggacattcacattgttgtgtagccaccacctctatcaagttccaaaacacttccatcataccaaaagtaagccttatactcattaagcagttactccccatctcccctcccctcttagcccctagcaaccaccaatctactccctgtctttatgaatttttgccttttttggacatttcatacaaatggatcatacaatatgtggcctttttgatggcttctttcacagagcataatgtttttaggctttatccacatcgtagcgtgtgtcagtgtttcatccctttttatggctgaataatatcctgttgtatagatatatacccacagatgtaatttttagagccaagatatattacatttgtaaatccaaagctttaagagccattaagagactcaaaaggacatataacccttggagtaactggcctgaaatttttctagatgaaacagaagagtacagatctgaaattctcctccttgctgctgccagctagctttgtggccttgtataaatgagcatcaattttcttaattagaaaataagtaactagatttagtactaaattgtttcaaggttgtttctttgctcaaaaattcccagcatcctacgcaatactccgcatataatagctcttaagagtgttgtttatggaacttaacaaaataccaaactcaacaagattactagtccagcatcatttgatatgctcagaaatggtatgcttcatgccacaattctcttgtttttaagagaagcacttgcatttttgaatcaaagtgttcattattaataactgaaccttccaaatgaacctgagagtacatagaaggagattgagacacaccagtgccttgctttttagtttatacatgagaactctaaccagaaaacctaaatgaagaagagaaatagtgcatccactggggggatttgtgagaaagctcatgaatattttccacagcatctgctgggaatatggtgcaagaaaatgaatacaaagagaaagaaaatgagccagacaaaaaactccctttttaatgtttattttagagagaggctagtaattgattaaactaatccaatatctggaaacattcttttttaatattcactttgccttttatgcagtttgaaattttggagactctcctttgaagtggatcagggttgcgtctgaaaggaacaaacagtttcccagacagatgtgtgaagaaatgcctagagctacgcgcttcttgctggggttagacgtgaccgggccagactgttaaatacacagcaacatgaaatatgaatattcttttgctttcgcagggaattttttttcctgatagtaaaaaggaagagggcaagccattttgttgttttctccaattccttcacttttttttaaagcttgcattcatttgttttatgttactgtgttgtgacattttgagatgcctcttaaaactcatgtgtaaaaaagcactttttaagagatatttattttccttttctttttcatttctatgcagtgatgttgaaagtcatcttgacatttctgaaacattgttttgtttgcattacagagtctccatggcaactgcatcctcccaggttctaattcctgaaatcaacctcaatgacacatttgacacctttgccttagatttttcccgagagaagaaactgctagaatgtctggattaccttacaggtattgtcttttatgttctctttaatattgtgcacacttagtgatataaacactttgccaccagatcagttattccccaataaccagaggaatgggcttttgacctaggaatggcactgatatttccataaacaatttctgtgcattgccctttgttttttcatcaaaacaacacagcccattactaaactggggacaggagaaaaaggagaatctcaaccattaaaagcatacttaccactgtttccctcactctcaaggtgtgggtgctaaaaatagtatctctctgtggtatttttcatatcatagtagtaagcaactcacaatacattggcagagaaaaaattggcagctaactgattggttgtctgtactgcttcatctccttgtatttgtgatcttgttttaatttgcacaacatcgagttgaggtaaagcattataatccccattttgcaaatgacagagatcagccgtcttgctggaaatcaggtaactagggaatgacagaattagaatttggctgggacctgtacaaactccaaaaacttctgctctttctagtaaaagactgaattttatcttggcaaatgtcaccatggcaaaggtcacaaatttacattggaattcctagtgctgtgtttcagtgtgcttcctggttggtgttttgttttgttttgtttctcccttggttgagcttaaaaaacaaaaacaacaacaaaacaacaaaaacctcaggccactcctattcctaagcatgcttctaaacttttctttgctgtcaacttctaaagtaggaactgagaatattcactggtagaacctggactgtttagacaaccttattcgtgttagccaaagccaccagtgcctgcgacttcaggaaagcacaatgtacacagtgaagccagatgtgcgctgcacttaagacatacagccttcaagagaccacgtctctaacttagcgtgacatgagcttctcaattccaattctgtgtgtacatgtttgtgagaaagcgattgaacaaggtggagcaggagaaagggaacattgtgtgatgtttgtttttacagtctgtggatagaaggccaggggttctatattcagggagcattgtacccagaagatgagcattttttctttgcgaggacccaatgtgccgtttttagcctttctgcattgtcaagcaaggcaggcaggcattccacaaacttcttatcttatgtaactctctctttcaaacataccactcctattaaggaagaaagaaattgactaaaaaagcatttaccgtatggaactaaacttggtttcaaatatttgtgtacataatgccctcctatttaagcttttaactctgagatttatttaaactgacactatccaataaaactttctatgatgatagatatgttctatatctgtactatccagcgttagctgcctcccacatggggctattgaaaacttgaaatgtggctagtgaatttttacttttatttaacttcaactaaatttaattgaaatttaaaccaccacatgtagctcgtggctattgtattgaacagtgcaggtctagactttctccagctaagctgtttttcacagtggcatcctgttaaaaatctcctttttcttatatcatttgcgaatgagtttagttgcaagcaacaaaaaatccaactagcagtgaataaaaccatcaaggagtgtttgtattacagtcacagaagagaagcctgtgttccagggctgggcagtggttcagtgacgacctcagaccccaggctctttcttttttcctcctctgccgccttcattgtgttgcctttttgccacatgatcacaacatgactactccacctccaagtgttgtgctcaagctctaggcaaaaagaaaggggtggaggggaaacgatggacaaaatgctctgccagtgaagtttgtttatcagaaaaacaaaaagcttgatcagaagacccgcctagcaaacttccacttatgtctggtgggctgtatctgtgttacaaggtcatgtccagggacagaaaagactggaaaattaagtatttgcctaggcacatggccattctgcccagaatcagtcttattgacaagaatgtgcccttgccatttcccaataattatttcatagtatttcaacaacatatacccattttaatctctataggaatgcaaaagtattgattaaaggggaaattgtgaaagtagtttagactgaattgtaacatacaccatatttcatcccgatggctgtttatttcaaactaaaggccatatggggtacctgctattatgtcttctgagctgtcaaccccaaatacaaattcagtccatttctagacataacatcgatcctgaccataacatatgatgcttggctgatactgccaagtccaaatagtttatgacatttgtaagcaggaaatgaagtctttgtggagtattagcccaccattccttgggtggtgtttgtgacagagacaagaaaataacacttctggtactgattccatgagtattgaaattggcagcatgctgctgttctcatttacactaaattgagtattgacttctcaggacaaactcattgggtttacagtcaaaataaggttagcctgtctcattgtaaaaacaagattttttttttcctatgacatgcctctaagtggtatatcaagttaataacccatagaggtgacatttccttcctgattatggctactaccatgtgtctcacagctacttgcctattttgaacatacgttttctttctatttaattgtatattgcaatacagaacaaaatttttctacaatggttgatggagaaataattcaatgaactgtttaaattgtgagagagtaagtatttcttcactggtccatgcaggagtgatcccacaccaacagggaccacacagacaataataagcacattttacgatgcagctggacctcctccgtggaatgcatatcctgattggtgtcactgattcatgcacatccaagtcataccacatgacactaaatctcacatgtgaatacttcaggagacagatgtacaaatacatattccagaaagaatgctttaaaggttatgtagaacccttctgtcttaatgcacaatttaatgccatgcctgtcacgttggaggtgctcaacaatgtttctggaattcagaaccaatagataaagctaagctaattgacttaataccgtagacttgcttctgtgatacttgtcctagaggtatattcaaaaagcaaagtgaagactactaacgcagagtttaaatttacagtttttataaacttttcttcctctttgggtttgcttaggactcatcaattctaatcataatttagagcaggaaataactctgaaatagtacaagcaaaggttgctcctagtttgtagagtgcaggtatgtttctccttttgaagtgagattctagtgggtagaagagtggaagtaaaggccctggatcaattctctaaaccagaggtcagcaaactttgactgcaaaccaccagatagtagacactttaggctttgcagtccatatggccacaactactcaactttgctgttgctccaaagcagccatagacaatacataaatgaatgaatctggctgtgttccaataaaactttatttacaaaaacaggcagtgggccagacttggcccacagtcacagtttgccaacccctccctctaaaatattatttacaatgcaaagcactcattttctcatattttccttgctcacatactcttctcataaaaccagttactgaaatcaattcagtagaagtcattttaaactcattattttggtaggacttagacttctctgctccagaatgtgttaaagaaataaaacagcagccttctacaatgataaattaaccaaatgccaaaaaaaagttttttccttggggaaggaaaatgtaccttttagatatgattgactatgaatcatggtcttctgaatttgaaatatcgcatgagttgagaaatgagaagaaaatagggctggactagtaagttcttttttttatgtaagtcatcgaaacatctaatgaaagaaaaattcaaacaattatgtggctgattttttgtaggataacaaacataagtattttttcaattgggtgcctaaagatataagtatctggcaccacgtattaataggtcaggggttggtgaactttgggttacagcccaaatctgaccctctacctatatttgtaaataaagttttattggaacctggccatgcccacatgtataagttgtgactgttttcatgctacaatggcagagttgactagttgcaacagagactgtatggcccacaaagctggaaacatttaccatcaaggcctttactgaaaaagttagccaacctcccaaagtgaatgcagctatgaaactttatcttgtttactttttatttgacaagttttccttcatgcacaagaaagtattatttgtttaacctcccaaacatattctcatgatctcatgataaacacagaaagtccatactggctgactctagtcacactccttattaaaaacaaaagcaataaccagccaatcagatattctttagattggggtcaccatctctaggatagtagtcctgatggacctattgagaaggacctgcttaactgtcaaacatctcctctgaaatggtatcccagttgtgtgtgcttttccactgataagcattcttgacccccacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtgagtatctcatggcctatttatttctgtctttggtggctttcttcagattgattgcattcctgaatttaaacttcaaaggaagacaaggaaggaaagaacacacaatatttattgacttgtctttcttgaacaaaaaagtgatagcactcacttgtactacattagtaaaaacagctggctaaatattgatgaaaattaatgacctctagcaaaccacatggatgttaagggaaagaagccagaaacaaatatatagagagaaacaaatatatagagagatacatagagagagaaacaaatatatatatatagtattaatccacatataggttcataacttaaagatcaaaataaactattttgcttaaagaaacattcataggtgttaaaactataaaccctgggcaacctggtgaaaccccatctctacaaaaaatacaaaaaaaatacaaaaattagcggggtgtggtgacacacacctgtagtcccaactactcaggaggctgaggcaggaggatggcttgagcccaagaagcagaggttgcagtgggcagagatcacactacagtactccagccggggcaacagtgagaatgctgtctcaaaaaaataaaaataaaaagtcaggatgatggctacctccaggattaaagggcaagtggcaccactggaaagaaatatacaggggttcttggggttaatggcaatttctaggtgaaagttacatgctttagtcattttatcatacatttagttttatgtactttcctgagtgttacttcacatattttaaaagaaaggatttaataaaataaatagccaaagaaagttaaatacctggtcccattcagaggagagagctgggcccatcacttaaaatgttagtaactggccccacccgggaagaatttccaaccttacctgaaacattagaggtgccccctctcactgaggcctatttgatatctggcatcagagataacttggtgatttcaaatagcagtagtagcaggccacagagatgataacagaggaagcagtcctccaacccacagagttatttaaattgaactgggcaaatggcaatggaccagaagacatggcttttcacgggagcaagcttgaaacttctttaacaaagaaaaatacaatatgtcaaaatagaacagaatagaatagcagtcatgtttcaacaaagagatgttttgaataaattcatatcaatttaatgtgcttttattatataaaccttttctctcttaactacaaactgctctttcctagcacaagtaattctgagtcatacgatgcttaacatagaaatttgatttaggattaattaaaagagtgatgcagaaatacaccaagttctaagggactaaagtataaatgacccataccaacaaatggctccccctaccttccttatatccactctccccaacttctccaacttcctctcctcaactccctcaccttctaccctataattggcctgccgtggaagcttttattaaaatcttgccatttaccaagaatgtgtaatttttaaatgaaagtggagaaagtcatgcaatgtcaagaacagctctggcaagctgcctgagtcagtagggaatatagaaaggtcagaaatggtgagtgggacaaaaatgtcttgggggaagttgtggttaaactaagtcttgaaaaaaagcgggtgcattttagcaagttaaggctgtaccggacagctatgtcatcataagcaaatctatcaagatgtaacgtagcagggcatagtgggaggtcttgcctaattaagcctggctggtaagtgaggaaagggagacagtgagaaatgaagatagagaaatagaaccagggctcaaacctatattggcctagctccaaaaagcacatgttcttaatccttaatcctcagtcacctaatcctaattcacaggcaagagctagattgcagagggctacccaggccataccatgtttggattttaccctgtgggcttgagagtcatgcaggacagtaatgtaatcagaggtataactagaaggtgactcaggagcactgtggagagtggagaggaacagggcaggaccagaagcagagacatcagctgggaagtttcgtagtaattcactgaggcagaaatagccaggacctgcaaatggcaccagcatcagagatggaaaggaaaagataattccaggaagacttctctgcgtctggcccattttcctgggaaaaaatcatcagtgtcctcagatatttgaagtgctttttggggcaagtcgcagaaggcctgtatagcaatggtttagtaacattttgctcaccttctaggattttgaattcttctggtatcattcctcatttctgactctatatgccctactgcaaatcataaagaaatactaattctctaaaatatttttctacatgtgcatatcatacacaatgctttaccttgtttttttcaataaatattatgtctgagatatcattccatttcagcacaaataaagaactgcctcattcctttttgaggcagtatcatatcctattttaaagatatgctctaatttatttatcccatcttctatagatgtttatttagcttgtttccaatctttggcccttacaaacaatgccccagtatccccaaggatgttcaagatatccttgaatatctctccttccacacacggggaattatatctgtagtataatctcttgaggtgcaatttctaggaaaagattatttgcatttaattttacttgacattgccaaattgcccttcagagagatgacatgatttttaaatgcatttttccagctgtatgagcttattgtatttcactgatcttggctacatataccataaacttaacgtggaattaaagtctagtaaaattttaaaccttgattgtgcttcaccataaacctgaaacacaagttaatctatgatcactaatatcatactaaatagtcactccttcatataagcagtgattctcaacaagggcagttttgccccctaagggacatttgacaatgtctctagagacttttggttctcaaaacctaggaggagggtgctattggcatctagtgggtagaagtgaggaaagatgggaaatctcccacaatgcacaagaaatcccccaacaacagagaactatctggcccaaaatgtcagtaatgtcgaagttgagaaaccctaatttaaaacaaggtaaatgtataatatctacatgattacatgctaaatactgagaccataacacactgatccacacacactactatactatgtagcatggaaggaaaaacacaacaaaaaggggggaatataattaatgtattttgtcttcacttaaggaattgttttctcaatattttgtgattaatatcactagcatatttgggataaactgaaccagggattgtatcaaacttgaagaagatgaaattcaaaagatgatcagaaattccaaggtaagagaaaagaagcacgtgaaggtctgagaagagcaggtagaaaatggagagatgattcattgtaaaacaccaaggaaggttctctgaaaatacatagaggactgatagaaccaacgtctgttgatgagtgaatagtctaaccggaaaaagaaaacatttggagtcattttataccaaaagagtggttcttggcccatgtgagaaatgctatatttctctcaaatcattttcgtctgattcaggaaaagtgctaacagttttctattgctgtgaaacaaatttccaaaaacttagcagtttaaaacaatacccacttattatttcagtttccatgggttaggattctggcatagttgagctgggtcttcttcttagggtgtcacagtctgaaattaaggtgttggctgggctgcattcatctggagactcaactaaggaagaatctacttcttagctccctccatttgttgacaaatttgtttcattgtggttgtggaattcatggcagcttgcttcgtcaaggccagcaagggagagagtctgctacttcaaatctgtcacctccaaacctgtctttaaaggactcacttgactaggtcagactcacccagaataatctgccatttgattagctccaaatcaaataattagggaccttaattatatctgtaaactcccttcgccttcgcctttgtcatataatgtaatataaaaacaggagtaataaaagtgatagacctttgtcctttgccatattctgttggttagaagcagatgacaggtcctgtttacactaaggagataatattacacagttatgaataccagggagttggaatcctggggaccatcctagggcatgtcttcctcagatggttatgtctctcctgaaatttcttttggttttcttttattctttcatatatgtatgtgtgtgtgtgtgtgtgtgtgtgtgtgtgtgtgtgtgtgtgtgtgtatatatatatatatatatatatatataaaatttcagacagtcttgctctgctgcccaggctggagtgcagtgtcatgatctcggctcactacaacctccacccccagagttcaaatgattctcctgcctcagcctcctgagtagctgggattacaaacatgtgctaccacgcctggctaatttttgtatttttagtagagatgggatttcgccatgttggccaggctggtctcaactcctggcctcaagtgatccacccaccttggcctcccaaagtgttgggattacaggcatgagccactgcacccagccctctcctgaaatttcttaaatcaaatcgtcatggacactttgggagtacatgtagccttggccttgactgatgggctctgtatccgttggcttttgctgaatagccaacaaccacagggcctaagtagaattcatattgcttatgcatctggagtcaactgagtgtcaactaggaagccctgctgatcttggctccctcacatggcagactgataactgtggcaacccgactgctgcacatctgtctcatcctcctacaatccagctcaagtctgctctcaccctgattgcagagatgaaggagtaaaggcaggaccaattacacacattctttttaagcccctgtctgtgtcacattagctaacatgaggtttgtcaaagacgtcccctgggtgagcccagagtgagaatgcaaagacctgcaaaattacaaggaaggagcaaggaattggggccaaaaggccctaactcaataccagagcttcacctcatccccaaaatgaaaggaagatatttattgcttgaaacttagggtttctcacttggctaaactgtgaccaacttgatttctgtgctatttgcatcgaaaataataccaaacatgatgcattaatagaatagatgatgcaaaaaggtcatgcataaaaaaactcaacaagagcaaaaccactcagtataatgaactcagaactttatgttgggtgattccagagatgttttgttcccagaaaccagttgccataagaaaagaaatgcaaatggcttagtgaagattatcagcctttaacgcatagatgccagaaaggcccattctcccaggatggaagaaaaacagtgaaactgctggtgctgaccaaactgggatactctcaccgggttgtttgtatcaggatgtgttcctcccttgatgcccattaaaccagaatagtgaagtcctaatgcctacaggatccatttgcgacaaagaaagaattcattcagataaaaagctaaccgataggcaaagattttcaaattattttcttcttaaatatttttcacatttgtagtgaccaaaggagacctggatttcaatcttgactttggacctcactagctctgcagtcttgagcaaattatttaatgtcctccgaatccgtttcctcatctgtaagaagggatagtgttttaacttcacatggttgagataataatagtaaacaccttagtcttgtgtttgccacagtggtagcacatagatattcaaagttattattcctacaaaaatacggactgtactcaccccataattgcattttaaaagaaagaccagttttgcaattttccaggattatctacatgatagctttttacacaatcagtatgtgaaaggctttccttgaatgatgttaaataatctgtcctattatttggagaagtatcctttgcagatgttgtattgcgtgacaaggtctaatggtaaaactctactgaaaatgagaagatataatgctcaaaacctggctgtagctccttatatcactagaaaatcttttactgtctctaggtcatggttccttcactcatcctaataaattgtagttaattgccttcaactggcgttagtgaaggagacttagataatatctatggagctttttcaatcttacgaaaaggccctcactaatgaaatacatacattcaaatgcaaaagtaatgacattaatttttattttttatttttgttaatagagttatgactatagatgttaatgaattgcttatcaataactagatatttatttaattttacaacgtttgccacgttttctctaaaactacttttgatgcttcattttaagtcttaaattgggtcctttccccagcagcctattcttattcttagcagaaatcaaaagctgcatttttttcaagccttaatggctaagtagttatctgtttttaatttattgtagtcacttagaaaacattcatgaaaattattaaacatatactatttttacagaggagaaggaaaggaatgttcacttctgtccagtctgttggaagagacaaaggatgttagaaaccagtgtgcagcctctcctaagactgtccacatcatgtgacatttttacacataattttttgtggcaagatgacagttgccatacaaggctctgaaatcccagatgtaattaagatcttataatgagccacattatgtagggaaatgcttctaacccattgtgaatgaaaaaaaaaatgtataaaatcaaaaaactcaattaattaggtttcattgtggacaaattattttccaagctccgttgttattttaaactgagtcggaggaggtgaatgttggaacaccctcaaagatgactgaaaatgagtttggagaaaagtgaagtttcaatcaggatggttgtgtgggtgtttcataaagagatgaataaagcctggtcaagagtcctaacacagtggggtgtcaaggcagagaagtcttgcttaagcaaactcagtgccatatgcaagaagttaggtggtgctggcgtaagaccaacaccggtaatggtgcactccaagtcaccccacttactccagcccccagaagaaaattgtcaatgttgctttcctggcatttttaatcaacttctcaattattatcttggcaataataataacataaaggtaaacctaaacagtaatagtgtttgttagtattcatgaaagtagattgtcccagtataaagctaaccaatgaaattttactacttcataaacattttgttcttttaattttcaaggaaaaaatagggacctcttcaaaataatcaggatagtcagagtccctttttgtttggaaaaggtttctgaaacataaaatctttgttgggttaagactttggattttaggccaagttacagttttcagcaatttcagacatctgctttatgatgttactgaaagcgttcccccaccacattaaacccagcttttgggttgtacagtgatgtaaagtttattgaaacatttttacacttgctttctttgaccacaatagtcatttttttgtaacatattcaattaaacaggaacagtataaaggcagtgaaattgatacgattctcatttgaatctactgaatgccttaattgttctcattcgtggctgactgccattgacaaagatctaggaatatgagtacactatcctacataatagaaaagctaattttttgttttattactactgtaataatattaagtacctaaagagagttataggcctcttggggcccagaactcagagttcaaaatgacccttctttgattggatcaaaatctaatatttggctgtggcattatccagaagtatggagtttattatagctatgttcaaggaaaaggtaaggtgaaggaagatcagaagggatatatagtaaggagattcccatgttactaaactatttgtggatgttttcctgcatcatatgcaaatgagaattggtaggaaaacagagggctaagaattagagaaaataaatttggggaggagggatggattgtgcctcttattgctctgctgaatctccaaatataaacacacacacactcaaacccttctatgagtcctaaattacattcttgcttcaagctggctttttcaaatctggcagtccactggcgaaaatgtttgcaggttagagaaaaaaaaaaaaaaaggcaacagaaaattcacaagaccaaatatgtgtgtgtgtgtgtgtgtgtgtgtgtgtatctttagatatctttagatgatatatacatacatacatatatatatatatatatttaattcactgatgtgtacttgaaaatattatgcacccaagatggaaatcatataaggtgaatttttcaactgtgacaataccatgaataatttttaactcaaaagatggagtaagtaagtattcagtaagattcaaagacaggcttcgggagcctgtgactaccttgaaattctatgcatatatttgtggtttggtgtgtatatgcatttgtgaatttcttactacagaaaggttttattagattatcaaagaggtgagaccaaaaaaagattaagggactgcttcttgagaatctggtaaagtataagttgcctcaagatcaaaggaactaaccctttgacttgcaaatcaattgaaagaggagtggggtggtggctttggagtcctctggaagtggagggggcccagccctctcccagggatcagtgaaggaaattcaacagagtcaggaaacttcttgacagcctggtcaccaagggtttggaaaaaggttctattggagtggagattgatgggtggaaaaaggagagaggggagttggacctgataccaaagagatgttttcagccatcaaccagctgcaaaacaagatgggcttccttttcctacatattcttccaagcatcataaatactcggtctgctccccaacccacatcctgcaggatgcagccagagcaacagccccactccactctgaaaccagtcatcctagggatgatgatcatttcttagcttccctgttggaggtcggttggggttggctgatcgctgcttggttcactcctgcactggctgggcgttggctgcatggtaaagctgttccctgtctcatcctgttgggataaacagagtatcctaggcatattttctccagagcagtggcagacacaaagggtcaacagaaaccctcaaggttttgtcatgcctactcttgcaactagcacattgtcatttcagcctcatgctattgaccaaagcaagtcacttgaccaaattcaaagccacatgacagggaaatatattgcacctctttagaaggagcacctgcaaagttatttgggcctggatatacagggcagggagaattttggaggcaaaaatgcaatctgccacatctacgttagtgaagtcagtttttcgtacatgactaccaagacaaagcacttcacttaccaactctattcaaataaatggaaattattcaacctaaaattatgcaaacattgctccccttgtgccaaagaactgcaccatgtctgattggctttgcaggtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagtaagtgctgtgaactcaacagagctgtcatgtcttatctgctcttctttcagctgactctgtccccctttcttttccttttctctgtcttgggtatcattgacagccccccaaaacaagtaaaaagccagtgtggaataatggaatttgcatcagatacctctaggttccaaaactgattctattccttcacagccgtgaggccattactctctctgcattactcaattttaaaaaattgagtcttctcattttttaaataaatattcctggaggcattcttgtgagaagtagatgatgtatatgtaagacctgacacacagtaggggctctgtaaatggtggatagtgttatttttcatagcagagtagccaactaatcactcttcagaaattcttttattctagaaaacagtcggagtctgtggttctcaatcagggacacttcttcctccccctccaccccaccctaccaggacatttagtaatatctggaagaggtttttagttgtcacatctgaggtggatgctaccggcatgtagtgagtagaggccagggatgatgggaaacatccccaatccacaggacagtgcgcatcacagagaatggtctggcctatatgtgtgtctcatgatactgtcatctccctctctctgtccacatgtgttttgttttatcctctcttctttctttacatccttttgatctaggaatattatgttatgtaacatggtgtttatttgcataagacctcccaagagaaagcaaattggagtgtgtcggtatggcgccatgttgtgaggttgccaggcagtcaacaggaacaattaagtgcttttcaaggggaaccctcatttaacctatatccttgtttctcagtacaagtgttgtatcctagaggaatgtgttggatcctagaggaagaacaagggatgtaaagagagcactgaattacgaatgagaagactgtggctttcccacttggtacccatatagctatatggctagtttcttcatatttttaaatagattttttattttggaatagctgtagatttacaggaaatccatagataatacagagagttctgtacacccttaacccagtttgcccaaatattaacatcttatgtaaccttggtacagttatcataactaagaaattaacattgatgaattactcataactaaactccagactttattcagattttaccagctttccactaatgttcctttcctattccgggacccaatccaggatcccacaatgcatttagtgttccttcagttttaaaatgggaatattttaacaacttgagggttgttatgagttgtcaaaaagaccctctcaaagtaattctaaaagtacataagagaatataacatgatgatatatttctttacagtcatacaacaaatggcacaatacctatgcacacttagatcagcattatttgatttgcatttgaacatgtaaatatttgttccttcaaaagatatgtttgagcaccaagtgtgtttgggatgctgtgcaagatgctaaggatattatgagtatcttcaactccctaaggtgtgcttctctctcaaaaaggtcctagactattggggaataaagcacattaatcctaattaacattcaatatgtgaaatctctgactggaataaccatgagaggttctaagttgacaaagccagggtgccccagcacaaccttgagaggctttccaaggtaggttaggagcaggggatgtgaggacacagtgttccatgcagaaggaacagcatgggcaaaagcccagagacaaggagaatatatttatggaacagaaaattgatccatgtggttaaagtgtgtcttaggttgggaggataggtgagccaggaggctggagacaagaacagatcgcgaaagcctcctgggccacaccagggagtttctttgtataccaatgattggtggagagattgaagagtttaaatcaaacaggcaggatgaaaatttccatgaaataaagctctcttgcactatgatgtggtgagtggattacaaggaaggaagactggctgctgggcacagtatcaaaagattattgaaagagttgtccatgtaagtaaacaacggcctgaataagagtcgtgtcccatacaaatattataatgaattgaattatttagtaaagtaagctattaatctctttcttgaactaatttgtcttcactgaagcaaaagccttgaatttgggcagagtaggtagtggtttatttgggaaacatatctgaggcatgggcagaatttgctcaccaagattgcatgattctgctccacacatgcgtgggtgagggtgtgagccaaggcaggcaggatgtttgaggcagtatgtcaccatcacaaggccggtctttccaatggctctgacattctgatatatctcaccggaaggaggccgagcagaacttggccttcattgtaaatgatgggcgccattaaggaatttcttcctgctctgcccattagtatcctatcaatcatttttaatccatattctaccttccacctttaaaaattgaaatattttaagcaaaactgtcttcatactcttcttgtcttagttcatagtttatctctgatagttgctagcatgatcattcctaaggacttctttttacaagtcaaaatttaaactacacatgtaatccaatagatcttacggcctctgagaatgtccaatccctgctcagcccttgagggttttctctgctccccctttaaagcttttcttttcttttttattgttatttttttgagacagtgcctcactctgttgcccaggctggagcgcagcggcatggtcttggctcattgcaacctccgcctcccgggttcaagtgatactcgtggctcagcctcccaagtagctggaattacaggtgtccgccaccacacccagctaatttttgtatttttagtagagatggggttttaccatgttggccaagctggtcttgaactcctgacctcaggcaatcgagctgccttggcctctcaaagtgcaggcattacaggcatgagccaccagcccagcctaagcttttctttgatatgtacagaaatagatttctaaaacaaaagccagctaactatagctcaagggccaaatctggctgcctgattttgtaaataaagttttattagcatatagccacacccattcatttacctattgtcctgtccgtggctgccccctcactatagcagaagagttgaatagtcacaaaagagaccacatggcctggcctgcatagccaaaaatatttactgtcaggccctttgcagaaaaagtatgctggtccgtgacctaaaaagaaaggattttagaggtgctggtgttgtgttgtgtttgtatccaaaaggcaactggaaatcctttggcctacccacatgtgacaacacacactgtcctatactcactgggtcagtttctcgcccagcatcgtgtattgccacagttgaatttactagaccttttcctgtgattgagagctgtatactgggcagaaggaacctgccaactgcaacagtgactgtggagtttggacaccatggcatttgtatcaggttgcaatgcatttcctgcctttaaacgccttgtacccaatgcagtgttgaatgacaggcagtactccaaaccaatattgaattgtcaaagaagaagtaacaactatgacaaaatgtccaggtgtgactctgccaagatttttttaatacttaaatctttaagacacaaatgtgagtaatgaaatagagaaggccttattatatataaataatttcatgagtagaaaacccaggcattgctatcacattttttcctaattttgtggcctgaaaattgtattctcatcctaaattcctaagagtaatgctttaatttttaataatctcagaataatataaacctctagaatattctatatgttaagacccaagatcttgatttgtttggtttctggtctgaagtctattgagcatgaatgcatcttatgctggatagaacactgcagtggttgaaaatggagtcttcattcattcctccttttcaggatgctatccagccagtatgtacctgtgctgcttgtatacacctggaatccgtgaagctagctcaccctatgttttctggctaagccttatccatgctgttgttgaatagttggcatgccaccactggatccctatcttagaactggtagactgaaagcttatgaagacaggaacatgttctttttcactcttactgtgtactgtactatacacagagttgctgctctctattgtcttttgaatattatgaaaactttgcaagcaaatgtctttgaaagttgcttataatgtttaaattactattaaaatataagataccactttgtgataggaggcatgactcagggagggctggcttgttcctgtcttttaaacctgattttgaaaatatgctattggttatgataaaataaacaatcctcttcctcttcctttttctgttttgtgaatttgttttcaggccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtaagcaacttatttctattgtcctgcagttataaaaaggcacatctcattctgtacttagagagtcaacccatactgtaatgcatcttaaagaataaaatgcagaaaagttgtattagtcagctcttgctaggataatactgcataacaaacacccccaaactcagcagattcaaacaacaaccatatattactaatacccacacctgtgggttctctgttcaagattatagagctctgatcattggatgagctataccatgttaacactgctctttcatgccatgaaacatgggttggcaaaccacagcccatgagccaaacctggcctgctacctggttttgtaaataaagttttatgggaatacagccaggtccatttttttacatatagtccatggctgcctttcagccacaacagcagaatcgagtagttaagagagaatcatatggtctacgaagccaaaaatatttacttactttctggtcctttccagaaaaagtttgccattccctacttttaaacatcactcttcatcattacacaaaactaatttctgttgccttgtatgttttatggttctagactggaccaattagtgcaaatagctaagggttgaatggtgggggtgaagcagtgatcataggctgggaataatttcaaaaggcctgttagatccagcccagtgactttagcccactgagttctctaagaataagggcaaaggtcaggacacaattacattggaattagttaacctcacaaagttaaccttgcctaatccacagccacaactgcacccctttgaccgtctgtctcacaaatgcctgcttgctattgatcaaaaagggagctattttatttttatttaacaagccctcatatggtacaagtatgtgccaggcactggtctaagcattttacagatgtcaactcatttattcagccttacagccctacaaaggtaggtgctaatattatccactttactgatgaggtgactgaggtatatgctgaagatcacagggttacaaagctcacaggtggcagagtcagtaagtctgcagtcaagggtcaggctcttaaccagcagtccacaaacattatctgtaaagggccagagattcaatatttctggttttgcatgccaaatgatttttgtcactaatactcgactcttctgttgtagtgggaaagcagccacagacaacacctacacaaatggacatggctgcgttccaataaaacttcatttataaaaacaggcagagggccagagttggcccctgggtagtagtttgctgttccccgctcttaaccaccatggtatgctgctattcacaaaagggtggtatatttttgaaatgctataattactctctagggtttatgacagtgtacgtaatgagtgatagctgaatccttgctttaaaaaataaaatcaacattcaaaattgcatagcctgaagatggtgagtataacagtgtttctttcaatataagcatgataaaacacttatttatatataaaaaaacctttcaattcaaacctatgcaaataatgtgacatggctgagtcctttatattgtaggtagaaattagccaaaaatctaagaagtgaattgtaagcttcccatctctcccaataatggtacatactatattggctgagcgagtaggttttcctttgttgctatcctcataattctctttgcctagaagagttttctgttccaacatcctgccagaggatggaggacaaatccttcaccccactaggctctgggctagattggcatttgcaatttttagctgcagtggggcaaaattaaagcacaaaggaaaacacaatggatgcaggtacaaaaaaagcaaatgtttctagttaattaatgtgctgtattaatctgggatagaatccagggtctaaatgattattactctattaataattaattatgataaatgaaacctgatcattatgatctcattgccattgatgaatagtttgcaaaattccatcagaccacttcagttatataaacacacatcagcattaccttgaaaacaccctccagatgtcaaaactaactcatgagggggaaaagaaattctaaaattaattgctacacaattaatctttacaaacctgacggtgtcaatttcagaaaaatcttcatgtagaaagtcactttacatttccttggggggtattagcaaggaaggggcaccccctacgattaaatgcctgtgacatcttgacttgcaacagctaatgacatatttgcttatgaaatatagtcctgactttaaattgatgtgtacattatgatctgtgcaatggggcacgttaacattgctccgagagacataatttttatactttgaattctccgtgtctcactgcgtaacttaatggaacattacattctgcctgcacatttcaagctcaatggaaatatgtacctagtttcacagattaatgatactataatggtattttcctttgcttaatggactatacacttagtattttcttactctctaatgctaatgtgcacttggtgttttatgaaatggtgttaactaaatgagtaataacgggttcatgcaaagattattagaccagaaggggtgggggcagcatacaactctggattttgctcccaattttaatcttctgtttctacttgctacatgtagtcagccatacctgccacagctatttcatagggttcagttaaggttcaaatgggaaataaacatcaaagtaataaaaaataaaaatgctgtgccacaacaagaaggaaacaatacagatgtggtgattttgtgatgcaggttccaaattgtctgaaaagcggaaatagtattcactggggtatacagaacatttttggggggtgggagatactgacaattgcaaaatgaaaacctttccaaaatgtatgtattagtctgttttcatgctgctggtaaagacataaccaagaccaggcaatttgcaaaagaggtttataatggacttacttacttacagttctatgtggctgggaaagcccacaatcatggcagaaggcaaggaggaacaagtcccgtcttacatggatggcagcaggcaaaaagagagcttgtgcagggaaactcccccgttttaaaaccatcagatctcatgagacttattcactatcacgagaacaacactgaaaggacctgcccccatgattcaatttccttccaccgggtccctcccacaacatgtgggaattcaagatgagatttgggtggggacacagccaaaccatatcagtgtatcaaataaacagatgacatttgagaccctcgatgcatgccacagaagggagccagaagcttacaggaccctggaagggctggggcatgaagtcagggagtctgctgctctagttcatggagtcatgatgagctgtagctgctgcaaagttgcccacagcacaaggcaggtgtactcaggcgctcatctagaagcttccaccaaccgcacgtctactgtctgccatcaggaaagcgtgtttcccctcctctaagcacttctggatcttgtgcaaaggcatcacaatagcagagcctgacccagactcctacaggaaaggggattctgggaaatgcaacttggattctcctcataagcaggagaggatggacgggagggaagagaggatgcaacattgatgacagacaggcctgcacactgggcttggcagattatcaattccatccttcttttggatttagtgatggcatgttgtgttaattttctttttaaacaaacacaccactcttaaagtgattgtattttaagtccagtgtgattttttttaaagaatgtcattttattaaagacccatgaaatttttctctctgcattgggtaaggtaccatatgttaatatccaattagactggtttctgctataacatattaaaagttcaactgtgagtcatttactctttataaagagtgatgggttttgtttatcttaataactgaaatacgatgaatattacagaggcatgactcagaggggtaaaaagagattaagatgcttagaacattgtagaaagcattctttggatttttttgagcagcaagagaacatttagaataaccagaagatccgtctgctcaaacacgttcagaattttttttccagtataatcagaaaggctcttggcagtgatgaactgcacaatttctggttacggatggcattgtagaatgtagttcgtgtttgtgggttttgagtcatcctgagttcaaattctgattctggtacttattgttaatatgtgccatcaggcaataataataaaataaatagcagttactgaatattacatgccaggtcctgtgcctgggacttaacatgtattctctcctttactccttaaaataacactgtatatttctcaatatacatgagaaaattggggctgagtaatgacaaaggatttatccctgcaaatgggaatcatcttctgtgcttgcccttggcaaagtgcattcagaatcagaaaatgacagacatggtgttaaatgaaaaattataagaaggtcaaaaggagaagtctagggttgtgctgtccagtatggtagctatgagccacaggcagctatttaaatcatttaacttaatgaaaattaaataaatttaaagttcagttcctcagtctcaccagccgcagctaaagtgcccagtagccatatgtggcttgtggttaccatatcgaggagagcagaacatttcagtcattgaagaaagttcttttggtcagcactggtctagcgaattcattgtgtagatttttataagagtgaaaaaaagcagcaaaactcaaagttcaaattctccgtagtgtttgagctgaaaacagaaatgtgggtaaatacgacgcttctttccacccactactttccacccactttccatgtttgggagggaaggagatgaggaacacagatgttggggttcttgccaagctttcacttaaagaaaatgaacagggacaacaaatgatcatgtttttataacccctgaggaccacagaacggatttaacgtgcatgtgcaacatggctcattgtttttgttgttgctgttttgtttccgcaggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaagaccctctgtctctgcctgtctctgttgccttttcatcattttgtgtttttgcagttatgatgttgacaaatatttattcaacatctaccatttattcatactactttatgacatataattcattttcttttactgtctctcatccactatttgcctttccctattcaaaatacaattcttttgcaacactcaaaatattctccagggaatttttaaaacacaataaaagaaagcctatatagaagt

SEQ ID NO: 2993 - DNA, 174863 bp, human
atttcgccgggttgcttttgtcttgcgggctcctgtcgggttcggtgtttccgctctgaagactgcgacgcgggctccgatgcagctcgctccctgccggatgggtcatgggattctaaacatgaggcaggtaagctcaggcggttgcgctggcggcggagggggcgggcgccgcccgggacccctgcgacgtgttactgcggagagcttgctgggttagcaggcgcctggccgtagtcgatgcgtttggcggaaagacggggctgcattttcctaagacaaccaaagaagcacattttacctgagccaccccggtctggtcctcgccacccgcccccacttttgcctctaattgtggttgatgtcaggcagtcgttgtaaagggcttacaagcagtttgtagaatatatgtaaatcaattccagtttgcggccgctggaatgtatcgtgcaggatgtatctcgagcttttagtgcctctaccctatgctttgggctagaataaagacagctgaatgtcctgaaaaagaatttcacggggcctcttatctcattttggtttcgcattctgagcacttactgtgtttctggcggagaaggcggaaccagcttgaaatgagcacagacagtccttccagaaaaatgcaaatttgtttttctgttctagcagtttggaaactgtattgcttctggacgtgagaaggcagccctgaaagtagtgagcggagaaagggctgggggattacttaaatgagtctttgaaaagaattctaaaccaacagcttcttctgtggctctggggcatgatgataaaattccttatcagtccaggaagaggtttatagctttgctgttaagcaagaaaaggaaagaaaaagtggatgtaggaagccaaggagagggtgtgatttacaactcaatcaaagttatggaagaattttatgtcaatatttaaatatcaagaacaatactcatataaggagaaaacaaggctggaaaaacatgccaataggcttggaagggcagggatttcaagaggaatgctattgcttttaccagctctgaataaatctggatgggaaagttagcatctgtatcgcaaccggaaaagctcttcactttttcttctaagtgggttgggtgctcgccaccctgcacactttgggggaagtgagctttccatttaagagcgcaggggaggggtttcgaactttctgtccctttcccacagccttgggagatgaagcagagcccccttcgaatggtcagcgcaaaccctccgccttcttgccccctcgcttgttcgctcagcaagcaggcttggcaagtttcagtgagtgcagaaaaacacttgcggaggagcaagtgccgtctgcttgcaatgaattgcccttgccttggtagggactgtggggaggacgtctttaagttctgcaaactcacagtccaacctcatacttttaatgtctactaaagtgggatgaggaaaaggaaggagaagggtaattggaaaggattgaaaaggaaaaagaggaacgcaaaacatttttgacaaaggtccttagctggaacaaagaagttatttgatcctgtgcagagccacctgtcctctcctcggtggtgtctgagctcaatttccagaatccctgttcccacacaattcctcaggaaccatggcagtctccgtgccttatgcctaaggtttgcttcccccagcttggaatggtttttcccatgcctagtttgttgtggcatttacgtgaagttggaaaacagcccagtattgaaattttaggggtacaagtacacatatagtgaactccttagttatttaatgaatgggcaacttttcatctcacagctacgtatgtctactaatttttttggcctgttcagaactttgaaagagggtgggatggaacaggggaggagatgaaggagagagacaggatcattgttcatccaaagaacgaggacagtttccagaatctagcatgttgttccactgcagtcagaacaagaatgtagggaggaatgagatggcagtgttattggcatgggttaatccctactttatttgagtttctcttggggaaacctgactgttgcatccaggcagggtgagtcgaattcaccagccaatttgtcatctcagcccggcagctccagctggatttacagggttaactatcaaacagacctgtgtgtcatcagctcagcaatgaaattggatctctttgctgatgagtgatctgtccctagggctgcacaaatgttgtacactggtgtggcagcccagaagagacccctgcctgccactgatagccagaaattctgggtagccagaaattgcccgcagaattagaaggctgtttgcctagctataagattcagaggggtttgggcttctgccaggttggcagaaaaggaacattcctgaagccaccacttcaggtgtagaaggatagtattctttgagggttcctaaggccacggctgagttaggccaaagaaaagtgtaaatctgattcaccttgatcaggaagtaattttaaaatatgtgccaacctgtctctgccctctgatcataaacgggaaacttttatgaaccttccttgagaaggaatttgctctgttcccaggcaaaaggaaaagcatggccacctgttctagaagcctggccgaaaacaacaggtttgcctgtggcattcccgcaactgcatatatcctccccacatggcaagccacccattgtccctacacacaagaagaacaaatagttcattcttgagctgggggaaaaatcagattctctaggcaaaattgcctactagacatattttgtgtttttaacatcctgataactttagaaaaaaaactctaagggaagaaggtgcatgatgtatttctgatctactaaaacaaagtaagtcacgtagctgctaaattcttgcaaggccaggatgctgctgtttcaaggaagccgtgaatctgtttggttagcccgttctgcattctttagattggaattaaaatgcccaaggacatctggcttaataatgaaagtcttcgtattaatctttcctctgaggattagaaagtcctttacaaacacgatctatttattctctgccacatccccaggagagaatgaggtggcaatttgatcctcattgaacaaatggtgagacgaaggcagagaaaggttaagtataaagagacacagcaagttaggggcaagtctggggatgaatactcacccacccagaaagactacctgtgcaggtttaggatctcaaatggcattctagggattaaaacagaatctctcttacgacattctttttcttatcattctgtaactggcaagtatattgtgtcccaagtatgttgtatggtttccttcatttgaaagtccagactcttaacagttcaaaaggcagttctgttctcatttctcccaacattgagatcaggcagcttttatgaaatctaatagaaagatacagtaactaactggaattttaaatatgcatctgagaaatgttccctttcaacagatgttttaagtttttgcacatggtttatagagctcagtgtcttcaacatatgttaaaattttaatttcttctctgctatctctctttcagcaaatgttataatcataagacttgctgtcagtttaaagatccttgttggtcattttgaaataatttttttgagtcatgtttttagttcgcttggctgtagaccgcataggctacaagcaaatccgttaattggtagttgcatgttatccacagacattccagcaagttttaaggctaagtgcatatgtggatgtctcctggctttgatcgtttgtgtggtaaatagacatccaaggtagctatggcaacctgggctgtgcgttggtgaaaggaggggatttagttactggacaaagagtaatttgtttgattagaaaaaggtaggggcaaatcaggacatttttaacccacatgatttgaggatcccagttcaatcaaatcatttggatttttctcaataggcaaaaagaagtaatggctaagcgcaccagagtatcttgcagacgtaatttaattatttttaaacaagtggttgctactttccaaaagcaatttatacaatgaaaaggaagtacaatatatcatataaatatcatcaatatccctattgtactaagtatgaacgtttttattttcagaacttgatgggactttgaaagaccaggatctgattagaggtgtgcatttcagttatctacctgcaggggtcaggcttgaagttcccgtggtcggaagatcaggcagcggacttcactgcagggagcccgaggcagagtcagagagaattgctctgcttatttggaacaattagttagcgattctttaatcttgtgaccaaagctactatgaaaatgagttcattcaaggaagagaatatcaaatacgctgtgattaaagaaagggcgataaagccaggtcaaacagcaatctaatctccgtttacatgtaaggcagtttatcgggaagattctggctcattatcaattcctttgatttcacacaaaagtgagctcagcggttttgttctagaaatttgtttgcccagttttatgagctggcatgttataaaaatttctttaaactaaaaaggacacaatattagggagccatctggatccgaaatatttttccccctctggaggaaaatattccattgacacaagatcaggatggttaatggcctccaggaggtcaggtgatagtaggagcacagaaaattgaggcgcagaacaaaatgccaagaggggactttcctgaaaaaacaaaccagaccaaagaaaataacttacctgctttgcgctatgaaagagaggttctgagtaaacatggaagaggtgctgatcatttgtagtacaagtggatgttgaaggtcttatattcagtccagtgtttatgatgaatataatataaaggctgtccttcctttcttatatcattcaatgacatttactgagcactcacagaattaatatattctgccacattatacgtgattattaatgtgccagggcactttctgggttccaaatatgactttggtaaggcccctgccctcaaagaacttttgatctggtgtacaatttattgtaccagtagcataatgtaggtttttccatggtcaaaatggatgctcattaatatctatatttgtatgggtagggatccacttgaaaaactgatggtatccaaaaccttactgaacttaggagacttgagaagtgatttgtaattgtgaaatttagttgatttttagcccacatgtccatttgtagaaatttatgacttcttacataaagcagatttctcataattattaaatagtaatttatttttctcaatagagaaaagtaactcataggtagtccccaatctaggaatactttatgttttaggagtttgttgtttgaaacccagagcattttccagcgaaaaataatcaatctgattaatgtgagatcaagttctgtgttttgaggacatgccactgtgttatacaggatggaaacagaaggagaaagaattggcatacttttggtaataggccagtcatggcaatatttgaaataggaagttcgtactagttttcacctttctttctccatccttctgatgtcttctggtctcactggggcatctcccccaggcctgtcctaatatatagtgaattcataattgttcatcttcccacccttcccttccccacctccaaaccactctcctgtttcctttagtcaatggtctctaccacatggcaggaaagaagtaatatgggtgagccaaagctcatgactcttatccctttaacccttaggatgaatctttaattggggaaatttcaagcagtggagcctggagctacaaaacacatgattttcctttcagggacaatatttgggggcagggccatgcctttggcagacagaacttgctggtgtgtctgcccgtgggtcagacctcttcatttgttctttctcagcaacctgcctgaacttctggacccactagggtctttgtgagtaacagccagggagccacaggcccccagttgagagggaattatggcgtttgtgggtttgggttgtttgtaagtatgctctttgtatgctgagcactgtctacttggattagaataaatggaaagaaaatagctgtagcatcctcttatccacacgagtatttgagttggtgtatatatttctactcgtttgtctgcttatcttggaactgagttactccagagcaagagtcacatattaattacctttgaatccccagacccaagcccagtgtctggcacacaataagaatcattaagtgttctacaggcacatgctgggtgaattttagtaaaaaagagaatggaaaatgctccttaaaatccgaagggatatgaagaagaaagggcattagaaaggtccgggaaacagcaaggactaaatagatcagtagtagagaaaattagcataggttatgattactgaactatatgtatatggttttatatatatatagtccatttatatacacatagtctctctctgtctgtctgtctgtctgtctgtctctctctctctctctctctctctctctctctctctatatatatatatatatatatatatatatatatatattcctttcagttgtgttctgggcaagaacacaacccaaaacatggtaagcagcttggcttatcctctgtttgattgttctgcagaaatgattacgaaatgggtcatgccctccaatagctcaaagcctaatcgccaagatagaatctgctgctttctctcattgaacccagcctgatagtttaggccttaggtccatgtgcagttgtttaattttgcaggtgagtggcatgcccaaggttactccagaactgagatagcgtgtctgagagaagactgaagccttctccatgtagatggtggccacatttttcatagtgaagttcaagatttgtgccggacaaagcattttcattgctggtaggtgtaacagaccagaagttatagttaaaaatgacaaaatagaaatttcagggacatttaatagtttatggaaacaacaggactaatatattaccaaagggtctatgcggtagactgtggtatctgtcctatgtcaagttttggagtgttgctttggttgtgtgtatttagaagtggtcttccccaaacaattcggaggaagggggatgttactgggaaaatggaattcattgaatgccctgctgagttaataataagtagatgaatggccaaataaagcaatatatagatggacggcaccaccaaatattattaatagagatttatttacttacataggatcaagtcttctgtacgaaatacattaggaatccagactaagaatactggttaaagtttagcatttctgggttgacgttttagcacaagaaacactttaccctccatctgggagcaaggtatgagggagacttaggttctacacctagaagctaagtcttctagactccccatctcattctcttttgtgactgtaccacatgccttctactaagatataatttggatgttttcaggtcatgtgctataattcaatatgctaataaattccaaggcaatttgaatggaatgttggtttataatgaggcaactcaggaaagactacatcatctttagtggaaaatactgtccaaaaaatccaaatagttaaatgatcttatatttgggttttgtgcttcttttatgtgtatattctttgctctgattttagttaagtatgaaaatgtcagacagcaaaaactaggaggattatatttatataaaagaaagtttagggaatgagatgagtcatttagcccatgaattaatcagctgtgctttgaggaaatagtgcaggaaggtaaaatggaacaaatagacgagagaagaaagcgtgacttcttttagtcaacatatgatggggaaagcggtagagaaaaattggctatttggtgagtgattcacttgagttccttttcagtggtcaatgtttaaagtgaaatcctaatgagattgttgctgccctttttgtacggctctgactaaaagagggaaaacagtcataataattaattgagaggggtatgactttctgagtagataaaaacatgatagactattagataatgaatatttattgcttgatgcttctcagtctggaagagacactttctgaatatttctccgctttctaacatttcagctgtcagaattgaatggttcacatataaactacattgttttggtttaactaacaaagagtgataagacatgaattgtttgtgacagccccgaacattgataacagaagacattaatgcctgcagacacagcctacatggtaaaaatctggaaacaaaaatgcttattatgttaggccatcgtgctttgacctagttttgcttttctgcttggaaattatgtcaatattagttacatcatcccttcggatgagcaattccacattcttgtttatttcagtgtcatattattagtttttgtatatttagttctgacctctgaggagccaaactaatcctcattgacttgcattttccttttgaaatgagacttctgcatgataaagagagaggattttatgtattaacaaaacaatctaagatgcctctttaaaggcattcatttctccttgatccggagctactgccctcttgaaggttcctagaggccatccagttttctgctgatcagaattagtctttttttctttgtcttatggggatggaatagattactgggcctagaactgccatagttgaataacaaaaagtaaaactgtgaggctgatgggacatttcccagcccatcatccttaaatttgcccttttcatgtttctgctttacttcttcatccagcagaaacgggcttagcatatttttcccatttaacatttttattgaatacttttcaaaatgaattatttccgcagttgatttcgaacacatttttttctgtcatttaatactttatatcactagaggaaagaaccatttaattctttcatacatttatgaattctaatcttcaaagagtgtgagttcttcaagtgatcaacttacatcaaatttacaagtataatttactaccaaaagaccttgaacgctttttggtgcacatgttttggcattccttattaacaaatgtaatgaggcaaaagcccacaagaatatgtattcctggttcctctttaaaaatgtaccatttgctcttattttctaattaaggctttgaaggttaaaaatccctttgttgttagctcctttacaagtctcctgcctgagtgcagaaaacataagaagggagtgtcctcttcagagcataaccaaaccaactaaattttaaccaggtaaattgttgattagcattggatcatgtaaagaaacagtatgaaagtaattgagataggcacaactcctaattgtgtgatcccagggggcttcaaacattgtttgaaacattcacctcagagattatattccatgtctgatccttatgctaatttgaatactaggatcctgaagaaaaactttataggatttcttgagtccctaattggtatgtaaacatcgtcattcccaagctgcccaaagttgtgaattatagtataccatgtgtctcctgttgtgatatcaatttctacagcaatttttctgcttgttgtaggcaaatgtaaatatatttccctcctcttacacaaatagtggcctttcacatacattattcttcaccctggcttttttctgctttagagtataccctagagatctttccataacagtccacagagagcttcctctttaaaaacaaaacaaaactgcatatcattgcactatgacgatgtaccataattgatttgacccttcccctactagtcacgtggagtgtgtccaatattttgccattaaagcaatgtgcactgaaaaacgttgtgttcatcagtttgtatggggcggatgtatctgtattaaaaatccccagaagtgggattgctgggccaaagggcaaatgcagtttctaattttgataaataaataacattgtctaaccagcctgtgtgagagcactgccccagagcctcatcaatagagagcattgtccaacttgtgcacctttgcctatctgatatctgaaaagcggcatctctgtgtagctttgcattctcttctgagtgacgttgagtgtctctgcatgtgttgaaggtctatttgcatttcttgtgcaatgtctgctcatatcctctgtttagaaaaacaaaaagaaggccgggcgcggtggctcacgcctgtaatcccagcactttgggaagccgaggcgggcggatcacgaggtcaggagaacgagaccatcctggctaacacggtgaaaccccgtctctactaaaaatacaaaaaaattagccgggcatggtggcgggcgcctgtagtcccagctactctagaggctgaggcaggagaatggcgtgaacccgcgaggcggagcttgcagtgagccgagatcgcgccactgcactccagcctgggccaaagtgcgagactcagtctcaaaaaaaaaaaaaaaaaaaagaaagaaagaaagaaagaaaatgccaggtctagtacaacgatgtttgatgggtttttttgacaatgataaaactactatttagtaagagaatcactcccggcagtagacttagaagcacactatcagagaccctcgagtaaagaccctaacgtgccacatcttaactctgtgaccttgggttgattccttaaacttcccaagtttcctcacctgtaaaattgaaatgatgtggacaactcacagggtttatagaataatcactaaatgaaggattatatatataaatgatatataaagcacttaacagagtattggttacatactaggcacttaaaaatgttaggttaacttctctttttttaggtacaaacttaaggtttcagagaaggctgggttttatggacatttctacctcttaccctctgaatgaatacacatccacccacacagaggcatgtaaatatacacatatgtacacacggtggaataatatctgaaatggctgtaatgattcaaaagcatctctttagacaaatgtgtgtgtgtgtgtgtgtgtgtatgcacgtgtgcatgtatatgtataaatatccctgtaatgtaagaaaactaatttgttgctaaaaatgtacccttttcggacaaattatcctaatatgctaaaacaacaccaaatagtattaaatggacatgatcacttatcactacctttcatattataatccaaaaaagcatatttttccttcatctatcttattctttacaacaattaaactcttttacaatgttacacaccttatacttacagctatacctagaaataaaattacacttatactcatgtttatgtatttctgtctttaaaacaaaaaaataaacacagcagtaaatacaaaaggtagaaatggaaaaaatgcattttagagggcatggtgctgagggctgagaatataacactggtctttaaaacaactctaccactgtgaatgagaccatttgggtgatcttgtttcccagggctgtgttgttacagaaacataattttaaaaattgtattttgaaataattacagatccataggaagttgcaaaaaaatgtactgggcagtctgcaccctttacccaccccttaccccatccctaacccccagaaaccagtaatcatctgttctccatctctataattgtgctacttcaagaatataaacgtaatcatacagtatgcaattgtttgagattgacattttttcccgctcacttaattttctagaggtttatccaagttgttgcatgtatcagtcgttttttcctttttattgctgagtaatgttccttggtgtggatatatgacagtttaatcatcaacttgtttaaggactttggagctattacaaacaaagttgctatgagcatttgtgtgtaggattttgtatgactgtaagtttgcatttctctgggataaatgcccaggagtgcaattgctgggtcatatggcaagtacacattcagttttgtaagaaactgccaaagcgtattgcagagtggctgaatcattttacatccccaccagaaatgtatcagtgacccagctttctctgcatcctccccagcatttggtgttgtccctgttttcattttagccattctggtaggtgtgtagtggtgtctcatttgtattggttttcaaaaagtgcagaagatacttcataatccagtttgggtgtgttcaatacctcccaggtaaaattctcacacataatatgggcctatcttggtacatgactgaattgtcaaaaatatctatgattgctgccttttttgttgaaccttaactgaaatattgagagcaaaaaagaaactgtgttgtgcaaaatatatccgaacattagactgggcttcaatttatactctgagacactcagagaattgttacttgctcaagacatggcagatgcacgccccaacacctaacttcactttaggaatagacacattaggtatcaggaaaaattgctaagactatttaaattcctctccccttttccaacatattccattgcctttgcatttgcataaattaaataggggcatgatctgtcttcattgtcaatatacatgtagatgtgtgtaaatctacaaacatacatatacacagacatacatacactggctctgtgggcgtcaatcccaaatgttccccaacatccagtctagattctcccgggtcaggatttctcaactttggcactattgacatttggggtttcataattatttgtggggctgtcctgtgcactgtaggatgtttagctgtatccctggccttaagcaactggatgccagtaacactcccatgcccccaaagtgtgacaaccaaaaatgtctcagcacattgcaaaatgtctactgggggcaaaataaacctccctttgagaatcactggggtagacagaagagaaggagaatctcaggcttcaggttacctcactgggtttgctgaaacttgataagaatctccttaccagcggggatcaggttttggtgcccacctgttcatttctgataactaccaatctctaaatctgtttctgcaagttatggctgaagattagtggttaacagagaacgatatcagcctttgtttcttaaagagcttatattcaatgctttaaaatacaaattggatctggcactgttgtggttcacacctgtaactccagcactttgggaggccaaggtgggaggattgcttgagccagggagtttgagaccagcctgggcaatatactgagaccccatctctacaaaacaaataaaaaattagccaggcctggtggtgcaaacctgtagtcccagctacttgggaggctgagtcgggaggatcgcttgagtctgggaggtcagttctgcagtgagctaagatggcaccactgcactcgcctgggaccttgtctcaaaaaacaaaacaaaacaaaataaaataaaacacaaattgaacacacataattgaaaagcaaacttcatgcatacctggttttgttttacttttaatgatgttttatcacttatattagatatcatgattattttaacagatacaaaatttaataggtaataaaatacctcataaaatagggtatatctccatatgcatagagaattttatagagaaattggcacaattcctggatcttcctctgattcaatgtgtttatctttgaattctaataggttttaaaagacatttaaagaattgcaaaacaggcaaaggaaaatatgatagtgttttataatttaaattatgtctacatggcaacaataattattatataaattatagaaaatgttatgtattttttaactttataaatttacccctacttgataaataatatattttgtatttattacatttggtatataaatatatttctactttagaattaaaataaggtgaaaatagttattttttgaaatactgttaagttgcatattcttacctgtattagaattaaaatatgtatcttatatttatatataaattacaaattacctgaaaaaagaataaattataaccgcatgtaaaaataaaatattcctgtatcagttgtgcaatttaaattccggttttagttttcattctttaagttgttacatttggaagatttggatagtagttatcatgaactcactgttatctatggctctgacagtaaaatacgccattgagttgtactgtaatatgaatctcccgggaacgctaagccaattcagaatgaggcattcctgtctcaggaatagagatttataaagtgaccggaggtatcactatttctagaggaaggtgcaccttgaagtattctcattcttttctatgcatttatgatcccagcctactaaactcaagcaacacttcaatacagcaaagcctcttggaagtatatgagtttaataagaaaatttatgaagaaagaatacactgaaatgcagactgacccccaaaataataggatactttttaaaaaatgtattagtttcatagcatggcaaataatactcaaaaatactttgaaaatgcacattttaaaaatgcccaaagggtttagtagattatgttgagagaaggcattggaggaagaaacattatagccataagaaccaggaaaatgatcctcctttgtttataggattacaaagaggaattttaacttctaaagtgaaaatacaaattacttgtgtaggctaaaatcacccttcttagaggaaatggtacaaattttcttcatatagtttatgttcctccagaaagtctctgtgaagtgataacattataactgcatgcattctcctggtgacttcatttaaagtctgtgatgtagtaacatcatgcacacttccctttcctacagagcccttatgttctctatagaccaagaggttaattaatttttagagttatatagcaaagagttgccagaaccccaaataacatatctctaatttccaaaattgcctgacaaactatattttaaagaagccatgttattcttaggataaacctaataatgtcactttaatccccagtcatgctcatctttgcctttcttccaatatgtgcaaggaatatataaggtgaccttttaaggttacagtatcttcttacaaattagagttgatgcactgaggttataacagcagctgagcattctcaaaagctgcagattgagccgacaggcagattagcaagtacataaaatgttagtagagaaaaaaaatagacttcaattttttggcaatcctgttaaacaactctgtgaataagtctttgaaacttgtacagtggaaggtttgaattttcctcaatgcctggcacaaaacttacctatctgttgcatatgtgcattgctgaattaattaatggaaagtaaaattttaaaatgtaaccttggttatttgggataaaatggcacttccatgtaatggaatgtcataactgaaattgtagggattttcagatactctagctggcactaaatctcatcagagcccttcaagttataacataagatagcatattcaatatgagaaaatatttaattgtcagccttaaaaatgtatatagcagaggcaatcccttttttttctgacaacaaagccttctaaaagcttttcaaactatacagctttgagatttataactttgaaccaagaaaacataatttcaagaaatgaagagaacttctgattaattctagtctaaggcagtgaagtcctgctagattttaaagtattatattcttcataattaatgtcaagataggttcctccctgtggctcattattttcttgtaaaaagtacatactgcctgtgtttttaaatttcaggttttctcatgccgctcttgtctaatgatccagcaagttcaggcatataatacttttgaagaatctatatttaaagactaattatttatgcatgtgtgtctatgtattttgaaatatatatatttcaaaagactgtttttagcctttggctcaaatattttttttttaaggaatataatattgaatatctggacaggttaaaaatctccaacatttaactataaatgttaactaatgctttccttttcatttgttaaattgctgcataaatgctttaaaaagtatgttaccgttggcattaagacatcatctcttttacttaccaaagtgcaccaatctttgggattgaaccattgtagctgctttaagccaaaaattctccccagccgggttccttatcatcacccttgccacagaatctatatcgttgggagttaaagatctttggtctcaaaccttatcctggttgaattcctgtcatatcaccagcaacccctttctaatggcccccaggaatgctagcacaacaggggatcttcaggaggctcattccaatgagagacatcatttgcagtgacaaagtttgtccttagatgaaatctgtatctctctctccctatagcttttacccctgtttggccccctctctacaacacagaacacgtgcagttactctgttctctgacagctcttcaaagacaaagctaacatggccttctgggggcattttttccaggttaaatatgcccagatgtgcttgatttggactctatcctttaggatcaagccatgttagtaagtacaaatgtccaacatttaaaagaactgttcataagagagactcaccagattagaggaaagagataccattcagtttctaatacacagtgaccttaatgccactattttaagctctctctgcctggattgtagagactttgcctagtttacctctggaatagaaattctgaacctttgctagtgagtgagcaataacaatgatgacagacatctagctagatactaagaaaaaaagtcatgaatgaccaaagtgtgaattttgtttctttgcttgtctgataccccatggctatttgcaatatcttattgtcatgtgctaaaggatttaggatattaatcaaagagaaaagcggttctaagatggaagaaaagacaaaaatgtgggcagataagtaggaaaagaaggggatgaggattcaggagctttttccaggtacttggaaagttgaaggcaacttaaatcatttttaataatttaagaaatatcatttttcatttttatataaaatactaaaagtctggaaaatatataggcaggcacagtgtgttggcaatatgctgtttacaggttggcaaaacaagccagtgtctaatgaaaaggaaggttgcgaagagcttagatctgaaactgagaggcatgtcttgttccacaccttgagaaacacttggcatataccaggtgctctgtaaatatttgcttagtaaatgatagaatgagcatgtggtggcagaatgatgccttacatggcattacccagactcataggcatccctagggactgtaagaaaagtttgtgggcttttttcagcgttttgaaaaacccagaagatattgtataattactttttcaatgattgttttatcaaatacttctaaacctgaggatttatgaagttaaaagtgaaaaggttttttaaaaaatgttatgccaaatgagagaagccagtcacaaagggccacatattgtatgatctttttatattaaatgtccagaagaggcaaattcatagatccagaaagtagattcgtggttgccgggggataggggaggggagaatgcggagtgagtgctaatgggtatggggtttcttttgggagtgatgaaaatgctctggaattaagtagtggtgatggttgcaaaactctgaatatactaaaacccactgaattatacacttgaaatggatgtttgtaatgtgtgaattgtatctcaataaagctgtttttaagaatgataagcatagcatccaagcatttaaaaatttttttaaaagtggtcattggtggtaaaaaaaaaaaaaaaaaagtcagaaactatttgcttaattgttacagagattttatcccagattaaaatactccaattccgcactttgggaggctgaggcgggtggatcacgaggttaggagatcgagaccatcctggctaacatggtgaaaccccgtctgtactaaaaatacaaaaaattagccgggcatggtggcgggcacttgtagtcccagctactcgggaggctgaggcaggagaatgggcgtgaacccgggaggcggagcttgcagtgagtcgagattgcgccactgtactccagcctgggcgacagagcgagactctgtctcaaaaaaaaaaaaacaaaaacaaaaacaaaaacaaaaactccaattccatttcgccaaagggaacaagcagaatattcccacaaccctagggaacaggggtaggcttggctattagtcattctccttcttccccattcccaataattggaaaaaaaaatgtgtgtgcacacgtacgtgtgtgtgtatgtatatgtctgtgtgcatatgtgacaagggcagtagtcagagcaggatcatgtgactaccaggatctatggacagccccacactattaggggagaaagtgtcaagctatttgtacggttcttatagagcatgaatctaggccaggggtcagcacccttgttcataaaggaccagacagtaaatattttgggttttgtggccatgcagtctctgtccaaacccctcagctcgacatagactatataaagcaattggaggtaactgtgttccaaaaaaactttatttatagacactgaaatttgaatttcacataattttcacaagtcacaaaataatatttaaacaatttttttttcaaccacttaaaaatgtaagaaccattcttagcttgtgggccacacaaaaacaggcagaggcctggatttggtacataggcggcctgtggtctatagtttgcagaaccctgctctagggtaatgactgagaaagggactctactaatcagcaggttgttgggaagcacgttacttaccttaagccagtataaaacttaaagcaataatgctacattatgtctaaaggctaagctagtgagaggctaaattataacactcaacttttttagcaaataattatgaagcatcagctaataagaccttttcttaagagtattcagagtataataatgctaccttgtgtggtttggggatttttattttaagttagggaagctatgaatctcttgaactttgtccattaagaagtctgccaaagctgtgaattttaaagccatgggaatttttcattgcgcttggctgctgaattttaacagcaaagttattcattaagtccacatttaaaaaaaaaagtatcaacaatgcttctttatactttatctgcatttgacacacttccagatagatgatctttaatttgactaatgagtgcatcctttgttattttaatgacaagtaatttacagaaagagaaaagcttttcaacacgcaagtctcttaaatctggaatttaaagtccctgatgttcagaagcaggaagcaacagttggtgtaagacagggccactaggacactggaaatgcatcctgggtaatgagtgggaaatacaaaaggaagaaaacagttggaaatatgttggccattttatatgacactttctgggtttattttcaggttggagcacaagtcagaagctgaagaacttggagattttggggagcatatgtcccaccttccccaacccccaagtatccaaatatcccctttggttctatcagagaagtattaagatttattaattagaagaaaaattaaagttataaatgttcaataggaacataaggagaattcaaaaaaataaaatgttgagctcaccacagttttcagcagaaattttactcttttttttttctttgttgagatggggtctcactatgttgctcaggctggcctcgaactcctgggctcaagcgatcttcccacctcagccacccaaaatgctgagactacaagcatgccactgtgcccagctaaattttactctttaactgatttttcaatgcataaataaatgaataagtgggtaagtacttactgaggacacagttttcaaccaaaccctgtagatactcaggatgaattaagcatgggccctgccttcatggggcctagggtttactcaactttacagaaaacccagaaatatcctaacaaatgtggcaactgaagaactttattcctaatcctaaaactcactttctttattctcagagcaatggatacagcattctaatgtcaaatcattgtttccatgttacacaatactctaactgtcaaggctaaaccctgtcttaaggaagggtgacaatggctttgttcttatgataatagaagagataaaaagattatttacaaagctacagcctctgaaaaattggaagtattttatacaaacaaccacctcaattcttctcacagtgatatttaagtgtttgtgcgtgctggtttctgttatgtgggtctttaccattttcattcctccttgcagctctatgagttaagtattactattattcttttacaaatgaggagcatgaggcctggaaaaatttaaaaacatgcagaggtgataaaatactgggaaagtttcacattcaaccatgtctgatgcttaatccttttccttctctttccaccatagcatatgatcatggcatatcatcactgtttctgtttcccctatagaaaattcaggaaaattaacacatggaagagtattcagactttcacttttcttcttacataatctttgagcagcccattataggaaaataagggcattggagatttgaagaggcagaatgaacacgttctagatgtagaaagaaaagttctaagcaggtaaaagacaaccagagtgaaatacaccagatggatgcttgacttggagaagatgctaagcactaaataagccaggtggtagagggtgtgaaagcggagagccctgagaaattgatcattaagcggaaggtgattaaaatcttcctaagggacagttggtcagagcagaggtcaagagctaggacttgtctggcaagacttattgtggattcttgaagggttaagaagtcagtcagagacccgggattggatactgtatttgaactgattgtcactcaccagaatctgtgatctaggagacagacattgccaggatcccccccgtcaggatggtcatagagaagggaaggtgtgttcatttactattgctgcatagcaaattagcacaaatgtacagattaaaccaacaccccatttattagctcgtggctctgtaggttgcaagtctgggtggcccagctgtgttctctgctcagggtctcacaagactgaaatcgagctgttggccagacgaagctcttatctggaggccctagggaagaatttgctgccaagctcgctctggttgttggcagaatttactctctggcagctgtaagactgaactccttgatagctataagctgtggtccactctttctaagggacatctgcattccttcttaagtggccatctccaacctcaaagcaacagcacattgagtccttcacacacatagaatctctctaaattcctctttcatcagtcaggaaacgttctcagcagttaagggttcatgtgattaggtcaggcccacctgcatcatctccctttctaacatcaactgtgctctgtaacacaacacaatccaaggagtgatgtcacattcacaagttccagggcttcaggtggacatctttgggctgccattttagaaagtctgcctaccacagaaggtgatgaagaatctcagctcctgccttgctccttggtgagctgtgtgacctgtaataacagcagctttgtggaaaattggcccaccctttcctagggttaaagggccaaagcgaagttttgtgactttttcttcctcttctgacactggcttcttcctctaaggaaatctgctgcttttggtgttctcttctttccttcaccatctcctggtgttggtgccaagaagcactggaaggcaggtggtccatcaatttagggcaactgaaggttttgagatcaaggcatactggaggcccagacatcacaagagggcagcacagagcaagagctgataaatgttgagatgcagacttagcaggccctagctctttctgagatgatgtgttcatctgccctcaaaacatcctctcactcaacatgtgcctcctaacccagaccccaaggagtctttagtaagaacatggcagatatcacatgtgctgaccatggggttatcacaaaacattaactctccaaaaatctgctgcttggaaccttggtttctgcaactaagaaatgagttaaaaatgtattcaaggttgataaatttaaaatggaaaaaatcatcttctgaactctagcaatatgaaggccactttttacaagtctgatgctgtagtgcagtgtttacaacctattttcattttcaaccccctgtcacaaggagcctgttgaaacattttttgctaattgctccttgcatgaaattttaataccacaaatatagtataaatctatttatgtatatctgtgctttgtgcataaaaagagtaaggttttttgtttgtttgtttgtttgtttgccactgagaactagttttctcgctcttgggggcaatattgcccctattgacagtgcatgttataatggggaaaaattgctaacattttaatatttagtaaatcttcagcttatatagtctatttgatttggaaggtggctgtaatactttagttgtactaaaaggtacttgaaattaatcttgaaaagtcagaagaatctttacacatgaaaaatcacccaatatattatatttaaaataacaacttgcaaaacaaaacgtaaagtctgatcccatttttgtggctaagaggtacagaaaatgactagaaagatcaacctgtggaatgttgcttctttgcggttagatccttctataggtgttttgctctttgggaatgttataaatattcaccaatatacattatacatatgtataataaatacatattatattcatgtcaagaagaatactatttaaaaagttagccattctctctctctctctttttttttgccttcaacatttaggattaatgggcagtataaattcaatcattcacatgtagcaaaaggagaaatatttcacatggcccattcatgactcctttagatctctagagggcttcaagcctcaaagtttattgttgcattcttcttaattctggttgaatgcatgtacattattttctgcaaagaaataccacccactaaagactgttccttctcttctaacagggttttggtgtccccagggctcccttagtcctatttactttggatatttcaggagttactgtaggtttaactgtggtgagtccttaagccctctttttaaattcataaactgtctctaatcttagcaaaatgtcaggttacacttttgagaggtttgggaacttgacattttgtagcccagttggggtgtaggctgcttctattctgagcaccttgttccaatttatgtcaggaggaattatatacaggtcagggctgggagcaggttataattaatggggtggacaagtggatttttaatgtttcataaaataaaatggaaatcacatgttcttggaactgttgtatgttttaaaatatttacatttattctagtaaacattaattataactgatatatttctcctatgaactcgctaactgtgaggtcacaagccattgttcactgagtagaaagaatgggtgacaagctagttacaagaaaaaagacagtacttgggcgggtatcggtgagtgaactcgtggaagtaatccagtcttaggtctttctcctaattttctcttatgtttaaagcacccccttgccaatatgatccagatgtcagtccttctaagacagaactgggagggtttagcctgtgaaatttctgaatagctcctggtgaagaaggaacacatgaccaatgtttaactatttgtcttttcaaaattaaagtttagaagtagttgaaatactgccagaatctacagcgtccacgttttattcatattagtttatcaaaaatttccaattccttgaagctgtagcagcaatatgttgctgaggaaagaaattttttttaaaaaaaatttgtacttataattgacacctaataattgtacatatttatggggtacaatgtgatgtttcagtacatggatacacagtataattatcagattggggtaattaccacatccatcattttaagcatttattatttctttgtggtgacaacagtcaaaatattctcttctagctgtcttgaatatatattacattgttatttgctgtagtcaccctactgtgtgatagcacatcaaaacttactcttcttgtctaactttgtgtacctattgaccaatctctacccgttcctcccttcccccataccctcagcagcctctgggaaccactgttctactctctactgctatgaaattgacttctttagattccacatatgagtgagatcatgtggtatttatcttttttaatgtttttaaattttattttattttatttataatttgaatttttattttagattcaaggggtaaatgtgcaggtttgttccatgtagtaattgtcttctgtgcctgacttattccacctaacataatgtcctccaggctcatccatgttgccaaaaatgacaggatttcatcctttttatggctgaatagtattccattgtcctaatcatccccataaagaaatatattttctttatccttttgtctgtagatgggcacttaggctgattccatatcttgactattgtgaagagtgctgcaataaacatgaatatgcgggtgtgtcttcgacatagtaatttcacttccagaaagagatctttaagagtcagaaaaacccagattctaaactggtctctgccatgtgccagttgtgtggccctggagaagatgctttaactctgtgtctcagtttcctcatctgcagaagggggaaaatgatacccactatttagggattgggtagggattagacccaatttgtataaagtgcctggcatattgtaggtatttttttaaatgccagttatggatatatgaaggaaagctccaaaaaatgaaattcaaaggaagccttatgtaaattgcatcacatgtcaaccatttgggtgttaggaatattgatgcattctttattttgcctagaattcatcactccctaaataaatattatttccattaagtcaccaaattttatatatattctttgtcttgtatggtgaagaattaatacaagtgcgctactctattagggtataacagttacctaagtaatgtatcatgagacctttttgcccttttctaaggaaaataagtatttattggaaggacaacttcacacacagtcagcaggtaataatccgcagtacttcccaatgctgcttctatgggctggaagagtgtttggtggttctatatggcacagggctacttgtccatacccttgacccaaggatgtcacgtgcacccaatcaacctggaaatcactgtggtgacagaagttggggcccaatcaccctcagggccttgacactgattttgagtataccagtttggaaagtctctgcagaattccccaagacattaagtttataatatcccttgaggggtccttagaaagaaaaagtgcctatgttttggtgtcattatcgttcttcagggcaaggcttggtgaaaagatactgagagaagacagtacagatagaaggacaaagcgaacaaaaataaggacccactgattttatctttgcaagctctaaactgagttacagattgagatctaaaatatatactcaatacatgcatcctcaaaatgttcttcacacatttgtgcccaagacatagtagttgataatattaatacataaatatatatacacacagatatatatgccttacaatacagtcctatttttagtgtgtaacaactgtactattttcaaaatagtcatcggcacaaacaccagtaccacggctaaatctgacattattgatcttttctccctctaagaatatcttttgtaggcccataagtgagagatggcagatctcctgagcttcattcagtcctttatggaaatatttatgaaaaccctactgtgtgctcagtagctatcagagttcttggcatataaaagatttcaaaataaatttgcctagtattgctttgggggatgaggacttggtgatatcttcctctccccaaaagaaaaagtggtgtgtgtgtgtgtgtgtgtgtgtgtgtgtgtgtgtgtgtgtcagagggacagagacagaggtagagagacagagtgtgagagtgtgtgggtattcagagagagaacatgagtcccagtcttatccttatcttccctcatacaatgcaagctatttggaattgtagagctggaagtgatcttagctaacattttcccaatctcctacccaatacaggagcgtcttctacaataaccttcatcaaagggtggaacgctaaaatgtaagactagaggtctctttttgttgggcaataatttgattcaattatggtgtcattatttggtaactcaggtggcacagtataaatttctgtgggaaattggaatggggagcccaagctggactggacatgactgcaccatggaaggaggacatttgggaccagtcttgagctgccattgtgttccactgggaaactaaacactagtgctttctcaattagtttatatatttctcaaagtattccatagtctttagtttgtgctaacaaaattgatcggaagtactatattaaaattatcattcattttttactcttactgaacagcagtgagaaaagcaggaatctttgtcattttgtttagcatgtaaatgcacaaaaacctcagcttacctgaactttgctaaaatgtcaaacctttattaaccacaagttttctacattatacttttcctaaagatttgtgaaatacaaggaagaaggtgatattatgaattactgtaaaaatccatggtcatggatacaattatacattcaagtcaatctcctacgtcatctctatttatgatcaaatgaaaaaaggtctttttaatgatgatctcaaggaaaaataagatttgaaattacctcaaacttttcaattagatccaatatgtgatttgtagttatgcaagtaaagtggactcaagcattgtagaaatgtttcaattaggattttttttaagttaattgagatttgatcatatttttattgtcatctttgttcccacatggaaattaattccatttcagacttatttcttggagggtgtttagcatagttatcaccttaaatgagtagggtagggtgcgtagggtggcttttcatttttggaatttaattattactctctctatatatatacatgtatatatatatgaaaaagaaagagcttgccttggcagaagtgtttaaagaaacatgagtagttaatgccctcactgtgatttgacttccatcttcctttttttaagcacatttttcattttttccccctttaaacctgccatttagagctgaaaagtatttttcaagaaatggagcaatgctttctatcccatttattaaagtaatgcacagaaggaaatgcaccgtggtaaaaacaatttatacgagaaatgataatgttttgctaaagataaccaggaagtgaggaggagaaaaaaacccctcaaatagcagagagaggccagatggtctttttttttttttttttttttttttttttaacgcagtccctaagcaggaaattttgtttgattaagaagacactggtcttgattttcattcagcagttttgaggaactttttttaatggacacacacacatatacacacacacacacacacacacaccacaagccattttcattcagccaaattatcatttgtgctattgtaagcaagattctgctgatgaaaatgtgaagtcttaatgataaagaagaaaacgagttcccaagtctcagttatgaaagaacttggaatttacccactaccctaaagacgctcgatcattaccatatccatcatattgttgtaaggtctggtgttttgttttgttttcttttgatagcctggaatggaagaaagactgtgtaccacagtggctaactagggttttgtgagatacagggtagacccgggggaaaaaatagaggttttggagttcaacaccccagggggctaatgtgcataaagcgactgctccaaaggacctgagtttaatccttggagctgccagtcaggatcaggatgaagaagcacccatgcaaagaattgcttctggatgctgataggcagggaggtgaagggggggaggtgggaagggggaacggagcacccctctttggactgtgatgttttggcagtcggtgcttggaggagggtagctggcagtggctccggcacaataaagctcccttcggtgaagtcaccagcatccttgccatggtctggcaccctttgcccagcacccctggagtgtgcaatttcccagtctgtattctaaggatgaaaatgactaaagttgtgaaactaactatttgcatctgtttcaaagagaaagagtcacttggaatttggaatggaaagaatagatttagacaactggcagaattgttcggaactatgccctgaatcaagagaccctgttgacttatataaggacaagctaaaggagctacgtaaaagagagaaccaacatatctttaccatgaagatgacaaatcaggcattcaaatttgttttttcaaaaatgaaatgtgttctcatatagttgtgtgatactttctctaatcagtattcatatttatagtcaaaataagtataacttcactttaatatagcttagccaccttgaaagctcactgttcttaaagctagatttttttgtaagtgaatttttaagccctagattgcatcttaagtactgagttattttaattttgcctttttttttaatgtttaaaagccagcttcttgtctaatttgattcaatggataaaatgtacaggatgaaactcacacttaaaatgcatttcaatgagaattaaattgtttaaaatgaaacttttttcctttaaattttaaataaacaaataagatgcaaagcaaaataacaacaaaaaactcttaagtcaactcccttggggataagggataaccttagggataaggtcataccttttgatattaactccaaactcatgccttgtattcgtgttttacaaattacatttataatttatctcaaagataacaaggaagcatactttgataatacaagaagaatctctcagactttagcctgccttgagaatatgttttaaaagccattagaagcttcctagcgtttatgggatttgttcttatatagagtacatttttttttacatatattttgggcagaattctcaagtctccaaataaacagtttaaatcttggcttttaggccaaaaagtctttgggctgggaataactcaccctcagaagactacttgctttataacccctcccctggaatgctgcgaccctgtcttcccacaaaccttatttgcttcactgtggaagagtggcacagggcacccaccacccagacttcccaagctcttctcttggtctctgctatagctacaatagcaactttattctcctacaactgagagaagagagacagaccctctcatattgttgtatattgttttatactcagaaaaggaaagagaagcaaaactaaaggcaggtagcccggcgcctaagaaccagacgcgaaaccaaggaaccagacctgaaaccaggcctgggcctgcctgacctaagcctggtagttaaaattccacccctgacctagcaactgatgttatctatagattatagaaagacattgtaaaacttcccggtctgttctgtttcactctaaccaccagtgcatgcagcccctgtcacgtaccccctgcttgctcaatcgatcacaaccctcttacgtggaccccccttagagttgtgagcccttaaaagggacaggaattgctcactcggggagctcggctcttgagacaggagtcttgctgatgcctctggccaaataaacccctttcttctttatctcggtgtctgaggagttttgtctgcggcttgtcttgctacatttcttggttccctgaccaggaagcgaggtgattaacagacggttgaggcagctccttaggtggctttagcctgccctgtggaacatccctgcgggggactccaaccagccggagcgacgcggatcctgagagcgctcccgggtaggcatttgcccaggtgggacgcctcgccagagccgtgtgtggcaggcccccgtggaggatcaacgcagtggctgaacactgggaaggaactggcacttggagtccagacatctaaaacttggtaagactagtctttggaacttgcccactccatttgtgtggaagcgtggtctgatcacccacggcatgcctttatcggcactttggttttggttttgacttggtttgaattgcttgacggaactggtcttgggaacttgcccgctccatttgagtggaagcgtggcctgatcacccacagcgtgcctttatcagcactttggtgttggttttggttttgacttggtttgaattgcttcacaggactggtcttgggaacttgcctactccatttgagtaggaacttgcctactccatttgagtggaagcatggcctgatcacccacggtgtggcagtaccggcactttggtttttgtttttgacttgacttggattgcttgatacttggattgcctggattgcttagttttggttttgacctggcttagatttctggatactctaattttggttttgattctggtttggtgtaaactgcaaaagtgtgtgtgtgccctttttacctgttctttgttttgtggtgtgcgtgtggtgtgagcatggtgttttgtctcaaagaagcatgggtcaggcacaaataagcccaccctactaggaactatgttgaaaaatttcaagaaaggatttaaggaagactatggagtactatgacaccaggagaacttaaaactttgtgtgaaatagactggccagcattagaggtggcttggccatcagaaggaagcctagacaagtcccttgtttcaaaggtatggcacaaggtagcctgtaagccaaggcacccagaccagtttccgtacagagacagttacagctggttttagatccccttccccccacagtagttaagagaacagcagcataagcggctggcagaggcaaggaaagaccagcagacagaaagagagaggcagaaagagaggaagaaacagaggcaaaaggaaagtcagagagagacagagagacagaaagtcaaagagagaaagaaaaagagaaagagagaaatatacaagtagttaaaaaaaaaaacaacagtataccctattcctttaaaagccaaggtaaattaaaaacctgtaattaataattaaaggtattctcagtaaccctgtaacactctaatactactttgttgtcagtgtaaacaagggcatatcccaagagcactgaggccttcctatcaaaaatccttaacccagtaacccgcgaatggcccagatgcattcaatctgtagcggcagctgctttgctaacgggaaaaaaaaaattatgcaaaaaatgttgtataatttaaaagtactcagtactattgaagaaacagtttatgttcaaggtgtataagaaaagtaaaatatacctttggtaaaaggattataaggaggcataagaatgtggatttttacctacattaaaaggttaaaaaaattattgttttgaaagtttaagcgagttttgagacgttaattgtaaagaaaattctgtgtgtaaacatattagctaaagttaaaaaggtatcatccagtttttctgtgaactggacattaaaataaaaatgcaacaggtttttcttaaagcaccaacctgctctttaacaaaaattatgaaaggttaaaaagagtatataaaatcttgcttatggtcaaacattaaaaattagataaatatgtctacaaggttttattaaaattaagtttaacatcaataacactaatataaaggtaaaatttggcttatctagtataaaaatcatacagaaagcattgttaaatgtaaaatggtatttggctttctttggtctaaaaactaataaaaataggtgctaaaggaaacattcattttactagaagatcataaaagttaaaaacttaaaacaaactttggcaattaagacagcataccaagatgcaaatgcctggttggaatggatcaaatattccatgtgcacgttaaacaaaagcaattgttatgcttgtgcacatggcaggccagaggccctgattgtcccccttccactaaggtggtcctccagtcgacaaggcatggactgtgtggtagttcttttccaggattctacagcctggagtaataagtcatgccaagctctctctgctatatcccaaagtccggcaccctgcgggtcagcccccgagggctgtccagcctccgtctcccaacactaagttcacttcgtgtctctcacgacagggaggaaacttagcattccttggagacctgaagggatgcgatgagcttaagaattttcaagagcttatcaatcagtcagcccttgttcatcctcacgcggatgtgtggtggtattgtggtggacctttactgggcactctgccgaataactggagtggcacttatactttagtccaattggctatccctttcaccctggcatttcatcaaccagcaggagaaaaaataagacattgtaaagcgagagaagccccttgtaggtctttcaactctcatgtccatttagacgcaattggagtcccatgaggaataccagatcaatgtaaagcttgaaatcaaatagttacaggatttgagtcaatattttggtagatgacagttaataaaaatgtagattagtaaactacatctattacaaccaacagcagcaagcttttcatgagttaaaagaaaaactcacgtcagccccagccctggggctacctgacctaacaaaaccctttacaccctatgtgtcagaaaaagaaaaacatggcagttagagttttaacccagactgtaaggccctggccaaggccagtggcctatctctcaaaacaactagacggggtttccaaaggctggcctgcatgtctaagggccctagcagcaacagccctgttagcacaagaagcagataagctaactcttaggcaaaacctaaacataaagtccccccatgctgtggtgactttaataaataccaaaggacatcattagctaatgaatgctagactaactagataccaaagcttgctctgtgaaaatccccacataacaattgaagtttgcaacactctaaaccccgccaccttactcctggtatcagagagcccagttaaacataactgtgtagaggtattagactcagtttattctagtgggcccaacctccaagaccatccttaaacatcagtagaccgagagctgtacgtggatgggagcagcttcgccaacccttgcaaagtgactctgaagaagacgacaagccctgcttcagtcacacccagaagctaactggtccatgcacggccgaaacatgaggaaactcatcgcaggactcattttccttaaaatttggacttgtacagtaaggacttcaactgaccttcctcagactgagggctgttcccagtatatacatcaagtcactgaagtgggacaaaaggttgctacagtcctattattttacagttattataagtgtactggaactctaaaaaaacttgtttgtataatgttactctatacaaggtatgtagcccgggaaatgaccaacctgatgtgtgttatgacccatctgagcctcccatgaccatagtttttaaaataagattaaggactgaagactggtggaggctcataaacgatacaagtaaagtgttagccaaaacaaaacaaaacaaaaaaagaagtgcccaaacaagtcaccttgaaattcgatgcctgtgctgtcattaataataataggttaaaaataggatgtggttctcttaattaagaaagaggctatatggcagaaaataagtacatttatcataaattaagactgtgtaaaaataaatgtggatactggtcttgtgtcatttaggctacttggataaaaaaaaaaaatcctgtccaccttcagcaagggaaaagtggcccttcctgtaccagtggtcagtgtaaccccttagaactagtaataaccaacccccttaatcctcactagaaaaaagaggaacgtgtaaccctaaaaattgatggagctggactggatcttcaagtaaatgtcgtggtttgaggaaaagtttataaacgctctcctgagccagtatttcaaaccttctatgatgaactgaatgtgtcagtaccagaaattccaggaaaaacaggaaatttgtttttgcaattagccgagcatatagcccagtctctcagtgtcacttcgtgttatgtatcagcacaagtgtaaatatgtgaatcattatcaatctattgcacaggaagacataagtagcaaaaataagagtgagaactcccactaataaaaagtgagagtctcaaaggggggaaatgagagaagagagacagaccctctcatattgttttatattgttttatactcagaaaaggaaagagaagcaaaactaaaggcaggtagcccggcgcctagcaaccagacgtgaaaccaaggaaccagacctgaaaccgggcctgggcctgcctgacccaagcctggtagttaaaattccacccctgacctagcaactgatgttatctatagattataggaagacattgtaaaacttcccagtctgttctgtttcactctaaccaccggtgcatgaagcccctgtcatgtaccccctgcttgctcaattgatcatgaccctctcacgtggacccccccaccttagagttatgagcctttaaaagggacaggaattgctcattcagggagctcggctcttgagacaggagtcttgccgatgcccccagccgaataaaccccttccgtctttaacttggtgtctgaggagttttgtctgcggctcgtcctgctacccaattttctctgcgattattttccttctaaccctttcttaaagtgatgggctctaaaaaatcatgattcagctgctattgcaattttacctagccagtgaatttatttattttgagatgctttttgatattattgtcattgtcaaatgacattatgacatttcaaaagacattggctgtcagccagtgggatctagtcttaactcatctttggtgctcaccggtcataaagctgtagtcacatgtgtttatttcccccagcactcttccctcatttccttcctttccttcctgaaatttcctcttccagtggtgcaaaagctggtgagtaagtactgacaaaaccaatgcctcttccaatgtctctattcatttccttcctgtccatccctataagcttaactgtacatccatggttattttcaactttgagttaacatcgtagaatcaaacacttaagatattcaggtaattctgaataccatatgctatggtttgaatgtgtctcccaaaattcgtttgttggaaacttaatccccaatgcagcagtactgggatgtggggcttaatggtaaagcccttacgaatggattaatgccgctattaaaagggtttgtggaagtgggttcttcctctcctgctcttttgccatgtgaggacatagcattcctcccttccagaggacacaggcttcaaggtgccattttggaaacagagataccaggcccctaacctgctctctgttcttcttttttttttttttagatggagtctcagtctgtcgcccaggctggagtgcagtggtgtgatctctgctcaccgcaacctctgccgcccgggttcaagcaattctcctgcctcagcctcccgagtagctgggattacaggcgtctgccaccgtgcccagctaatttttgtatttttagtagagacggggtttcaccatcttggccaggctggtcttgaactcctaatgtcgtgatccacccgcctcagcctcccaaagttctgggtttacaggcgtgagccaccgtacctggcctaaatcgctgttctttataaattacttagtctcaagaattctgttatagcagcacaaaatggactaaaacatcatggttcctgcttttttggctcactaagtgttcgtggcttttctctttcaaaattttattgctaaaataaataaagatgtcactactttacaataattcatcacattccatttttttgtaagaaatagtaaaagttggatttctatgcccttgaaaaagaactctatccttgaggcaatctgaaactaagcatttaacaacttgaaaaattagatcacaaccctctgaccaaacaccagaaagttttatactgaaattcagatactctttgcttgtttattggcagggaaaaagccaaaatatcaagaaagccagcacaaatatgagtagtaatatccccttagctaacatagatttgcaccacccatctaccttctatcatgtcatcctttttatttctttcattttatgtatgagtctttgaaatgtttgtgtttttaaaaaccttttatttttttatttccttcattaaaatgtaagctctccaagggcaggcctttatgctcatatttaccaccaatttgctgctgcctagagcagctcctggcacacagaatgacctcaaaaaataccagtggaatgaaagagtaatgaaagaaatgactcatctggttttactccaaaagaagtagttctaattttttttaatgcttaaagaaagccaaatggatatacatataggatttccagtgtcataaaagtaacaaaattagcttactcttccaaactcttattttattaatattttttaataataaaaaattatagaatgcttcatgaatttgtcatccttgcattggggccatgctaatcttctttgtatcattccagttttagtctatgtgctgctgaaacaagcaccaaactcttaaaattagcttaggttcagagtgaagagctgaagttgcagaccagacccaagctgttttgggactatgaaggacattaagggctctgtttatttgagcaaaatctatgggtgaggcttacctgctttctgccaattttccttgtacaacagctgatgtcagagggtggttggataaggagcttggagccgttggtaaggaagttcttatcactttcttgcaggctccttttacctctagtcttctatgactcaagggtcattcagtgccaaatgaaattctgcctctgtggtaactgctagaaagtccagtgatgatctgatttctagtaacaactattggccatatccccaggaggagataagaattgtgtctattaggaaataattttccatggatctatcacctttttgtacctcttgtgagctggagcactgaatgattttattccagactattccccaggatgtttgtatagcaaacagtcttgggagatagaggtagtatctcgcgccaggggagaaggcaggtttgtttgttgttcattatattaaagacaatgtcttcctccagggcaaaagttgggcaggctaacttgcagtccattataaaagattcagatttcctaagcttggagttgcttaggtatgatgcaaatctcctgagtgtgcaaacatggacctaggatgctccgtaggacttcgagaacaaggggaaccaacagaacatgaaacacataccatttgagtaaaaacagcctttatctttgattcaggtgtcttctgccagcattcatgaaacgaaactggcaaatagcaaaaatctgaaacatttcactgttcttgatagtttcacatgctccatccatgccagggtcccttatttcctgcaaaataaaaaaattctgacaaagagtgcatatgggacagggtgaccttcactgggaagcggaagtgaagccccaagttcatggtgggagatcagtggtaatgaacagaggtatgtcatagtgtaggaaacagatgaaattgccaatgtgaagataagtcattagtgttaagaataaaaatgctagttcatttcacattcacatactgtttgttcacataagatgctccataaatgttattgaataaatggatttatatccttcttgcttgcaaaaatggtatgaagaggtttccagtaaaaaacacagataatgaatttattcaaagaagagtgggaagaggcgattcaggacaagaagggaagaaggaccccaatcccccatcccctaccaccctgtccttccataagagtgagaattttgtcaggcattttaaaaagttcacctcactaatcctcaaaggacccttaagattgctctcagataaggaaactgcatagaagataggaagagcatctgtgagtataagatatgtacagtatctggctccgatctgcctttgcaaggaaatggcagagccaggatttgaactcaggttatctggcttcaaggtactacatgttttttgtttgtttgtttgtttgttttttgtttttgttttgttttatatgactgagtttttttactctatcacccaggctggagtgcagtggcgcaatctcggttcactgcaacctccgcctcccaggttcaagtgattctcttgcctcagcctcccgagtagctgggattacaggcacccgccaccatgaccagctaatttttctatttttagtagagatgaggtttcactacattggccaggctggtctcgaactcctgacctcaggtgatccgcctgcctcggcctcccacagtgctgggattacaggcgtgagccactgcgcctgacctctacatgtttttttttttttttttttttttttacaggacaccacattgacagtgtcagcccaaaactagaccaagaacacttgggcacactgagctcagggcttagcccaaagttttctgaaagcatgccagagggaaagctggatgaaatgctttggtaaagaagaaagcacatcagctcatcactcatctgacaatagaaaggactgatcaggaagtggggaaaaggagaatagtggcaaaacatagaaaagagaaaaaaaaagactgaaatttttaatggagcgcaaaatcagacatatttttttacttttttgaacttctttagagactacaataataattcttatgtgataagtccaataagctatgatgatgttttattaaatgtaccatcatactagcagcttttgcagaatttgcatcagaagaaaagtataagatattaccaccatgacttggcaaaagcggtatactatattaatgttagccacttagttgctgtcattgtttctcagcacagtacccattgcctagtttccctgggagttcttgaaagctctattgaaaagttatatttaaagtgtaagttagagtgtgctgtgaatggagagaaaattgtttttctttttgtaaaaaattcactttccttgggactatatactaagttagctcagttatttgacagaaccagtatcttattttacaaagagaaaaacatagatctagaaatttccagaagcagatcactggttgaaagggcggggcgggggggggcatgtgattgaatgtgatttgaaggcagttttaattttatgacactttacagtgtgtgtgtgtgtgtgtgtgtgtatgtgttttaatgataacctaattttattgtcccagacttaaagatctgtgccacctggagaaactacagttcatccattagcatgtaaatctgttaagagtatttttgcttgaatttctccgagaaggctcccggctttgttctgtacagacacacagtcccgacgctgttcttaatatcctgttttcatttgtcagcgctgttgtccttttcattgccatgttcccatcattcctcttctttcatgtggtgctttacaataacattcagaacaaaagagtcactcctctttctgttgcctttaaaaaaaaaaaaaaaagacttcttcccctgactgcagagcttcagtgatcaggggaaatgtttaaagcatgttattcgtaatagttaaccaggagttgtgaataagggttcgttttccttactttttaagatcaggaggtagcttcagggtattgtgagcaaaaggtttttgtgtgtggctgactttgaagttgagggaaaaagcgattttctttgagaaaaggaggcatcatatttgagagaatttccaatctgctcacacaatgggaatcagttactctataacatcgtcattacctccatgagtcacgagactagtatttgttcttgtctttgaacttaagctttccagtgttcagagaacagttgtgaaatgttgcattggccatcatcaataactattttgctcctggttggtaataattgggaaggggagggtgtgtactttctctgccttctaggagagtattatataaataaagtgagaaaaagtttccccaagcggcaagcttttctccagggcacaatctattatacttgctgcaaaaatcccacttgactggtctttcagagaatagatcacttgcgtcattttgctcatttccaggtgaccttttgcagatatgagcaggcagttgtttttaaataaacattatctacaggtttctgtttctgcactaaggaaggaatgtttctgtaatgcagaagggatgctatgactgaggggtttgtgaagagtgaattctagccagtctcaaataattctgaaaaggtgcttttgtatatgtatatgtgtacttatgtatacatgcacattgtatataactacaaaaactaattccattatggacatatataggactttatacagacatagttatatgaatatatatagaaatacctatcaaactataaatacatttgagaaagcattcagggacagcagtgttaaaagcttttcatctgtgactggtttcacagaaattagtgacttccatttctgctaccatcacgctgttggtctgttcaccaggagggttgatttagacttctgccaggagactaggtgtggccatctctcaccctcttcctctctgtccagtctgctatcattgccttcagaaccaaattcttgcatgatacccagtacagcatagacctggaaaacatcggtcattttcaatataatgtaaaataggttctgtgtgcctttaaaactaaatgctttatttcttaaactgtaaaagacatgaaatgtctgagacattcagatagtgggaaatttcatctgcaagttgtcagattatgccctttagaagattgtaattttttttgttgtttatcattttctcttgaggggtggagtaaatatttctttcctgatgtttcaacttcagatgttcaggctaattttccactacagtgccaaaatagggaaaagttaggcctgtagaattttgacaatttaaatgttgttttaacaaaagccatgtcttgatgaaaagttctttagaattctacttgatgatctatgtgtgtctcttccgaggacaatgagaacttcttaaggaagtcatctatatgtgaaattgagtaatccttttattcattgttaaaagacaaatgaagttataatttggagagacataagccaaaaaatctatgtttgcatttttatgtcctaacatgtgaagcatgctttgatttactgtgaagtgttgcaatggcaataaagtagatgttgagacgtgcagactgggcagcccgaggaagcagttcttgcctctgcttcccctttatcatgaatgttccttaaacacctttggtggagtccaaatgtctggattatgaattgaattgtgcaagattctttttttaaacactttcctgatgatttactttacttgcagtttcttgtcttgcatggtgataagcaatatccttcaaagaactgcagcgcaggactttttttttttttttttcttttaggaagactacttccccttcctcctttagtcaatcaaattttaaaagattacttctttccattctcagttcaccctttctttgccattctggagactgaaattttggacacccatcacagatttgctattatatatataccgtgtatgtaatattaaatatatatatatatatacacacacgatgtttttatatatgtgtgtacataatgtatgcatacgtgtgtatgtgaaacctgtgtgtatatacatatattttaaattgtttatcaggatgatagattgctatttaggtcactatttttggaagaaataaatgactgttctttgtgtctgtactggagattgttcttcctgatataactttgaagaaaacttcttccagacattatacattaattcagaagataaaggcacaaaataatgtgtatattatttttttaaatgaacaagccagcatgcagagcataatgtgatcatgtgctcagtacgacactgaaaggccccaaaggcaaatgagtctagtgcctgttcccagccccaggagctgggcaggacggctcctattggtggcattgaaagctagcattcagccttctgccacaggacagtgtctcattcggccaagctgctgctggtccctgtaaggaatgagagtacagatcccgttgccaagtcctcatttttttggaccaggcagtgggtgttgagctgacctgagctacctttccatttgggttcagttgaacattgagtaggccagaggatagggaagttgtggcgggggccgtggaaaaggcagttgattcttcaactcgggcaaccctggcggagtggatgaggtggagctggccttcctggaattgttggaccgattttcctgttgtgtttcactgttgacgcactcacagacacacaggaccgctccagcactgcctgccacccaccgtctggtctcggtggcctgtctatcatttcgtgggtccccatcctctgcctacggcgatgtttcttcaaaaagaactagtgtgcagtccattggtgggtattcaaggtgatctctttgtcagaatctagagaggtgctcaaagaactattaaggaccaatgtactagttcctgtttttaacctgtttatcagtctttcaattgaacaaattggatttctgaaactgctgaggggttttctgcactattaggacagaacaggatagggtggttgttcctccaggaatctgggttgttcttttgcattgccatttgtctttgtgcttgtctgcttgtataaatgaacctcgagaaggagtgtttaagtattctgttaagtaaatttggaagactaggtttcaattaaaataaccagacagtgtgacccagcttccatttccccttaattttgatcattaaagccttcatatccccacagacatctgccatgcttcgaagtgattcttctcaggaatgttcattcattattaatcaggttgcatggtcaggcgagtatgtgattattttaaagaatgtcctagagatccagttactaagaatgagcatgttataggcagatgtgaaagtacagaaaagatttggttaacagtttaatttgatttgcatgaattccaccaggtgggtgtttggcgaaattaaaagtcttccctggttctcacttcagatatgaggtaaaaaaataataataataataataatttcagcacttcttaaagaagaaatgtcaagttattcaaaatatctattgtattaattattttaaaacttgaggctagcatctcagtgctcatctgcttgtcacttttttttttcaaacagtccctctggtcccctacaattttcttggcagaaattcttagttgtctgttactggttgagcaaatgaatttgagtgtgctgacatttggaggctaaatgcagtgataattcagagtaacattctttacctataaaatgttactggatcaccttttttcacctgttcttacttgatgtattatttatactgttgtttttaagaaccactttgcgtttgtactgaaacagcctacattatgctatcaatttccagtctttcagaatgcagttaaatccaactggatccccttctcccctttttccatcagttcatggccctgttttactgtgcctttgctaacccacctgcttctcaaattggccagagtgctaatcagtaaagtaacatttgggtagtgtctttattcggtggtctttatcactcaaagtcaaatactaaatggcataattgaatatgcagatgctgagtgcttgtattatgttattcaaaataccctatgatgaattcatcttggatgtagcagccagtttttattgagtttgtgttagacaagtttttgagttgagaaattatgcttatttaagatgagagcaagtcccttctgagttgggtccccgttgcaatctgcctcccaaactcaggttgatttccagtgtttcacacttcagtagttttgagtcctctgaaagtctgtatttctgctggtccaagatagaaacatcactctgcagtctttaaaaaatatttcacctatagttctataataaagataatctcatagcaaaaatccaaacagcaatagtcaactaaatctaattacccaggtgaataggggttaagaggagcggacaatcaagtaaattgacttgatttcgtttctgaaatttaggactctcaaataattcatttgtacattttcaatgctatttgttgtttgaaatacttataggagcttcctgttctgaaaccattttcgtgtggcttgctgtaacatcgtgcaattttaacagtgtgtttgtcatctcagttatgttttggtaaatttaacaataaagttagtctctatagtccagaggatatttggaaaagaactagaggaagtgccttgggaatcatctgggcagtggctgacagccacgtggtattaacgattaatcacaggccacccagtgttggcatacaagtttattccttggtctaatgactcactaatttccctggtagtgaaggctttagagttgtacaaagtgaggggctggaagtaaaattattgatagaattgatagaattgcatgttctttttcatatactccaaattagaaaaataattgtatttcatggagtatgcagacataacctagaatacttgtaggaaagcattgagaggtgggtttaccttatcattaaaaaggtcaatgcctccattaagggaaatttgggataaaaattatggatgatgtgctgatgatgggcgatctccttattctaatggatgctgtaacaagttagcacaaacctgatggtgttaaacaatgcaaattcattatcttacatttctagagtcaaaagtctgacacaggtctcactgggctaagagtaaggtatctttagggctgtattccttttgggggcccttggggagaattcatttccttgccttttccagcttctagcctgcattccttggcttgtggccccttcctccatcttcaaggccaggcatggctggtcgagtctttgtcatatctcatcattctgactctgactcttcttcctgccacttccacgtttaaagagccttgtgattcctttgggtccacctagatgatccatgctgctctccccatctcaaggtcagctacttagcaatcttaattatatcagcaacagtcagtcccctttgctctataacctaaaatattcacaagctctgaggaggaggctgtggatatctttggggaccataattgtgcctcccccaaagagggaggagtagaaactgtggtgtctgctgtctggtgaccaggaggacagaagccctgtgaggagacaccaggagccctgtagagaagacaaagacaggctaatgagggaagaggataaatcccacatcatgtgcattccaagtctgaggcacttgcagtacatgaagcaaagaactgtcagtgctaaaccgggttccagaaaggggttctcgaccatcttgggatacaagcctagcagtcattctcagagaggcagtacatgaaacaaacaaaaaactggatggccctgtcaaaggaaccatagaccatcagaaaacacttaggctttgattagcaagaggtagaagtcagcagtggttagacagaggaaaactaggaaagtacagtttcagtgacatacagtgatgtggtttgtttgtccccaccaaaactcatgttgaaatgtaatccccaatgtggtggcattgggaggaggggcctagtgggagatgtctgggtcatggggatggatccttcacaaatcgcttgatgcccttcttgaggtagtcagttcttgctctcatggagactagattggttctcacaggagtggattagttcccatgagaatggagttgttataaagcaaagttccttctcttgagcagatgccagtaccatgcttcttgtacttcccagcctgtggagccacgagctaaataaacctcttttgtttataaatcgcccagcctcaggtattctgttatagcaacacaaaatggactaagatacatattatgagagaggaaaggaaaggaagaagagggaggtgtgaaaacatttacatcattattttccagcaaaacatctacttattaattttccattttaaagaagtactttcctcataagtcttgaatctataagaaagttttttcaaaagatgtatccaatgcctcccacgatgtggggcttcactgtaatctgtcactgaagactctcctgcctaggggagtgattagagtgagtgctagagggactgtagggaacatctgtggacactcacccatggatactcagacagctaataagtagcagaactgcaggatgtcttagattatcccgtcacctgtccagctctctcccctttcattcattattctgtgctgtgttctagatgtttaaaccatggacaggcagaggtgtgagctgtgatttgttgccattcccagtttgttgcaagggactctcaagattatctagatcctcttctcaatgaggaccaatctgcccattcacaaaaatgttaagctataggatttcctgacaacaatatgcatgtgtgatttccttttattgaagtagaaatgaagaagtttttttttttttttgaggcatggaaattacattatgacagttaagaaaaggcaaaagctgctgttttatgatattggggtttttgttgttgttgtttgtttgttttgagacagagtcttgctctgttgcccaggctggagtgcagtggcatgatttcagctcactgcaacctctgcctcctgggttcaagtgattctcctgcctcagcctcccgagtagatggaatcacaggcgcacgccaccacacccagctaattttttgtatttttagtagagacggggtttcaccacgttagccaggctggtctcgaactcctgacctcaagcgattcacccaccttggcctcccaaagtgctgggattacaggtgtgagccaccatgcccggcctgatactgttattaatgatataaataacaatgtaagctatatatatatgtgtgtgtgtgtgtgtgtgtgtgtgtgtgtgtattagatacatatatatatagagagagagagagaaagagagagagaaagggagagagaaagagagagagagagagagagagagtgaaaagaaagataacattttgcataaaattcccacccatgtaccactatctgcttggtgaatccctgttcatcttttaaaacccacttcatactttacctccttcaggaagcttctccctgtctcctctccccctatatagagttgattattccctgtctgtctttggcatgcatctttttttatgttgcattacaccttgttcatttttttttctcgatatgggctcactctgttgcccaggctgtagtgcattggcatgatcacggttcattgcagcctcagcctcccaagtatctgggaccacaggcatgtgccaccactcctggctaatttttttatttttattttttggtagagatagggtctcactatgttgcccaggctggtctcaaactcctgggatcaagtgattatcccacttcagcctcccaaagtgctgggattacaggcatgagccaccacacctggccttgttcatattttctctctcggaatgaaccataagatcatggagacaggggccagctgttaccagtacttgtctcaggaccaagtacatagatgaacttaagtatttggtgaaagaatgaatggcaaaaaaaaaaaaaaaaggaatgaatggcattttaatttctccaaaaagatattttaaagaaagctagaaaataaaccatactaagtttcttttagaagaaggaatggaatgagtacaaataagatactgtagagtcatttaacaaaaatgctatctatgccattgtaaaatctgggtaaaagtggaaaaagtgggatgcactatagatatcaaaccaaaaccccttcctttttggtagcatacaggcaaaagatttagaaaattggctgaaattcacctaccacatctgagtattgtgtcttcacctaatacaattaaccatttacagtacagacacttgcataaagcactatgccaggtgctatggcagtaaaagaaaatatctagttttgagcagctactattaattcgttcttacatgagttgcccctaagcactcgagtcacataatttccattgatgtcagattcaaagcccattgcatatcatttcccattagcactggaaacttgtaagtgcttgttcaagtcttgctccgccatccttgctgctgttgcccacacagcattttattcatacctctctgagaatgattttcatttatgttctggttatctgtatatgcctctatcttccaatacatggctcaacaaaataagatgtgcaggccaatgctggcctgtgacctgtttttctaaatatggttatgttggaacacagccatactcattcctttatgtattgtgtctgattgcttttgcactacagtggtagattgagtagttgcaacagggcccctttggcccacaaagccaaaaatgtctactattttaccctttatagaaaaagtttgttgacctctgttcaaatatattgagagatccttaaagtcaagggctgtgtttgattctttttggttttagctgaaaagtcagtacatttaatggaatcaatgaatgtttgagtcattttgtgtgctgagtgctgttctaggtgttggtggtacgttcttcaaagagcaaagcaaaatctctgctttcacagagcttatattctagtgttgaggacagtggggacagaaggagcaataaacaaactaaaagaatatgtcagtgataaatattataaagaaaaataaaccgagatgggggaagaattaccacgatgggtaggtggtatagtggtagaaggggaattggttttatgtgggttcagagagaaagtgacactggagcagagagtcatgtggattctgaagaccttgcaggggcgagcaggggattgatgtgcttggcatgtttgaggagtcagaacgaggccatgtgctcagagcagagaaaggagtgggtagcgtgggaggaagtgagctcactgtctgagtctgtgttttctggggctggtttattctggtgaatttctctctgggtgaaatgggaagcccttacagggcagagcaaaaggagatgcatgttctgtcatgttttaacaacaggctctcttgcttctgagtggaggatagactatagggggaagggcaggagtgaacagaagccaagagaccatttagaaaggtcttatgatagtccacataagagatgatgctggcttggcccatgataatagagatgaggtgatgtgaaccccagattctggcttcttcatctaactcagtgcctggcacacagtaaacatctgttgaaggaatgaataaaatgtcagtatttccactgaggtctccccagtggaatcctttctagaaattctcatcacacctctctgggatggaatcctggcacctgcattaaaaatatagtcatcatagctctccagacataatttgatgctcatccttctattcagattcattggtaggcattcttgttttatctgagaacagagcagaccaaaagggctacatttttcctttaatttatatgcttctgatgagaaggtaaaagaactttgatttaaagataattctacattttttctatgattaaccaaaataattattaataggtaaaaacctttccatttcttctgagccatctgtaggaagaggtgacagaccaagtggggatgatatgtttcttacaacagcaaccctagggtttccattgcaggttgtagaaagatgtacaagctttaatatttcaagtcacagttgctcttttattctttcctatataataaatgctagtgaatggttgaagattttttaagataccaggcttttatgaagccagtagctgtttaatttttaacaggctcgggacatactttatacttttaatgatcagttaccattcagttggtagcaagatgagcattaatttcaccaaagcaccatattggtatttctgagggatgctatttcagaaggggtcagggtattctagaaaccgtgaattttgtaaataagcggaggtgtgaatacaaacgattgattgtcagaatcactaaacatagctttggatgtgaagccttcccataaatccggctgagaacgctctccccaccacccccgtgggtgatttgaacctcccgaccactgggtgaactgcactgttctcccacagcctgcaatgggctgcatgtaatattcccatcactggtctgcagacctctgctaatggtcttgaaagggagaaggttcaaagcggcttggttcccaggcctgctaatgagcatgaggcctcttcacccttaatgaactggggtttgtgtggaattctttctactactctttttgatgggaaggcagatgagagttcacaaaagcactcaggtctttatggcaaggggagcaggcagctgggccaccctcgggtggcctggaggagagcaacatagctagcagaggtcgtacccaggccaacatagctctgagtgtgaggctggacctcctgccagcctggcctgttgctggcaacagtgacaagcccgtggtgggagttttttggccaaaagggtccctcagcagttttgtaagcctccttaaattgctttctcaactgtaatcattatcattgtcataacataacttatcacatgaatatgatgaccactgaaatccttgttctaattaactaaatcattgctctaaatattagtcattggtactcaaacttactgcagccactgaaaaagcccccagatatttttctccacttcgttctgcctacccacgtcccactgctggattaaacaatagaattattcagaaacataatgaacacatgccaaaaatattgcctctatcacaatcatctttgtgaaagtcaatgttttttctcaggaatatattttggaaaatgacatcccacacttaaacacgatcatctctgctgaaatccccacatttgatttcatgtacatttcatgcccatttctatagttactgccttcctattgttctgaaacctggtttggtattgcagagtaaaagtccttaaatctcgtatacattaatacgtaagtttataaattcaaatttataaaagactctagtttattgatgaatatttctacattttaattttctgtgcgaggttaaacctgactctgacacaataagattattctgattaaatacaaattatggaaattacagtttcaattacattctagttttgaatgaagccttttaaaaaacaaaattgaaaaaaaaaattgcacattttcagttactgaactttgagaaaatgttaactggtatatgatggctcaggatgctttttcctccttttttccccagtgaatagaaagagaattatttggaatgtacacacacttaccctttcatgacctgtgtttggaattattctgagatgcattcaaagctgacacccccctatggttgacctccctgtgcctaatcaaatcttacattcttgtttccagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaaggttagtccgatccgccttaagccaacccctttctgccagaaaatgtcatggaaataaaaagtgtattcactgctagctacatggcaggtgaaggttttctcctcacctttgttatctgattagttttagcatgtttttggcaacctataaatgttacacaataagggtatcttgtaaaagttgactgctgcttgtaattttagcgttgtcaaggtgagggcaaattctaaaaatctggatcattttcaatccatgcagtttttctggatcattttcaatccttacagttcttccaaagagagtgctgcctctctctgagagagagggagagagagagagagagagagagagagagggagagagagggagagagagggagagagagagagaatgacagataaaatctggctttgggcatttggggaacacttacttttctcactcatctgggaaaactaattcactctcattgtacctgtatctagttactgcacaaacaaaagaatagagggaagaatgtctgtagcaaatgtgggattttagaggacacgtgaccttttattccttgtataaacgatatccagcttattggtgaaattcagtgctctgacaatctcaggtttcacgaaagaattccttttcgtgtaggctctttattcagtaaggttacagtcaagactatttgaacttcattttttacatgaaattattaacctaactccagcttgggggataatgattaatatgactatatgtgaaataaaaggatcactttctaggcagggcgtggtggctcatgcctgtaatcccagcactttgggaggccgaggagagtgaatcacttgaggtcagcagttcaaaaccatcctggccaacatggtggaaccccatctctactaaaaataaaaaaattagccgggtgtggtggtgggtgcctgtaatcccagctactcgggaggctgaggcaggagaatcacttgaccctggggggtggatgttgcagtgacccaagatcgcgccactgcgctccagcctgggtgaaagagcgagactctctctcaaaaaaaaaaaaaaaaaaaatcactctctaagtatggatagaaagcactagggaagaaataataagccaagtctccacatgtttgttcaatttcaggcaacagtgggtctaattattgaaaactcagctgagagagtttgagtgagatactatgttcatcagctaattttagatcacaagacaccaattaaaagaaaggaagtataaattaaaagctctaagtaaatatatattgaagtccttcctctcaggaaaaacacataccatgttgttgagcaaacaaaatgaatcacatgatcaaaagagtgttatcacttagaaaacagtgtcacctttaacaaatggtttctatcacctctccttagcgctaatgggtggttgtgtttactgggaccacatagtttattctgtgacagtgggattaacggaccacatctgggatttggctttgctatttcttgacatgttgagggaagccgacatgctgaagtcaattcctgcttctcaatgtcacttgggcaacaaaagcatcacctgggcagcatgtttcacttcaagtatccaaagaattactggtgcaaatccatctttaaaccatgtagaggaagtcaagcacaaggactcaggtgacacagacaacagaagacagccgctgacaggctttccagaacagtgcatggcagcacaggagaaaagtaccaccaaagttaatcatagcaaaggcaatgcatgtatgagctgtgcctctagagcaaattctgaagaaattgcgaaggctattaatttttacaaaccaaggtaatctttttttttttttttttttttaccccttttttggttggtggtggagctgaagggagaatatttaggataactgaacagagatgtttgatttttgttttccaaaatgtaaacatgccagatctttgtttctttattaaaaatgttcctttgattggatttgcactaccttttaatgattgtttgttaaaacaccacaatcataatgatgttcaatatttaacaactcccaggcttgatatttatttaaatcttgtggtcaggttctgctcaagtactcatggcctgtcacagcagagttattaaatatttacataacatctccaaatttatgaagaattcctgtcatgctctagccctctttgtgataaaaacaaaactcttcagttacgagccctgcacactttaattgagccagtggcctatcggttgttctactgtcacatggagggcctgacaattaatgatgtggtttctttttatttcctagttacagaaatataagcatataaacagcatccaatgcaccgaaacacatttacagccgttcaataagatgtacttatgagcatttgaacaaataacttatcgacatagcatgtttgttttaaaacatgccacttacgttagaattttaaaaataataattatgacatttggatgtctgatatttcagttatcgcatacttatgaacatatgtacatccttgttttatttaaaacctaagcacaatataaatgttgatttttttgaaggaagtaatagcataccaagaggaccaaaaccaaggaagtatatttctgttaattactactttggtctgaaatgtgctctgaacatgcatttttctgtagctctaggatctcatatagatgtggatttgtgatgatgtgagaacacagataaagcatggaggaatttgaggatgctttcattgataagacaatagatttgctttattaatttgcatatgtaaggaccctggtgtctttggaaacatttttgtccttctgttagtaaaagtttattacctgaagaagggaattctgcaattattatgaagaataatttcttgcaataatactaaactttgggggacatattttactcattagatctcagtataagagatgtttgtttatacaaaaaatcagaatatcattttgtacattacaatctttttctaagtgtaaaagaaaaagagataaaaattctaacatgttgaactcgtacaaataaaatcatccacatcatgtaaaatagcatcatgtcagtaatctaacgctttcggagactatgcattgagaggcactcatgaaatattgaagcaaagagaaaattaaggtagcatttcctgaactctactaagataaaaagagaaaagttttcctgccaagtgcaaaggtctctaagtggagcgtatccataatgtggatatttctttacatcgttttaattgaattttaagaagcctctcagtccttcaaacttggaggaaaaatttgatttgtgaaccacataacatataagagaatttaatataattaatgcattccagagttttcaaggaattaaaatgcagtagtcctctttttctgttccaacatacaaggttggagctcttgtttcttttctctaattatacctataaaaatatacaaattgaaaaaaactgacctttccttgcctttcagtttcagcatagccccttcaaattagctgaagctgaagttccaaactattgttttgctattcttattctaaaggctggctgaggaagtttgtttgtataatgcatgtttcaacggatcatcccattgtaattttttaatagtttgatttaaaagttcaaattaaagctcagcatttctatgtagcactttttatctggaagtgaagacatgagatttcattcttgggtttaatttatagattgtaaggttctatgtttgaaaaatctttcccagtttgcaactaggaaagttgtaagtgtatactgagctagacttctttttattataatttctataacttgtttcttctttgaaaaccagtagcaggcatagtgcaggttctagtgctatggtgtgtgatgcacacacatacttgcatatacatatacatacatgcatttatttatttatttaatattataatcttcctgaatctaagttggagacaaattcaagtgaccagtattttcattagggatatttcattctgcaggcaagagatgacaacaaacatagcaataataactatattcccatcactcaaaatattttacctgttccttgaatgtttggtagatggatacaagtcaactttggacttggtatattttttgtgggaagagtcttatcttgaaggggtttttttttgaagttacaaatatgtgtattttttaaaatgtgtctttctgtttattggtttctagtttaaatcccttaagatcagggctcaagacaattgcatatggtctcacttatggatgcagtatgctttaagaaatattagaataagtttattgtatcttcaaaatttccatgagctcattaatgttttcagtctgtgtaatcaattaatgactaggagaggtgcacttaggccttccactcagagagtgaaattttcttttttttttttttttttttactttaagttctgggacacatgtgcagatttattacataagtatacatgtgccatgatggtttgctgcacctatcaacccatcatctaggttttacaccccacatgcattaggtatttgtcctaatgctctcccccgctcgccccacaaccctgacaggccccagtgtgtgatgttcccctccctgtgtccatgtgttctcattgttcaacttccacttatgagagagatcatgcggtgtttggttttctgtttctgtgttactttgctgagaatgatgggttccagcttcgtccgtgtccttgcaaaggacatgaattcattctttttcaggcctgcatagtattacatggtgtatatgtgccacattttctttatccagtctatcattggtgggcatttgggttggttccaagtctttgctattgtaaatagtactgcaataaacatatgtgtgcatgtgtctttatagcagaatgctctataatcctttgggtatctacccggtaatgggattgctggatcaaatggtatttctggttctagatttttgaggaattgccacactgtcttccacaatggttgaactaatttacaaccaccaacagtgtaaaaacattcctatttctccacagcctcgccagcatctgttgtttcctgactttttaataatcgccattctaactggcttgagatggtatctcattgtggttttgatttgcattttcctaatgaccagtgatgatgagctttttttcttcatatgtttgttggctgcataaatgtcttcttttgagaagtgtctgttcatatcctttgcccactttttgatggggttgtttgattttttcttgtaaatttgtttaagttctttgtagattctggatattagccctttgtcagatgggtagattgtaaaatttttctcccattctgtaggttgtctgttcactctgatggtagtttcttttgctgtgcagaagctctttagtttaattagatcccatttgtcaattttggcttttgttgccattgcttttggtgttttagtcatgagatccttgcccatgcctatgtcctgaatggtattgcctaggttttcttctagggtttttatggtttggggttttacatttaagtctttaatccatcgtgagttaatttttgtataagatgtaatgaaggggttcagtttctgttttctgcatatggctagccagttttcccaacaccatttattaaatagggaatcctttctccattgcttgtttttgtcaggtttgtcaaagatcagatggttgtagatgtgtggtgttatttccaaggtctctgttctgttccattggtctatatatctgttttggtaccagtaccctgctgtttttggttactgtagcctcgtatagtttgaagtcaggtagtgtgatgcctccagctttgttcgatttgcttaggattgtcttggctatatgggctcttttttggttccacgttaaatttaaagtagcttttctaattctgtgaagaaagtcaatggtagcttgatggggatagcattgaatctataaattactttgggcagtatggccattttcacgatactgattcttctatccatgagcatggattttttttccatttgtttgtgtcctctcttatttccttgagcagttgtttgtagttctccttgaagaggtccttcacgtcccttgtaagttgtattcctaggtattttattctctttgtagcaattgtgaatgggagttcactcatgatttggctctctgcttgtcgattattggtatataggaatgctcatgatttttgtacattgattttgtatcctgagactttgctgaagttgcttatcagcttaaggagctttggggccgagatgatggggttttctaaatatacagtcatgtcatatgcaaatagaaactatttgacttcctctctcctattcgaatacccatcatttctttctcttgcctgattgccctggccagaatttccaatactgtgttgaataggagtggtgagagagggcatccttgtcttgtgccagttttcaaagggaatgcttctagcttttttttgccgagagtgaaattttcaagtcctcttcatagttctgtcattttgcttgctttaggccttttgaacctatgttattaagaacgatatggctgggcatgggggctcacacctgtaatcccagcactttgggaggccaaaaaggagcattgcttgagcttggtcgtttgagaccagcttggacaacatagcaagaccctgtctctactaaaaataaaaataaaaattcaactgggtatggtggcatgtacctgtggttccagttactctggaggctgaggtgagaggatcattgagcctgggagatcagggctgcagtgagcagtgattacaccactatgctccaacctgggtgacagagcaagaccctgtctcaaaagaaaaaaaaaaaaacccacaatgaaagttaatataggttttttgagaggtcataaaaaattaatatgtgtttaattaattaaggtaatatgaacagtaacagtccctgccttcatggagcttatagtctagtagggcattccaacagctactaaatactttctctgttgatggtggcaggaagcacattgtgcccaaagcaaaggtactgaccccagtcctgagagatggagaaaggcttcccagaaaagggatcactgcacctaccatttccaagccttgtattagaaaacaatattgaatttactagatgtctgtaaaatccctgttatcagttattcctttttaactttttaccacgtatgatgttctttgtgtaaccctatatagtttttcaaacttgttcacagtaattcccagttgattttaatctaaaatacagacagactatatgatgtttcaccatgtggtatgtgaataactcagacacatgtcttctaaaatgttgtaattttatggagtttcaccagttccaactgactccaatatgcaattctgtttgtactaattttatggcagcatttgtttagtctgcaatatagatatgtatttttttccttttatctttagttggacacttaataattgcacatatttatgagatatagtctgatatttccaaacgtgtatacaatgtgttgaaatgtatattttttaatagtttccatgtgattaaaataagatttccaaatatttgtaaaatgtattaaaactatattttaattttgttagtttggtacaaggatatttatgatagatggaataaaagaaagcatctccaggcatatgttcttaatgggaaactcaaggcagcttccttttcctcctcctcacctgtctattttctggatgagtcctctctcaactccttcacctgcagagagcaatgtattattgcctagtgatttattattgttggaatcattcttggtaagctcagagagttcgaaaaatgcacaaacaagtacacatggtacctcttcatcatgtggctgtgtaaacgtaattcttgggcaccttgttaacgttcttgtgctatattttactcgtctataaaacagggctaatgtatagtacttactttcacagaaaattgggagagcaaaataaagtgtttcatgtgccttagcattgtgcctggcctacagaaagcctgcaacacatgtcagaacgactgttagaaactaggaggcagaatgtgtaatggttaagtgtatggacattggatgtagactgactgccaaatattttttaaccactgtcttgtattatgtgtatgtgagataagagtatatattgttgctttaatgtgttttgtagttttgtttctaaagcacctgccaaagggcagagacgtgacaattaataaacacttgttgatggacatgtgcagaattgatgcattagacgagtgttttgggattcggaggaggaagagatgaatctgcttttgagtagacaataaaccttgcttcagggtggtgggatttaagctgctttgacagatctgtggattatgcatcaaagaagagtgaggtgctctgcaggagtgagaccagcagagacctgtcggtaggaataggcaagacagctttggaattttagacaatcctaactagagcacagggtgccaaatggggagccaggaaagaggatgttggaagagtcacctggagggaaggtcttgaaagtctttaaatgcaaggttaagggtttaggccatttttaccattttctatagagtaatagtgaagtgttttttttttttttttaagagagagaggttaatgtatattttctgaaataaatttcatgtgagaatataagaatggatagggttactgtgttcatggaagaaataaaagggggaagagacattcacattactttagattttgtggtctctcttttaattggcagaaagaagtagtatcacaggtcaaaaaccaccaccctgtcaacagaaacatgtaaaattgtgagattcaaggtcctgccccttaaaactaggaagaaataggagatgtcgttgctgattggctcttaggtacagacacaaatgtgattcttttcctgcttttctagtgcagtaagacacagtggggacaatgcatggttatttcttctggctttttgattcacaataaggagaatgctgttcaaacctccgaatgcccactataaaccaaaataatgttttagagccagaagcaaccttggagctcatgtcattccatcctcattctgcagatgaggaaagtagggctgagagtagtaaaagaagttttccgcaatgacctagtgggttagtgactctgaactaggactagagcacagttcccagctgtccagttttgtgtctttcctgctacttcctacagcggttaacagtgccagccagcacaggcaggattgccttttgagtggttctgaaatttctgaggtctcttctgaggttttcaggagtaaacacaatgattttacggtaatttttaaacgcctgcttggcctggcaataaaccagcatcatgggtgtaggatgatgccttaccatgctgtctgggaattattgcagagatgtggctttgcaatgatgcctccagggccaccaaaataagttgcctagaagatgcccccatgctgacattttctatagctgagccagtgtagatttggccatcttgaagggccagacttcatgcctggagctgtgttcatgtacatggacccagacaacctcggggacactgcaaaagaaagcagagttaggacagtgatgtcaatgaggaaacaaaggaattgtggttgcaacttaatgggctcactaattcccttcttaggattattgttttcctgaatgtcttaatatatagattattcttagactggtaaattttttgacattgccataaagtgggcatgagtagtctgagaaactgaatgtggctaaagatttaatttattttcagtatgtggcataaacattctggaaaaatctgatacaaatgcaattgtaaaaatccatttaaaacttaatcactttatattctggacttttgggtatgacacaacgttgttgcgtacccatgaggtatggactttaagctgacaaaggaaaacacattttgcatgtcgcatcaaaaaggaaaatgcttgtaaagtgccgagcatggtgactggcacatagtaagtgttggatgtacacgaggtattattttatctgggcatttactgttacaataaaaccttcattggtgtaatccaatggtggatttcttgacagtatcataaattactcagtggttatagggttgatatgtgtttctggctgacatgggaaactttgaacaactctcaagggaattataattgggtggaaactttgatttgtcctttctaaaccaagctaagtagtgaaatggacttttaagaagcagtgagtggtgaattgaaagaaatggctttaaaaacaaggcccaatttgaagtctggggatgcgggtggcaggggtggaggggagcggctctttcatgtttctggttaatctgattggatcagcaccacaggtgccatcagagcacctacagctgtttccaagaaaagaaaagctggcattggtttatactatggctgtcacatttatacacatctagacagatgaggaaaagatgggtgacatgatacacagtaagcctagactagtcagacgagctcagggggctagctttctttttttttttttgtagggttgcctttggtatgtgagtaaatgatgaagcaagttggccctgggctgtgtgttagcagctgtctctcttagaataggaagaggaaggaacttcggtatcgactggggctggaggaggaggaaagcgctgaagtgaaggagctgtacaagaaggcagcttccaactcctccactgtaggggccctggggtgttttgttctctgtgctctcttctgtgccagttgtgcagggtgcctagaatagcggtatcatcgtctgcctcctcccttatatctcttttgctatttattgagggggaaaatccggaaaatatggtttttatttttatttacattgggatagactaggttcttattactgaaacaatatggaaatcatgagcagcttctattccttttgtgcctttataaatattcttttccctatctgctttatcagatcctgcttttaaaaaaaaaagaaagaaaaaaccttatttgtttactcagggaatattttatgtagctactatgagataaacactgagtaaattctgggaatgcagaaatgaaaaacaaagataagtcgttgcttccatggtctagagctcattataacatgtaataagaatatatagacaggatatgaaaagagctccatggagctcaatcaatgagataatttttaatgtgaataataataaaaaaccactgacttcggtgttgatatctggaaattgcctaattccaaaagctgaagtaaaaatacatttcaataaaaagcaacatttacagagaacagtgacattcagtcatttggaattgcaaattccactgttcagtcatttggaattgcaagtaagggcaaaatatgaagactccaatccatgaaaaaagccggctggatgctttcttatgaaaggtctactgttcgcgggctggactgctagcccttctcacgtgctttcctcagaggtctccatttccttcctgaacagggctaataggtcagataaatatccaggctcacaagcagtttatgtcatttccactctgaaaggatccatccctaggaagatattatgggagcaaacttgcggaagtgctattgtgttaaccaagccagctggtgggtttgctttatctgttatggaatttttaccaacttaggtgttaggatgaatatcctgacctggtagagtgtttatttcccccttctttgacccttgacacagctgtttagagctcagtcactcttggttgacatggtcagattcaaagccaagaagagtgaaatgggcaggcttttagactcacacactgagtatggcctgtgtgagtgagtctgaaagatctaggagacatggggaagccgtatgcacttcacttaaggagcttggagggagatgctatttttgcctctggattgctgatttaagctctagagggtcccagcaaacaagggcctcacttatttatagtgtccagcttgttaactggttccagtagctctttcattctaaataccctgacttgatcattacagattctatgcatgtaacaaaatatcacatgtaccccataaatatgtacaaatattatgtatcaataaaacgttcatctgataacatattaggcaaggccatagggctgcttccatacctctagaaaactgcctcgtaggtcagggctgagtggtagtacaggaaggtggagtaatctgtcaagatgctgctttaagttgttttgagatgtggttcaagggtgtttgttgatcaaacaccaagagctagctattaccaagaataataactagcatttgtaaatctccagattgacagtttgcaaagcactttcaagtattatttgatccttggaacaaccacgtatctcctgcaaaaatatgggaatgataatacctgctcattagggatcttgggaggattaaatgagataatataggtccaagtgtctagcctagcatttagtgggtgggagcagctgggtaaataggaaccatctttaacaatgcagaacatgaggccatggaaaattcaaaagcataactgtagtcagatgactacgttttggagctcagacccagggaccccattttgcccttgactaatcgtcacctatgattaaagcagaaacaactatggtccaaacataccacccttaaaaaattagcgagaaagaaagagagagagtttgagtatggagagagcaagtatttttgccttcacttttgacacacaggctccctggactgagcaaagaagttccctttgaagtggtgactatgattgaggatgagctagtttccactctaatataaataaagaagtaaaaatacaaagttgaaatatggaaatccatatggaatcattttatttacttacagcaatattgaattatccaatactcaatagtttctctgtacctaagtgttaacataaatgaatgaatctctgatgatccctaaaatcatttcatcacttgaaatgtgattatttacttaccctggctaaaaatgtaaatttatagtcttggtctatgagttcaacatttcaaatttcttaagagaccaaaacgagttaatattcatatttagttattcatgccaaagcgtggatacatataaaaatgatcaccatgtgttagtcaataataaaactttttgatctgttatccattcctctttctaggatcgctaatcagtcagaattgtagatttaaattggtttctaaaacaaagatatctcaaacatggttgtgcacaaagccactcagggttcatacgtatatatatgtgtgtgtgtatacatatatatatatattttttttatttctttttttttttttagatagagtctcgctgcatagcccaggctggagtccagtggcgtgatctcggctcactgcaacctccacctcctgcattcaagcaattctcctgcctcaggctcccgagtagctgggattacaggcatgcgccaccacgcccggctaatttttgtatttttagtagagacggggtttcgccaggttggccaggctgatctcgaactcctgacatcaggtgatctgcccgcctaggcctccaaaagtactgggattacatcatgagccaccatttataagattcagcagatctgagacaggtttagagtctgatttcaacttgtgtcctggcgttgccattttagaattgtgcgaacttaagggaaaaaaaacaaaactaacttttcaagcctcaattcctcatcagtaaaacagaggtaataattcagtaataactccataatgcttgtcccctaggaagccctggacaaaggatagtggttcctctttccatcactattgttattccttgaatgcctctatctttaccccgttattctaaattttaagccttttctgtagttatatggacaatgcagttggccctccatatttgtgggttctgcatctgaggattcaaccaatcgtaaatcaaaaatatttgaaaaaaaaacaattaaaaaagataaaaacacaaataaaaaagtataacgactatttattgtattattaattattaataattattgtattattataagtaacctagagatgatttaaagtattgcaggatatgggtaggttatatgcaaatattataccattttatatcagagagttgagcatccatggatttttggtatctgtaggagggtcttgaaaccaatcccctgtagatattgaggaatgactgtatatgttcttatacaaagtcaaacaatacagtttatgtaagtgaatcctcagtccttccagctcttcctctaccaactcttgattattcttaaaggatcaactcaaatctcatggaggactactctaatttaacttttaataaaattatctgatctccgacattccctattttttttttttttaccactccttcataattgcatgctgtttgtgtattatttcatattctttgggccggattcacaaaggataggataaagtaataccatgtacagtggcttacgtttgtaatcccagaactttgggaggctgaggcaggagaatcgcttgagcccaggagttcaacaccagcctgggcaacatagtgaaaccttgtctctacaaaaaaataaaaataaaaaaaaattccaggcatgatggcacacgcctatggtcccagttactctggaagctgaagcaggaggattgcttgagcccagagttggaggctacagtgagccgtgatcacaccactacactccagcctgaatgacagagaaagaccctgtctctaaaacgttaaaaatgtaaaaataaacctactttgggcataagtcttccctccccaatagtgtttcaatttctcaagcccagtggctgtattttgtgttcttttatatctgattactcatttttcaacaataagagcattctgaaaagctacaaggtattttatcagtagtaaatagttgttgaaaccagttgaaaaaggctgtaatgatttaattagattacagtctgtattgtgtaggtagaagttgcccatcagattaaaaaaaaaggaaaatcctagcccaccagccattctttcaaattttaaatacatagtcaagcaaaataatgcctttcaggtctctgcacacctttctgaatctacaagtttcttctcaatgatttctttcaagaaagtcttataaagagaccatttgaatttttaaaactttaattcaggcagcagtgatcaaatatttgtgattcacaaaggataggataaaataataccatgtacatatacaatcggccctccgtatctgtggatttcacatctgtgtattctaccacccgaggactgaaaatattcaaaaacaataaatggttacatttgtttgtactgaacatgtatagacttttaaaaaatctctaaacaatacaatgtaacaactatttactaagcttttacattgtattaggtattataattaatctagagataaagtatatgggaggatatacataggttatatgcaaatactatgccattttatataagggacctgagcatctgtggattttggtattcataggggtcctggaacgaatcccctacaggtacctcgggacgactgtatatattttgtgtgtgtgtattttcttccctattgcctcagaatagagtttaattccactttgagacaggatggtaaggtatcatgaggaccatagggtaaacttagcaatatacaattgcttagttttcgaaacttgggagaggaaggggctgccactggcgcacaatgggtcaaggccacggatgctgctaaacatcctgaatgcacagaacagccccccagacagatagtcatccagccccaaatgtcattggtgccaaagcggagataccctgagtcgaagcaaagcatctttgttaatgacataagagaaatgctcagttttactcttacagacatttacttgtttgtgtgacccctaaaccaaatctactttgagatgtagagagctgagacattgcagaactcccctcccgccatctgcagatgccctgagtggcagcctggcagcctggcagcctggaagcagccccagagttctttgcacagcgggcttctctcacccatgcccccagcccaactctgagcagtctgggcccgcacatgccagccttcaggctgtttcaacagtatttaaacctccaaaggcttatgaaatattctttaatcccttcccaaaacatgatttaggtgtatttgatattatctgctatcccctagatttcctagtgtttgcagcttattttcaggactaccttccaggtgtagccgtctgtgtcagagacaggagagcctgaggctttcctccaagtggggagtctgcagagaacaggctggcagctgagactttcgcccaaatggcttatatttgatgtataatagttttaattgtgatattattaaaagtgaattatttccatagatcaaaagttaactcattaaatctgttagtctattttaagttggtcttccaaaggaaccatttatatttatatagcattgcgtctttatccttgcaaaactgtggattctaaactcctcaagtcagagacttggaatagcataaatcagatgtgagtcttcattgctgaggctgaatttattcagtcataatttccaagcatttgttcctgctggaaggtactacttatttcacaagaagttcatgtcatgaaagcgctgagctcgaagggccatcacgcatatctagtccagtggttctcaacctggctgcacagggattaccttgggcagaagcccagcccaatgggacaagatcttctggggtgcagctcaggcattggggtttccccaaaactaccccaagtgattctaatgtgcaaacttggtggaaaaagtttattcttttccaattcctcagttacaatgagtaaactgagggtcagattaattcataaaggcagaagtcagcaaacaccgtaaaggactagctactaaatctttctggcattgcaggccatatggtttctgtgggaactgctcaaaagcagccataggcaattcagaaacaaatggatgtggcaggctgccaatgaagctctataaaaataggtgactggccggatttggcccatgggccatagtttgccaacctctggtttagatctcacagttggttagtagaaacccatatgctaggccacagatagactaaccttcaacaagtgatcttccttctactagatgcagttttcctgtttgaagcagtgtctataacatacccaacttctgtagaggttaaataataattatctttatgtaagttaaggcaaatatcttagcataggtactcatagtctagagcgcagaaattttcattatctgtgtctttatgagaggtctgcattttgatggtatttaccaaatttaaagtaataatcacagtatatgtgttttactaaagtaataacccagacaataatattcctatccaagaaattttttcagctagaaagtcagaaaatgagacagcgtgatcagaccaccaaagcaagcaagaaaaaaaaatcagctaagaaaaatggagatctgattttcttttcacccagtaaaggaatcagttgaaaatctcttaattcttccttactgtgctgatgactcatggggagatactttatctcagatttcttttgaatacatctgagtaaatttgaatatgaattatatctaatagctagagatgcttcctacgagtccttgggaaacagcatggactaaggctgaagaagtggaaagaaagccatcacaattaatgtggagagttatgtgtttggtacttatgaaactttgggtatttttcactgtttgtatagcctttcttccaaagtacactcataaaaatagggttcctgaaatgttaaaaagccactggatctggtcattttccttggagattaatttatctctatttggcaattacttcgtatctatgtttttcagagaaagtcactctacctcttcccttttttatctaaataacacattcaataaaagtgcttcatgtcctgaaaaaacaaaactgtcttatttacgattataaaatggtgttcaatcaatgatttccctgaggggataaacactagagatggaaaaacaaaatcaatttgtttttcacaaattgacatccctctgtatgatgccatcattgaactgaagttattgaaaggggccttatagagagggcaccatagagggaaatcatagagaataacatcatagagaggggtatcatagagataataactgcatggagaggagcctcatggagagggagctttgagaggggacatggaacacacagtggtagattaaaataatccagtaatcaatttggccacataaataatagtgatcataatttatgagggcttcccatactaattaaaatatgcataataacaacagttcattttcataattgtacacttaagtcatgctattttttctctttttgcctagttctatggtatgtgtgatcatggccttacaacttttagaaggtactggcaaatgtggttgcagtgaactgtttttctctgaagctttctgcagtaatcctcctggcattattaaggtttccttaatcatacttggttagaggtgatttgcggtcctaccaaccttaatttgaattttctctctgcctcagataagcttgactctggggaggtttctgaacatctttaaatttgagttcccaaattataaagtgggttcagcaatgactgcttttcatggcttatttgagaatatatgagattgtgctttaaaggattgagtagaatgcctggtttgttcattagttttttcttttcttttcttttcttttttcttttctttttttcttttcttttctctttccttccttctttctttctcttcctttctttaccctcccttctttccttccttttttttttttttttttttttgagacagagtctcactcttgtttcccaggctggagtgcaatgatgtgatctcggctcaccgcaacctctgcttcctgggttcaagtgatctcctgtctcagccttcccgagtagctaggattacaggcacgtgccaccatgcctggctaattttgtatttttagtagagacagggtttctccatgttggtcaggctggtctcaaactcccgacctcaggtgatccgcccgccttggcctcccaaagcgctgggattacaggcataagccactgtgcccggcctccttctttcttttttgagacaacatcttgctctgtctcccaggctagagtgcagtagtgcaatcatggctcactgcagcctcgacctccccggctcagcctccagagtagctggaactacaggcatgtgccaccatgcccagctgatttttgtatttttttgtagagatggggtttttgccgtcttgcctgggctgatctcaaacttctgggctcaagcgatcttcccacttcaacctcccaaagtgctgggattataggcgtgaaccactgcacctggcccccaaaactttcaatgatgacaaattattccctgtagtaccattactattattctaccctttggcataacatagcctaggctgcatgttctgtcttcttcaaggaagtgtctatgattaggagaaatgcaagagggaggaacatactggaggatgattttatctctcgcacatatgtgaggacagcaacacctaagtttgctcactccaccctagtaaaacttcactactggcttaatccttgattcttgagtctcagtggggagtcattttctagtactgttgagagttatatagccctaagggattttatgaaataaagtgttcccaaggagtgttctagaagatgagtgatatgagttaataccaagggtttcttctgacagggagtgttaggtgataagacaactgctgaagattgaactgatctttatccagggaagttctgcacttgagattgtctttataggacaggcaacaggcataaaaaaaaagtgctataaaaataggtttgtttgtttcacagtatcattgagaaaacagctataaagaagatatataaaaatatataaatctatcatgtggtcattaaatgccagcgacttattgaacgatgatttataaatggctgaaattcaaagaattttcatggaaccaaaccaaagcatttcagaacatctttcgttctttcaaaattgaatcaactgttcttcattttacagcttctaaatattgtttgtgtgtgtttttgctgttgttgcacaggaaataatttttaccttaaaatattaaaaacttttttttctaaataataaactccatgcagtaaaaggcaacaatcagagagtgtaatgctagaacatttcaggcatgcccaaaatgcccatggcaggatgaaggaggcaacctcatggggcccagccatttgtcttgtaaagtcttaaactaccataggaaatccctgtaggatgttctattgtgtaagagttccatttaaaatacattggcaatatcctaaaaaaaaaagcagtgaaaatctaaactatgtcttgtagcttattcaaatctattattcatctactgcagcagccaacactgctgcatagagctaaaggagaaaaaaaacgaagataaaataagcaagagaatcatgactactatgaactgataaataaaagtgttaaaaaagcaataaaacaaaccaccagcttgttattgggctttcaaataggtatgtttccgcctcctcctcctcctcctgctccttctccttctccttcattcagaagcaatcatcataccacaagcaaacaaaccattttgaaggtgtttaccaggaatgtttccctcccttttaattttctgacctgagtattggtacaattttttctttcatcctttttgcaggcaaaggggttactggatgtgctaaaggaaagtatgattgtagagtgggaaaagggtgaagaacaatgttttatcttcttatgtcaattaggcaggacaaaagacacaggctcccaaaaataccttcagagtttgtcatcctggatcatgataaccttcaatatgttgaaagtctcgttcatctgggttcaagatcccacacttaacgaaagaaaggccgaaatttcccgtaatgttctttactttgggttttacaaaaacacttctatccaggtattttttcttgttgaaattctgaagtaactcaaggtgtacacatgtaatttaaaacttagctttgaagccgggtgtggtggctcatgcctgtaatctcagcactttgggaggccaaggtgggcgaatcacctgaggtcaggagttcgagaccagcctggtcaacgtggggaaacctcgtctctactaaaaatacaaaaattacccagcatggtggtatgtgcctgtgcctgtagtcccagctactaggtaggctgagacaggagaatcacttgaacctggtaggtggaggttgcagtgagccgagatcacaccactgcacttcagcctaggtgagacagcgagactcagtctcaggaaaaacaaaacaaaacaaacaaacaaacaaaaaacacttagctttgaaaggaaatagcctatgtttccacaaattagagttcataattatgttgcatttctactatataggacagcaacattttcacctgatctgagctcatctattagcctttccttacaaatttgaatcaaaactttcgccaggctataaatctccctataattggtagagagctagataagaattatcccataataagagtttgggagaaccttgtggtattaaagggatgctgacatggaatactgtatatatttctactgttaaattagatgcagtcctaatactgtttgtgaaactaaattaggtcaatgactcagagctggttttatttagagtgagctatatattaaaatgtagcaatatttcccttcttctgaaaagccttctggtaaggatttcaattcattgtagaaaaacatttcccaaattaaggtattttaattaagtcctggtaagaaattccaagcatgcttttttttcccctcctcaaaagaggccttccacattgtgcatttagtgtttactaagatttcaaatctctttggttctaaccagtatcacttagataacacatttcacttttttttttctcccttaagtgtaacctgggaaatcccaactttccctttgatgcactaagtctttggcatctcaatctgttaaaccagtgcaacaatcataacaggcattttctggagatgttacaagggatgaaaaaaaaaatgaatgaaatgagttgactttttaaagaacgatgccataagaagcaagacataaatttgctccagaagtcaaatggtgtgtggggagaacaggctttgaaatcaaatggaactggtttggagttccagcgctggcatcactagtcgtgtaaccctgggaaacagcctgagtacattttgtttgtttgtttgtatttttgagacagaatctcactctgttgcccaggctggagtgcagtggcacgatctcagctcactgcaacctccacctcctgggttcaagcgattctcctgcctcagcctccctagtagctgggattacaggtgcatgccaacacacctggctaatttttttttttaaaaaaacagagtctcgctctgtcacccaggctggagtgcaatggcataatctcagctcactgcagcctttgcttcccgggttccagtgattctcctgcttcagcctcccaagtggctgggattacagatgcacaccaccacgcccagctaatttttatatttttagtagagaccgcgtttcaccatgttggccaggctggtctcaaactcctgatttcaggtgatccacccgcctcagccccccaaagtgcttggattacaggtgtgagccaccacacccagctctgagttcatctctccatcactagaaatcagggtaatcatacattccttatcacattattaagaggactagagatagaatatgcagaatactgggcatgtagtatgtgttcaataaatggtagctgctattgttactgctactactacagctgctgctactactaaactgctgctattctcattgttactattatgactcctactattatttctactgccaaacaaggaggactgtggaaaaagaagccactttatccagctctaaacaaatgagttgttacctcactgtagcccacctttctagcaggaataggagaatgaccaagtgttttggaatcagataaacccaagagtaacttaaggagaatgataggaccatcgttgataggagagcctgagtacattcccagtgctgtacttgtgtggctgtgaaaattattgttccaaagttgaatattgtcaagggtgttgagatttatctcatggtcaatatttgatctttcaaagctgacctatacctaacacacttcaaattggttcagtgtatgtagcccttgttacgtggatattattgtgagcacttatataccagggaatgtgtcatgaggaagaattattatgtgtttggtatgtagtcattgaattaagacttccacataatgaactggaatggaattgcattagaaattctttttttcatccaaaataaaagtaaactcaaatataattatgatgttgccttctaatgtgacctgattgccatatctttgtaatgttccgttactcctgccaacctaatgtcagtgtgtactccaattcaattcagcaaacatttattgatcctagtcagggatgggaagacactaagattagcacaaagatacctttgtcattagtaagttactacccagtaaatctggctagtatattaaatctatggtcattttttacattttgcttttcattctaaacatgtaaaatgataataaaaaaagaaagtatttagaacagtaaaggttcaagtccaccccttttttcttcacctttttgtttagacactatttctgacgttaattaccacattaattgggtcttaagttccccttccagtcctcattatgacttccacatttcttacaactggcagaccttgctaagtcgtgaactataagttttttttaaaggttcagagcatttagtccagcaacacaaattaccctatggagacactatatacactagtagcaatgagcaaatgtttcttttatttttataattgttttggaaaatcatatgattgccaaagacagcctacacatggtcaagttggattcatcccagccttaaaaagtctgcgaaacacattaatacttgtgatgtatagagttgagggatgttttgttttgttttaacatgcttcttatatgtacattggtaatgtttaatttaggttaaaattctatgaatgatttaattgatattatccaggtttgttaaccattttaaatggccgttgattttgccaaattccattctatgccattagaacgctgtccacactaagttccgttaatgggggtaaaactcccatcatttgactcttaagtatggtaaaatagctgtctagaaataaatgaaccagagtcctggaaaatccagtggagatgcctagcaatgggggtccccaaagacttcagcgtaaggtgcttatcccttgaagcccccaccctcccacccttcctctatttgtttcttaattgcacattgttgttcagaaaattcacacttgggatttttatattttgtgatttgaactcatttttgcaatttcctttttacatttctagagagctgcttgaaatggatgctaaactacaattccagccttatgtgttaggaaatactttttctctactacaaagtgcaaagaactggaaactactttagtagagttttcatttaaaaaacctctatcgtacttcagtactggaggaaagaaaatgcttgtcaatcaacagccttgtgtttttcagtcttgatatatgtaattgatatatgatatatcaattatatgtaatatcaaaagagatggtgtgcacaaagcctgcctcggagtacattgaataatattttattcagatattcattttaaagttagtgatttcagatatggagaagttgtagtcaccagctgtgatttactggggggtggtgggagggcagggggacctattactggcacctgaactggtgatttctgtttacctgtaatccaaaaataagtaagtgtctgctaatttcacctgctaacatgtgacagcatctttccaggcaaagagtagaggtagccctgagagtgaggcctttcttttcggctcatgtatgggagagaattgtgttttttagcagagaaggagatagcttagacctattgcatttggtaccttccgtagaatgtcagtatgacaagtaactggactcttccagacagatctcaagagaacctgagtgcccattcaagagaactggaaaaactttcaactcccaggcagcacccgcatagctctgaaatttgagagcactctgcactctcaattcattcccaggatttgaaaccaaagtgccaaattgttttctcaaactctgtaggaaccgttatccacctactcacccatctacctgcccatttctttagcaaatatttgttgagactactatgcagcaaatactgtgttcggtgctttgaatccaatggggagggagagcaacctgggtcttgtcctaaggatgctttccttttaagggaattcatgagtcttttctgccctaaattgtctaactgtaagaagaggcagggagaacctcagtatgtgttactagagaacattggcactagtcgatttaattttcaccaaattgactatttggatgagatcctcattatgcacagtgcacatccaacttagatggaaccatctaaattggaataatagacctttgtgatctgtgactccacggatgaaatattgggtctcagacaatcaaagacagactgactctcactttgaagcaatgcatcaggctttataattaaactagtttagtcgcaaacttcttactatgaacctcaggacgttctgcaggtaacaactagaattatttgtgtggaatactaacagcccaggaaacagattaaagtcacaggcagaattctttagccttgttaagtacttggtgttaggaagaatatggaaatttcccagatcttgaaacattgtaaaggccctgggatatactatctaaaggcctgcaggcagtatccagaagtcttccacgatccttttttctttttcttttttgagatggagtctcactgtgtcacccagtctggagtgcagtagcacaatcttggctcactgcaacctctgcctccaaggttcaagcgattcttgtgcctcagcctcctgagtagctgggatcacaggcatgtgcaaccacagccagctaacttttatatttttagtagagatggggtttcaccatgttggccaggctggtcttgaactcctgacctcaagccatctgcccgcctaggctaggattacaggtgtgaaacaccgcaccgagcccaggtgtcttccacaaaaattagccaggcatggtggcacctacctgtggtcccagctactcaggaggctgaggtggaaggatcacttgagccagggaggtggaggctgcagtgaactgtaaccacaccactgtactccagcctggctgacagagtgagactctgtctcaaagaacagaaagaaaagaaaagagaagagagggtttgatttttttttggctattgaggaaactgtagctgtaaatagtgttaattctcagaaaaccagttaaatggtaaaattcaggagatcattataatcaactttaatcatgaagagatagttacatatgtggctcagtttctttttttgtttgtttggttttgttcttgttgttttgaattcagaagcagctttattttaagaatctcaatttatagtgaagtctcaatctctttagtcatcattatgtaaaatagaataacattgcaaagaaaaatcaaataaaagattaaaaatcctagggctagcacatgattgaagcaatattgaaggtcacagatagtataaattctctgattattaacagaggtgagctttgttatagggagatggatcattattaagtcatctgtctgatctagagccagccgcacgatctaatgatttcattcttggattatttttaatatgtagaattagagatgtttgggaagtgtttgctattatcttgatagtacagtttcctcctaaattacttttgtaaagtaaaataatgttacattggaagaaagtgtgtatttcttagtaatgcttcacaattcctcatcctacatttcaataaatcatcttatacctgtcagcacatgtagtctaagatttattgcatggtccattgtgaagcagatagctccttggccagagagcaatttctgaaactaatttaatcaaaatgtttttataatacagtgaactatggcttgatgtcttaaatatgcattgatgtcttcagaaccatatgattaaactctatccaattttgaaatggaattaagatttggcttcatatgacttctgttatagtcaggaaatctttggttgcattaatattatttatgtactgttattgagcaaacattcatcagtgcctctatttgcacagccaacccgctagatgttaagatgttgtgggggaacaacaacaaaatactagtttagtagaaagacgtaactgagagcttggaaggagcagtagacatggcacaatttattggccaaaaaggaatccagttttgctgaagttgaatgttcattttgcagggtggtggtaattatagctgccttctactgggaaagttttaaacctatagttttgatgagtttgcacgccaactcaggagtttgaacttcatcctttaagagttgaaaaattttggagttttgagagtgatgtaagcttactggaaagattacgttgacggccatgtgtggacccaactggacaaaaattagaggaatgaaaaccagtgattcatggaagattgttagaatggaaaccttgggaagaaaagggaaaactgaagtcaaggagtcttttaaaaaaacaactccccaaaatctttagagagtgattagatagaagacatgaagagcatagtaatatcttttgtaaagatcgaggccgggcatggtggctcatgcctgtaatcctagcactttgggaggccaaggtgggtggattgcttgagcccaggagttcaagaccagcctgggcaacatggcgaaacctcgtctctaccaaaaatgcaaaaatcagactggcgtggtggcacatgcctatagtcccagctacttggggaggctgaggcaggaggatttcttgaacctgggaggtcaaggctgcagtgagctgagatcacaccgcagtactccagcctgggtgacaaagtgagacactgtctcaataaaaataaataaataaataaataaagggaaggtggggagaaatttcaaaggaacagatgatgcatttaagacagttgagtttaaaataacaggggaccagcaaagctgaaagttggtattgaactgatagtgagagactaaagcttaggtcagagttgagatctgagatcaaaatctgaatcgtgtcaggacagaggatggagttaaagctgtgaaaaagaatgccattgctgatggaatatgtacatatgaagccactgttttattataattgtttggatagaacatgttctggtgggaaactcacttgcagtcaaaattgcacagtgctaaagtctgcctttaattatagtaaatgcattcgatttgagaatttgttcattacctgtatcagtgacactttattcaaataaaaacagcacactggagaaagataacagttgtggaaggccaaaagtcctctttgtgatttactatcaccatttaattattaagctgtctgatgtcatgtgacactgcctccccagagtgtcctatcacagtgatagacgaaggtcacagacatttggaaatcaaattataaaagtcacactaaaaagtcctgagagcaaagtttaacatgtttgttttcagctttatatattttctgtcaagctgaattttgaattttgaagaggtacactgagtccaaccaatggttgggggggcattattttttcatcataaacagatgagtctggatcctctgctggctggttgccctctccccctttcaataccacttaatttttttttttaagaacgacgtttataagtaatcaagaatacactgggagcaacttcagcatgactgtttttttgcgtgtgagagagggcacgttgtgaacatctgagttctatcttcatttttattagaaaaagcaatttagaactgccagtcagatgggttaaaaagcacagctgatcgaggtgcagcatccatgcctgaaccttctgtgtggcatgacattggctcataacccccttacaccttctctagctctctcttcagttctgcttcctgttccgcagtagagactgaaggaactcgggaaaggcccaagaatgggacctgattacaaagccttagtaagtaataagataacaaaatgtccacaagaaagggaaagtggggagagaagcagagcaattgcttacttcctacttagcttttcctctctttctgttttcccaggggaaggtgcccaacaatttgtatttttaaccggctccccaggtgactgctgtggttgggccaagctacattttgagaactcctggtctaccttctagattctacagaaaagatgagactttgcaatttgtaattgttataactggcaagtctccttccacttctgagtattggacagttttctctcactggattaaaagcaaatggcttggtttttaaaagtttttgaaagtaacatttattatttgacttccgctttagcaacacgttgtatatgtaaactcaaatatagttcagggaactgagagctagttcacttccaaaatacagtgacccataaattgtctttagtcatgtataaacaaatgaatgctattgggaaaatgccttagtaaatattttttgtaaaacacagcaaattaaatcactttctagaaaatctattttttttttccccaggcaagtggccatcaatcaaagaagcagaatactaggtgtggttttctttgtttttgttttgttttgtttgaggcagtgtctccctctgttgcccaggctggagtgcagtggcacgatcatggctcactgcagcctcgacctcctgaactcaggcgatcctcctgcctcatcctccggagttgctgggactataggtgcatgccaccacgcccagctaatttttaatttttttttttttttgagacagggtctccctatgttgcccaggctggtctcaaactcctggattcaagtgatcctccagccttggcctcccaaagtgctgggacaggtgtgtgtcaccatgcccagcctcagaatactttatcactttggtttccaaatattgggaatattttgcaatttaccttttagactacacaaggcttcagggcaatgctcttgcctgagttgacgtttgaaagtgaatagagctgtaaatctattcttttgtcgtcagaatttttttaatgtttttcctaaatatttaagttaaatgtgttaaaatattgttgaatgataaacatctgtagtacacttctgttgtgtttctggtgaaagtaactactgttaaggtcaacagaccaaatttgtatacaaatgctttggcaaattagaaattgaggtgaccattcagtagctctttttaggcattgggaatactcgaatgcaagaaagcattcccttatattttcaagtataaaaagtcctctaaattccttaacagcaacaatcagtgtttccccgctaagcactgttttaataaagttgctgggattttctatgataaaatcacataaatttatacttctacatacatctatatataattttattcctgtacttgttatatacatataagctgcattacaaatatatttttattctgaataaatcctaaagtataaaagtagtaaattgaataaattattgattttccttcactgtatcacagaacctgtttctccattttgagcaatggttctcgaacttggatgcacattggaatctcctgggtagctttcacaaatcctgctccctggacctcactcaggcgaagttatttatactctccggttgggaagggaggatagatccaggtgattgccatgtgtaggccagaatgggaactactcccctagtagacactcctcatcttctttccttccatgatttccacatttctttcaactcagtcgaaatcatcttgaatagacaaaggcagtgtcggtcctactaaaggttgaggaaatggctgagtaaagatgatgaagtcagggacaaaggatgcaatgaattttaagaatttgagattcaaacttcaaaacttaggcaagggtctgtttttgaaggttcagagctgaaaaacaatggcatgctttcatattcttctttgattctgtaggatgtcccaaatggggaattctcttacataatattgattttgtaaattcctgacagatcgtacccactttggatggaatggaattttaatctatttttttgagccaaagagtgtgacctcccttggccttaaatatttttttgtaccacacatgtggggatatgagtattgtgaaagctacgaacctttcctttgaatgccacaattcaagaacaaagctgatcatgtattgaattttaataatcattttcagcagctggtccagaaaagggcattttcctctaaaacctaaaaaattcagaagataaattcctatagaaaaaaaggaaatcatacttatctattcaaaattattagatcaaagactttcaactattttagcttcaaatatgtttaatatattgagtttaactgacatgaagtacctgcaggatgcgtggtgctggcttagaaaaagatttggttttcctacagtatctgaaaaacaaaaatgtattttcatccatccaaggctaagcatccactatgagactaatttgacattcaggtctggtaaaaatgtttgatggtatcagttaaaaccctgttgaagtaggaagaccagaacatgttcattagtgagtatctggcaatgttatcatctacttaagatggaagaaaggggataagatcaaaattattcaatccctgagtgatggaggaagtaaagcttgaaggggcctatacagacaacatgtatgacatccatcagtatcaggggattttatagacattaattatctagtgctctacaccctccctgcctgccttttaaggtgtattttatgattgaggaaaaaaaaaaagaccaggataatagaattgaggaagatagcaatcaatgagtaattccttatccagtcggcacttaaaactcaatgctttatatatttatttgcagagtggtaggaactaactaatcctcatgctgtgccttccttactcacttttgaccatgtttttgctatagcaaccttgatacaattgaagattgtcatttcttactcttcctcagtttgaagctcctgctttcctggacaaaagacacaaataaaacaggaatttattcaatcattgcattttatccataatttaagacatcttatctataatttttttctgagttaaaatttattttggtggttaacaaaaagagtctttagaattttgagtacctgaaggattggaatttgaggcatcctcctacactcccatagtaggtgttgaaaatgttaagttaattgaattatattgaaattttaaaatggcttggagcaacagaaaaaaaatgttatgtataaattaattaaaaactacatggactgtttttttttttttaccatccacatggataccagggatttcttttctttctctttctttctttctttctttctttctttctttctttctttcttttctttctttctttttctttctttctttctttctttctttctttctttctttctttctttctttcctttctttctttctttcttggattattaaaaagagaaggttgttttttaaataaggaaaacaattttctgcaaatggccagatagcagatattttggtctttgtaggtacaagtcctcaactttctcattgtactgtgaaagcaacagtaaacaatactttatggctacagaaatgtgagttttgtatacttttcatgtgtcataaaatgttattcttttcattttaaaaaaaattatttaaaaatgcaaaaatgagggcgggcacggtggctcacacctgtaatcccagcactttgggaggctgaggcgggtggatcacctgaggttgggaattcgagaccagcctgagcaacatggagaaaccccttctctgctaaaaaatacgaaaattagctgggcatggtggtggcacatgcctgtaatcccagctactcgggaggctgaggcaggagaatcgcttgaacccaggaagcggaggttgcagtgagctgagatcgccccattgcactccagcctgggcaataagagtgaaactctgtctcaaaaaaaaaaaaaccattcttagctaacaagccacacaaaaacaggcggcacgcaaggtttgaccagtggaccaaccatagtttgccaacctctggtttaggacattgaatatctcctgatttgaaagttttcacttgaacaaaaataattaactactattagtctgttctacaatatcctcctcaccatgtaattcttaactggcaagtagattgcctcttttgttttatttatttatttattttaaaagacagggcctctttctgtcccccaggctggagtccagtggtgcaatcataactcactgaagtgttgaactcccaggctcaagcaatcctccctcctcagcctcctgagtaactgggattacagatgtgtaccagctgtagtctacaaatttgacctgtacccaatccttggcttaatattaatttttaatttttaaaaaagtttttgtagagatgggggtctcactatgttgcccaggctggtcttgaactcctggtttaaagcaatcctcccgccttggcatcccaaagtgttgggattacaggcatgaaccacagtgccctgcctgtggcctcttttgatattgctatggcagcccagagtactgtgttgagaaggattcagaagttgaacaagggcaaatgagcagagagggctgccagagagttgcccaattggaccatccacagctcttctagctgtgttatagtcttacaaaatgcttcctttatgtcctgctgataaaagttatagacttattcttagaagcatttttctgcaggcataaattttgcaactgagatcattgtttttaagttagagaatttgaaaggattctagtaatatagcttcatgtgatatccattctcaaaaccaacaaatgtatttattggtcatttgctcacctctcttattataggcagaaatggggctggggaggaggagtgaataaaaaaggccattcacatctctaatacctggaaataactagtcgtcattggatctgctaaaattataactaaatgaatagaactatactaagatacctatttatctccattaaaataaaagctcttctagaccatacacagtatttaaaagttgttctctgtatgttattgactaccaggttagaaaaataaacactgaactcctaatgatggaatttataaatatatggaacagattctgtggtgttaatatagaaatttcaaataaaacctgacaaggtaaacactgtatcacatatcaaaatgacttaaattgtagtccatggaatactagacttaaatttatatgcagattgtattttattaggtttttgaagttccctcggcggcctgtcttgccagggcatttggaaatggtagctattataaccaatgaaaaaaatgcattaaaaaattaaaacaacctaaattacatgtatttgcggtctgtcgagtcaaacctgaagatagtctcagcctcctgcagtgcaattaaaacatctttaaaatttagttacatataaagaatttatgcttttatacaagtggcatgtgttaatatgggtgtgttttcatattaactattgtgattaaagtttcttagaagaaaatatatgggtcgtggcacttgacgtgtccatatcctgatcacgctggagtggtggtgttgggtgccagggctccgaatacagttgctgaatgtcactctgaatattatggaatgaaacaagccagatctgtgtttgccttgaaaggtatccagacctaatattgtactttaaagacattctgaagtattgacttcggaataagagcaagcattctttaagtcctgggcaaacccaaaaggaattactgaaatctcctgtttcaagcatacattttaatagtagtgctcaatgacaagtcattaattccctgcaacctgactcttaggttcaggtctccaaaggctaaaattaggggcatttgtctgcttcccttgctatttgattgggtatcactgtatgtagaagtacaaagctcatctgttaagttggatttactattctctgctggtgtccctatccatgcctaaaggctcatattgagattggtgtaaaatcagctgtcccaacatgaattgttcaattatcagctcaaataagccttactaaaaactacctaacatgaaggaggttgactgtggctctgtgaagatgcatccaaaatgtgtgcattaaaaataaaaattataagaaaaattaatcaccctttttgcataaagtatgtaaggaagcctcattctttaagcaacacatgttttataactttgccttccacaaatttgacctatacccaatccttggcttaatattaagaaactaaatctgcccacaggtatccttgccttttataaggaccattttgaattatttgtatttcttttctttggtggtagtggtgggagggtagtattgaatgccaccaagtcgtaaacctcacagaataagagcactatgaaaaaatcacttggggaaaaggtaatgaattaaggctgggagcaacttgactttgggtttagatggaacttgaagttgatgtgttagtgataattgctatagcatctctctatttttataaatcccggtttggaaaaatttgtttgataatgttatatttgccttcacaggaatcctgtgctctggacagtgttatataacattcctcaaaaattcttctaaactctcaaggccctcttcttggggtcagactcaacggtaccaatgagaaaagcctgaaagcatggaagacttctgttgtttagcaaagctgagagaagacattgtcttaactatctacactagttgttaaattaactaatcagttgatttactacattggatttcagaagggttgtccggtgaatattcagttttccatgctaattggaaatatcattgcatatttaagggtgtacggtgggaagggactaagcaatgatgggtatacagcaagtactcaatacatcctgtggctttattatactctctttttgctggtagaattttctgctacacacatgcattccaggcaaagggaagagactgcgcccatgctcagacccagaaacaagcctggatccataaaacagcttgttcacaatggcaggagcacagcacaggagtggggaaagtagaggaaaagaggtatgagtaatactgaccacgaaaggaaagggagttgcccattcaaactaacagatgagaagggcttcatggacgagatgacaacaaatagtagcattagcattcattgagatttaggacattgcacaacattttagaaatatgtacacttagtctaaaacagggacccgcagtccagatgggaattctgacaataatcacatcatgagaaagctgagcaaataggattcagtgtttttggaaaatgtaatcttagggggaaatatattcttgtagctatgtactactaaattgaaaatctacagaacaaatcatttatgaaatgtgtgggcatgcttttaatttggtggtggtttaaatattttattaactgtatgggcatgcttttaatttggttgtggtataagtgttacaaattaagctttttttaaaaatcagtctaaactcgaaacttgaaaaacaagttttttattttatttaacaagcaccgatacaacacatcgtgagccaggtactcttcctagggcttccatgtatctcctcctctaatcatcttgacagccccatgaggaaactgaggcacagaggttaagaacttgttgaaggtctcagagctaggacttcaaaccaggcagactggcaccaggttctgtgtacttaaccattatgctccttaaattagaatatctacgagtcaaaatgctgtttaattttcttcagattattgtgggttctgtcaagctaagctttctgcccataagtgaaagtgctcttagcatcttgtacagaaagaattcttcctagaggttcattgagtggcatctatttcagacttacacaaaaagtttgggacaaatgttagtgtttaacagaagcagatgtttatcagtggcccagacaatattatcattttgagttttaccttctaggctgggggcgtggcaaacaacagttgtgggtcaaatctcactcaccacttgttttggtaaataaagtttcattgaacacagtcctatccactcgtttacatgttatctatggctgctttcatgctaaaacagcagcagaattgagtcattgtgtccaagaacatatggccaataaagcctgaaatatttactacacgatcttttatagcaagtttgccaccccctgttctagaccagtgaggtagccaccagccagatgtagctcccaagtgtttgaaatggggctggtttgagttgagatgtgtcataagtgtaaaacatatcagattccaaagacttagtaaaaagaaagaacaaaatataaaatatctcatcagttttcaaatattgattgcaggtggaaatgacaattttattaaaattaacttttcttggttctattttttttaatgtgactactagaaaaatttgaaatgtgactcacatttgtggctcacattaggtttctattgatactgctgatctacagcctggaatttggaggatatgtgacctctaggaaaagcagaaagaggaaagatggggaaagagagaaaacctcttgtatttgcaaatgtctttctaaagcaataaaatattttctgatttggctcttcctcacagaaaggcatacgcaaaaatgggttaggtggtctatggagatgatcgtagatgagttctcccagaagcagactctgactcagaatttgaattgggaggtgatccaggaagcacctggagggagaggggatgcaaacagggaagagattgaagaggaaagagggttaatgagcaggttgttgctgtggacccatgtgctgcctcccaattgcgccctgtgggagattttgtagacagaggctcagagtggttccacccaggaggtgaaaaagctgggctgcatatccaccaattgccagtaattgccacttgagggctgctcctaggaacatcagcttcttcttactctccccagcacctgccttgcctgaagccaggtaaggccctggggtgaaaaggcacaggtgcttgcaggaaaaagccatgagcaagctggagaatggtgcctcccagaggcacagggttgggcccttctagtgtctggaactgtgtccaaactaaatgttccatcttctaattcataatttcaacagacattcatgtagttctctggtgaatgtgttcattttctcatttgatcttaacaatagtatagataggtagatttatcattatccatacattatggatgggaaaactgagcccaagacacatccagtcatttgccgaagagagtccagctgggatggtagtcccggtctcctccctcttcatatgtggtcactgactccttggatttctacaaaacttgccttgagtaaggagatgtcaatatattgatgttttcaaggtgagaacaggaaactaaaaccaatttttcttgtgctctgtagaatttttttagatatccatagggcagtatagaaactgatatctacttaatcccatgacttttatatggaaaagtatgatctctgttttgcacaagtcacaatcaaaatcaagagattatggagactgctgaccactaccacacaggatgttagtgatagagttaatttccagaaaatcttcagagaagtccctgtagtggaagcttatgggtgcatggctcattaaggactggattttgttatcttcccattacccaggttcccttcaaaggtgttgtcagcccctttggtaccacttggaaacaagtctctctcccagcttaatttccctttattatgcttctaactgactcggtaattctttgcagacttcagtaacacttgtactatttaaatttgaataaccccaaaggatctggataggtcaatgtgtttaaaccacaggctttagtctatgtattagttgattaaaaacagatttgatgcatgatgtatacttaataaagggagggggaagcaagcagatgtttgtaaaatctcaatgtgttggattgcatttctttggccctcttttgctgactaactttagaaaagtcatacttatgacaattgaactgtaaacagttagatgatgtatttccctagaaatttcctgctgtgaagggtcagccaaaaagaaaagtatcccctagtattaacataccaaaaaagttgacaaatatacgttataatggttatgtctatatcaaggacattgaagaatgggatgcttcaaaatcatcctctagtctctgaccataaagtgattagcagttgcgattcatttaatccaaacaataaaaaaaaaaaactttggcttttgttgttgttgttgttgttgttaaaagcaagtttttctttgatgcaagcataagatcaagttgtacataaatcactgtgtctagttcattctctgactcttcagcctcttgtatcccattctttaagtgaaaaagttattcttcccctttaaaattgtcatatttgaaatgttttgagtgattccaagacagaattgaaggtttcttgttggttttccagtccagatgaaatgtgcacaaagccttcctctgaagtttgaacacatgagaattacagataaaatattttaaaatgtattttagtgaatacataaccaagcataaacatatgtggaaagcctccaaggaccggaaatgaaagaaagtgtagagtggtgagagaagactgacactgggctactcccaagaagtggagatgacatggggcaatggtgacttcagtggacacatagggaagtgaacatcacatgtggcaagagccttgtacacctggaggccaagacccccatgcatagactggactcaaagggaacctgacatcttctctggaattgaagccagacacagaactctcatggaaggaagcagaggcactgagtcaaactaggatctgtgcctctgttgcacacgagtgccttgtgggagcgtcttctttgggaaaagaacctcacgccctaacctcagaatatgcttcttatctggctgggctatgtcaatccccaaatcacagcacagggaacaaagtttacatcgtatgagctgtcagacaaaaattacaagacaaagataaaatcagatccttgagaaatagtcaacaagcacagggaaatacagaattgccttttctcaaaagagcttaagaataagtaagtttagttgttttgagattatggagaagagaatcgtgtttttgtaataggaacagagagaaattcaataagaaaagggagatgtgataaagaacctactagaaatgaaaatgcattcattaaaaaattttaaaatcagtcaataggataaacaccagattaataagtttaacttgttttaaaaataaccagaaagttctgcttttgacatatgcattttaagccttagatgaaagtggttcttttccttaatatacttttctaaataaaaaatttagggaagtagaatgagctaaaattttcataaataaattttacagcataatgaaattaacacctttatgaacttgttagttttcaaaatccctcaaactctttctaaatcctctttcttggatggcattataaatttgaggtctgttttcttttccatgaaatttcctgttgttccgtatctttgccatacttgtggaactgtctatatgctaaaacacagtttccctaatcttttgccctctcaacctctctgatgttggcatacgacattgttctattccctgcccatggaagattcttccacatgctcacttctttctttccaagaagtttccactgttgtgcaacaaaaaacccctggacatccttcaagcctcagctgcaagacttggccctcttggaaacctttaaccagcagccatcaactctttcccttctcttgtttgcagcatctttctcccagtttgtacagtcatccatttccttgtggacagggaatagatattaatatttttatttgatttccccactgtctctttcagagtctggcatattgtagaagcttaataagtacttgttgtatgaacacataagtaaatgaatgaatggtaggaacacataagtaaatgaatgaatggtgtaaatcaagcttgtccaacacgtggcctgcaaggccacctgcagcccagaagcgctttgaatgcagcccaacacaaattcataaactttcttaaaacattatgagattgttttgtgatttttttttttagctcatcagctgtcattagtgttagttattttatgtgtggcccaagacagttcttcttccagcatggcccagggaagccaaaagattggacacccctggcaatcaagagcatgtgaatgagaaggaacagagaaatcttagtgagtcttacccagaacagagagctattgtgtttgaaaataggattaaatagtcattccagagaactttaagtttgatgctctaaaggaatagggaataattctagagtcttatgcaggataatgagtggtaaatacagtgttcaaagaaatttgatctggcattgatggacaaagaatagaagcatgaacaataaaatgtacaattgtttgttggtatccataaaggattaatttcagggtctctcatagatactaaaatcatggatgctcaagtccctgatataaaatggcctgttatttgcatataacctaatcacatcctcctgcataccttaaattctctctagataacttatattacttattacaatgtaaatactatgtaaatagtagttatattctatggtttagggaataatgaggagaaaaaagtctgtacatgttcagtacagatgcagtcatccatttttttccaaatatttttgatctgcagttggttgaatccaggtatgtggaacccagtggatacagagtcaactccactacaactgaccaaatgtgtgtgtgatgaggacttatcataaatgtctataaatgaccttattgtcagcaagagctaaacaattcaaaccttcctccaagggattagcctcagcctgcccataaaaggataaatctgaaaaatccaatggtagttgatttgatgtgggaatatattccttatgttattgccagctctgattcaagtaaagggatagaaatccaattacctcctttcttcctaggtcgtgacctagagataacctataactaattattctgttaagtatccctgagttagtgcaagaagcaggaacaaaaagaataaagtctgagcgtgtctaaaaggttcttttaaatgcaacttttgaaaatccagtttaaatctataaatacttgaaattatgtcgatttcactaaggtttctgaaaaatgtatcagtttttcctgagaatgagtaattttgtgtatctgaagtataaaagtatgcagaataatatttttcctcttttttttttttttttgaacagcaaaacttagagagtaacctcaccaaccttattaagaggaacacagaactggagacccttttggctaaactcatccaaacctgtcaacatgttgaagtgagtatctctgtatttctgtatggtatgtttcatatgaaaactgccagatcaaggttttgatatcctcatgctttataattttaaaacaagaatctttcttaaaattaaatattttgcaaaagccaaaataaaagatggaggaaattaaaaggaattagaacttcagagagtctttcccatccagggctgcttcccattcccattatagctcttcctgatctagcattacatagcagtcctaatgttggagattttaattgcccttacaaagaacagtcaaaaaaggtattgtaggccgggcgtggtggctcacgcctgtaaccccagcactttgggaggccgaggcaggcagatcacgaggtcaggagatcgagaccatcctggctaacacagtgaaaccccgtctctactaaaaatacaaaaaattagctgggcgtggtggcatgcacctgtagtcccagctactccagaggcggaggcaggagaatggcatgaacccgggaggcggagcttgcagtgagctgagatcgcaccactgcactccagtctgggcaacagagggagactccgtctcaaaaaaaaggtattgtattagtgtactatggctaccataacaaattaccacaaactgggaaagtatgaaacaagactaatttattctctcagttttggagactagaagtctgaaatcaagattttggcagggccatgctccctacaaaggttctaggggaggatccttccttgcctcttcccattttctggtagttgcaggcaattcttggagttccttggctttcagctacagcgctctaaacccttcctccgttatcacattctcctggtgtgtctctgaatatgtgtccaaatttccttattgttataaagagcccaccctactccagccttacctcactttaacttgattacatctgcgaagactctattttcaggccaggcatggtggctcacaccctgtaatcccagcactttgggaggctaaggcaggaggatcgcttgagctcaggagaccagcctgggcaacatggcaaaaacccatctctattaaaaaatacaaaaaattagccaggcgtgggagcacacacctgtggtcccagttacttgggaggctgaggtgggaggatcacccaagcctgggaaatcgaggctgcagtgagctgagattgcaccactgcactccagcctaggcgacagagtgagaccttgtctcaaaaaagaaaaaacaaagattctgttttcaaataaggtcccatttacaggtaccaagggttaggacttgaacatacctttttgcggacacagtttaatgcactgcaggtgtatattaatgcatcttagttgtcagatatgtttccatgaaataaaccacaattgcaacaacagcagaacctgcaatgactacactgaataaggaaaaaatagatgccacttcctttatgtgattttcaaattcctcttccatcttctcccaaactgtcttttttaccaccccaccccatgaactgaaactaaacaattatcattcattacacttttaagccttctggcccttaaccaagcagttccctctgactggtaggcccattcctctaacccatgtctatttgtcagaatgcttcttgtgtatcctccaagtcctaagtcaaggggcacttcagttgtgaacgtttctctggttccctggaccagagtcatcgctcctttctctgaatcacgtaacattttatgataccgtgtatgtgattcagagaaaggagagatgtccccgccccaatctcatgtcgaattgtaatccccaatgctggaggtggggcttggtgggaggtgtttgggtcatgggggcagatccctcatggcttggtgctgattccatgataatgagtgagttctcacaagatctggttgtttaaaagtgtatgacactcctcccccaccgcccgcccccctcccatacacactctttctcttgctcctaatttcgccatgtgacgtgccagttctggctttgccttctaccatgtgtaaaagcttcctgaggcctcatcagaagccgagcacatgcctggtgccatgcttcctgtgtagccctgcagcacccgtgaaccaattaaaccccttttctttgtaaattacccagtatcaggtatttctttatagcaatgcaagaatagtaataatcttctcatggctttatcattctttcatgtaccagttccatttttccaaccagaatgtgaggtcttagaggatgggaatcaaatctaattcgtctttgtatctcacagactctgatgcaatgattttcacacagtaggagctcagggaatttgttttagatgaatttgcatgatgactctccaaatggcaaattttgaacactatttgaatgcctgcaagttcagctcccctaaaatatctaaagttggagaagcaaattattttgagcaggcatttaaaaattttgacagtaactccatttttgcaataagaattccttcaagtccctttgatcgtctacgcagtaattataagtttatagcctcctatgtgcctataactgtcagtagatgcacaatgtagcaaataataataaagattacaatatgttagagaacagtgtacacacatataacaacatatttaaagaacagtagagtagccaatcaggtgctcagctagtagaatattgcatttatggattctaagattagcatttttttgaagactaatattgctgaaattgagctgcaacttaaatgaatggtgagacagtttaatgggcaacatttgtttgttcctactggcacacaaaatatagatgagacagttgctggtatcttagattagatggagtatggtttgagaaggggggattaaaagagaaaaaaatgcgaatacaatttttctgaagctttgtggaagagtcaggacttgagccagttcttatagatttcacaactattatttttcagtaccctaagtattgaggtgtcagcttatttatgcaacacaatgatgtttgtcagtgatacattcctcagcatagcagaaattagcaaagattgctttcagaaagatcctatcagtgtaaaagcatgtctactatgcaaatactggtgctttggtggaaggcttaaaatactttgtgtttgtaaagtctgtgcttttacttacaagtgctccccttgtgatcagaaatgtaaaactggttactaagagaaacacatgagttagcaactttttccaactccaaatttgttgtgttttccaaggataatatccagggagacagaaattagggatgttctcatctcctacctaagccatctactccagctgttcatcatttgaggtgctgatggaggttatgataggtggaagagggaaaggcatacaaaaggaaagaaagggaggaatcagagtaaaacataggtgagagagcagattaggattgtccagtgagcttattggttcacttagtagaccctcttgctttaaaagctacatgattgtcagggtagaatcagtgtttcatcatgttgagatgaagttgagagtgtgaaggcagcagtgtgttgcagaatccagaccttttgaaccctctgcttagactggattctcttttggcaagcctcttgccagggaacatgttgagccttgttgattaaacaacattggaaataatagtgaacaagcataatgttttcattattatagggtaaagttaatatgtattatatgaataaatggatgaacaaaatggaataatctgtgtgccatattttatttttatgatgtgatggcatttgatgtttaggatagtaagaaagaattatttctcttcagttaaaaaaaaaattacctgagctttatggtaaatcttataaatgctttatggattgggtgattatgtcattcaatttcagctagttactccttaaagcattaatgtctggtttccattatgacctgttgtgatttcagaacaaatgcattgcttctaatgcaatattattatggcttgaatttacaagacgctattcatcctaacatgatgtaaaattacattctaagatgttcagtaatttcaaatgatagataaattgaagaaatttacagggagattttagttttattttaatagatcagatatgattttagttgcaatacaggcttttcaaataaagctattactgaattgattgtagtggacttgcatttacaaggaataaagaatattcattcttttctctgttgtttttgtataaatccttgggaatggaagcacatgtttatgggtgagtaaatttggtatttgggaaatttattctagataaaaattaaagaaaattatgagtacaaaaataatgatacttacagtacttatttttacgtttgtttttattcctaattattagtattctgaaagtataattttcaaaagttgaacacccaattctcctataatgaatgaattagtccacatcaaagatttttttaacttcttaatgaaggaaccagcaagatgataaagctgcttccaaggaggatgccagaaacggatacatataaatgtggggaagggggtagtagggggaaaagaatgccagactagcatagctaatttggatacaaaactggttagtgacctacagggcaataaacctgaaacatttggacaaaataagttgcatattactgggtttctctaagttaacatctaacttcgcagagtctaagccctaaccactagtaaatagaaagtcagactctgttacatcccagtctggagagtcagatgaccctgacttaggctgacttcatggaatatgctctcgtgggactttggaagggctcacagtcttctctttctcttttttccatgttttggataattttgcttaacatgactttctgttctagagactgttggtctaggagcagtgtttgctaaacaaatatttctgggaggggatgtacatttttgcctgtggacagttactttaatttgttacagtgtcttgctagtttgttcattttggtagtgcggttggagtacccactgtgtgtgtgttgcactgtgttaggtgccaaaggaccctgcccacaggaagtttactatcttcactaagacagaagagcacttataacacaaaataaagtagaaagccataattaccatgaagaaggtgtggattatctacttcaaactttcagagaaacaagaaattatttctagctggggactggggaagcagcgcaagatctgagcctgccttcaagggtaggtaacatttgagtttatggaagcagcactgcttgccaggcaaataaaggcatggggatagaaagacgaggaatgtatgtacacaaagcaagtagttcattctggagaaatggaaagcatggaagaaggaaggatctgtaggaactagtttgggagagttgagagctggaaaggctttcgtgttgcatctgaatttgaactttggttttgaaggtttagtgagggttcaaggaacacatagacctgtgtgagtttcacagtgacaactggcatttccaactcttttcaggaaatgacatttttggttattgagaaaataatatggatattgtcatgcaaaacaatctcatgtccaagggaaaccttcacagcactaggaaactccaaaaaggccatggagtttgttaggcaccagcatgctattcttttaaatcagtgcagtggaaaagaatttcctggtccacatccttggttcctagatggtacttcttccttttcctcttcctgaaggtgtccttgtatttgggtatgagcattccccgggaaaataattcccatgccagctggagctaaaaaaaactcacagcacagaggcacctcctaattgttgtaaattaaatcaatgaattccttcccacgacccatgaggaaatgccacatccttataagtccacatctcttcccagggatttacctctgcttttcttcagaatggaaaacagtttgaaggttccccttcagccacccaactctccccacccctgccacattgttttcataacttgttttttaaatgagggtaagcaaatgaatggctttttgattgtaagtgccaaacatttttaaaacggtggataacagagaatggcatgctgtggctcatgcctgtaatcccagcatactttgggcggccaaggcaggaggattacttgagcccaaggattcaataacagcctgggcaatacagtgagacctcgtctctacaaaaaataaaaaaactagacaggcgtggtggtgtgcgcctgtaatcccagtaacaaaggaggccaagactggaggattgcttgagcctgggaggtcgaggctacagtgacccatggagtgcaactgctctccagcctgggtgacagagtgagaccctgtctcttaaaacacacgcgtgcgcgcgcgcacacacacacacacacacacacacacacacacacacacacacacacacaagagcagagtatgaaggccaagacagtttgggactcaggaggcagagacattgaaagagcaacttcaggccaggtgcggtggctcacgcctgtaatcccagcactttgggaggcccaggtgggtggatcacgaggtcaggagatcgagaccatcctggctaacacggtgaaaccctgtctctactaaaaatacaaaaaattagccgggcatggtggcgggcgcctgtagtcccagctactcgggaggctgaggcaggagaatggcgtgaacccgggaggcagagcttgcagtgagctgagatcacactgctgcactccagcctgggggacagagcgagactccgtctcaaaaaaaaaaaaaaaaaaaaaaaagagcaacttcaggtagactcctaagaaatgtttgtctaggattgtaaaaactaatgggttttcaaccactctattttgttttcttcaggagagaaataaggtagaatggatgagtttgtagttacactagacaagtttggagttaattatatatgtagtgaaagacaagcttatgagaaatgatcaaaatttgggtcacctgtagaacttaacttttctaggtcagataaggactgtatctcttcatcacatttctctttccattttctttgaaaaatcagaagacacagtttattagctaagcaaacacttggaatcactgatatgtaccaaattttctgcacattccaataatcaagttcttttacagcaaatacaacaccttgacacttaatagatgttcgttttggaaatgataggtgccagtgactctaaagatgatggccaagaacaactgggaaagggtggccaattgccataatggtttcaagaggataaaggctcagcagtccttaccattcttgctcaaggtcatcctagaagggcattttctaatccaacatcacttcaaagttccagcattggcccctttggtttatcttgccttgtttgtaatcacttcttaaaattctttttgccattatttttctcactaagtttttaatctatctttgttgttgttttattttaatggaaagtttgctctcatacggctttctctgagtttctccagtgctagttgtcatgtaaagtgacaaggttcttgtggaggaattaaggctgtttaattagatttctgctcagatgatgagttttgtaaattgaaaaggatgagagtgaggtgttacttgggtgatatgtaccttgtaagaaattgtagaaaatcacttggcaaaacagatgggagtctgtagaagacttttccagtaattcaccaagccctaaaagcattcatttgtaaactttgaaataatgaaaaatcactgggttaaaaagaaagatgaaccatttgtttaattttgttgtgcagttttgtaatgccaaagcattctctctccgtagaaaacttggcaatggcttcatccggagtcattggatgaagaccagcatgcaaacaccaaacgagctatttgtgtcttgtgaacgtgtgtctgatcttggatgaagtatatcctgctgggggccgacatgaatgtccaaagttataatccattttcacttgcagatgagggtcagattcccacccgatctgaccccctgtgagaatgctttcaaggtataattagagtcagattctgggcctcattaaaccacatcatacaacccacagtcagctctggctctccatgtaataggctctagaattatgataatgtgatagtgcaaatatggtggctttcagaaactggattatgacgagccactataataatggttgatttcccaagttcacgtcttaggattcccatgacaaaggagaaaagaactgttggtctgcacagaaatttatcatctctggagaagatttgtttttactattgcatttgaataatgtctattcatatgcaatagtaagacagttgaaacagtttactctaccaagtttactaaaattgacaactcatgaagcaaatgtagtttttcttggtagaggttaaatttaattattaaagtatctaacacatacttgaatgtctccctttggattcagtgcccttgacttagaaaaatttgattcataacaggcattggatcctgtttctttcttgggcatattcataaggagtaatgagaagatatcagcaaaaatctttgagtattttggaatgagattaatcttatgaataaatgaatataaggcttagtaagctggtattacttttagaatgacattcccaagtttcagttttgaaactttatataaaacattatccaaacctttcatcgtctgcaaatctttctagtttgggtggtatgacctattgcatcatatacagaatcctacctagtggctcagattggagtatgaacacttgtacgtgcctctgaagacaaaccctctaatgtttgaatttggtagtgcagatttccaaggttaatacttaaatgtgaagcaataggccttaattggaggcccaaaggctgagcattagaaagttagagagaaagtgtgcttttttctgatatatcttattgtgctccctccctccacacaatacaagaattccttatcctgtctccattacagtattccacacacaaccttctttacctggaaatatttacttgcgtgattgactagagcagcagagatgtttctggcatgatataaagaataataggaacaggtagtgatacattttttaaaatagccattgttggccaggcacagtggctcacgcctgtaatcccagcactttgggaggccaaagtgggtggatcacctgaggtcaggagttcgagaccagcccggccaacatggtaaaaccccatctctatttaaaatacaaaaattagctgggtatggtggcaggcgcctgtaatcccagctgctcgagaggctgaggcaggagaattgcttgaacctgggaggcagaggttgcagtgagctgagatcacgccattgcactccagactgggcaatagagccagactctgtctcaaataaagtaaaataaaataaaatggccattgttatttctaactcaacttttatatgagatggtcttagctggatggtttcaggtgaaagagtcagaggggaatggaatgattgcaggtgagaaggtaactctcaagtaaaagctttggttcacttattgctcccattcatgacattcagaaacaagaataatcctaacaatcaatccaccattttgttactgaaccaaccttttacttctgggtctaatatctagtttaaattatttttctcaataaatgaacataaaattgtcttccaatgacaatcaagttgaaattatctctgtgtataaaataattacagattatgaaagaagccagacatatcattttttacctgattcggttgacttctatttttaatttgctaaattaaatgttgtaggaaaaaatgaagagctttgttctaattttgaaattccacagcaaaataattgagtcatgcatataaaatgtccgttaacaagaagacaattgtagtactggttatttttgtttgaaatagaaatatgaaattttaaattcagctatttaaaatgcccgaggctaccatggaatgtacaaggctctcagtgaggagcaacacaaagatttttacaaccaagtgaggtaacttcttggcctaggaatttatgatagagcttttactatgcttttaaaagtattttccctagatataacatcaagttcatatatgtaaagtcgtgaaaactatatagtggtctaattctctgacaaggcaagcttggtattgagatgtcataagttcattcaaggaagccttctgtcaatttccataggattgggaaggtggtgccttgtccatctttgcaggtgttggaaggggagcattattgcatagatctgttccagtttcacagcaacacatagactgtagtgtaaagaaagaaaaagtgataggacttatgtagatatgcactacaagcagttatgaccatgaccagctcttactgtcacttcctgatttaattatcccaacagtcttttgacataaacatcattcaaataaccacagatacgtggcctgaagccagatataacaagaatcagccagtaaagaaataggttgaatttaaccaagtaataagtaactggagttgttactgaacccaaaccaggtgattagaaagttagattcccaggggaattctcattacaagaaccatcttatcagataggtaattggaaaccctgttaaacccaccataacaaaggctcagcaagtgtacatctgcagtgccagtacaatcagtgagtcttcagttcttatgaacgttctgaaatcttttattattaaccattgaccctctaacctcaacttctttgagatgataaatttgtttcctttagtaaataagtaaattcctttttttcctccttcccaggaagtttgagattcatgtataaagatgaagaactaaataatactggctgagccaccctaatttgaaaatccaaaatccgaaatgctctaaaatccaaaactttttcagcactgacatgacgcgagaagaggaaaattccacacacaagtacttaacacaaactttgtttcatgcacaaaattattgaaaatattgcataaaattaccttcaagcttatgtgtataaggtgtatgtggaatgtaagtgaatttagtggtcagacttgggtcctatccccaagatatctcattatgtatgtgcaaatattccaaaatccaaaacacttctggttctaagcatttaggataagggatactcaacctgtagcataaaatcaatattttgggttatgactgggtgcagtgactcacacctgtaatctcagcactttgggaggccaaggtgggaggattgtttgaggccaagagtttagaaccaacctgggcaacatagcaagaccctgtctctactaaataattaattaattaaccaactgtgagtggaggttcttgcctgtagtcctagctactcaggagtctgaagcaggaggatcactagaacccagaagaagttggagattacagtgatctatgattgtaccactggactccagcctgagtgacagagacagagaccctgaacttaaaaatatatatatattacaacttgggactgaaatatttgtttgtatgttaatagttcatagcatttaagataatatgacatattacagaaatttgacagatttgctttgaaatgctaatttgaaacacgtaatttttttttttttttttgagatggagtcttgctctgtcacccaggctggagtgcactggtgtcatctcggctcactgcaacctctacctcctggggttcaagtgattctcctgtctcagcctcctgagtggctgggatcacaggcacccaccaccatgcccagctaatttttgtatctttagtagagatggggtttcaccatgttggccagcctggtcacgaactcctgacctcaagtgatctgcccgccttggcctcccaaagtgctgggattacaggcatgagcgaccacgcccagcctaacatgtaatttcttttagaactgttattttaagttggatctgtaagatagtttaggtttcaaagcaatattgcaatgttcaaaaaaccttaggtttcagcattttcttttttttttttttttttttttttgagacagagtcttgctctgttgccaggctggagtgcggtggcgtgatctcggctcactgcaacctctgcctcctgggttcaagcaattctcctgtctcagcctcccaagtagctgggattacaagtgtgcaccaccatgcccagctagtttttgtatttttagtagagaccgggatttcgccaagttggccaggatggtctcgatctcctgacctcgtgatctgcccaccttggcctcccaaagtgctgggattacaggcgtgagccaccacgcccggcctgggtttcagcatattttttaagtttagtttattagatttataagagctacttaaggacttgggaaggtataacgtgttaggattttaattttatcctgttagcatttgaagtgcttataaagtaaatcaaatgtgttaaattgataaatgcagtttaaagtgttacaggagtaatctgaacagtgattcctcataggggtgaggattgacctgaagagcggctcgagggtactttctagggtgatagaaatgttttatgtcttgattgagctgtcggttatcaaaatccattaaactgtcccttaagatctatgcatttccttgcatgtaaattttaccgcaatttaaaaatatgtgtgtaggaacttaatcagctaatgtatagacagaattgattgtttaatggagttgagtctattcaacttgagttaatcaaacattgattcaaggactcccgagagtgattattcttggtttcataaaatttattagatgtatgaatagaataatgagatcataatttgaacttaaaagcttaagggaaactacatagtgaattgttgacatagatgcagttcttgaacaaaaatcttgatggtctgtaagtctgtgtctattccttctcctagttggttggactcctgggtaaataggacagtcttcctagtatgctgcgtttagcatgcagcacttgactattgatgagtgaatggaacacctctagaggccaactacatcatccttctgtcctccttgtagcactagctcatttgcatagatcagcatgtccgataagctcacaccttgaagggcagaaaggacccttcttgagaagactgtacacagcactgtgtttttatgacagcaaacctcagtagccacaaatccctggaggatcagtaatgctagtgcacacaaggagctccctcccagcctgagggctctgccacccaggtagggctaagaggatggagttgacaaagggaagtcaaaaatgagagagctgtccatcaggagtgttgctgagccctgaatagagatcgatcgaggtgggtctttccttcccccttattataaacctgtacctttccttttattctctaggataccttctctatcttttctggtttgcaaaagaaaaaaatagttagatagtcactttgaatcaggcttgggaaaacacttataaataataattccacacatgtaagatggctaatcaacctaggtctgaaaatgacttaacaggaaaacattttcaatatcagtctctcatgattcccaaacacacacacacactcacaaactcaccacaacttcaaaattagcaaccaaaagacatctaaatgctgtgatctttccttttctcttccagatcagattagctttgctcttcactgtccttttgtcaaagcccctattgtacagctctccagtgtccttcctgcctgcccttctactgccattgtaacttttaccagccccactaccatttcagaagaaaactccaggaaagcaagtaagcatggatagctttaaagatcaatgctgaaggcccactaagaccaggatacaaagggagtcaattagaaaaaggtgggggtcaaggaagaactccccactcccaagttaaactcctcaatttgctgttttgttttagccagactctatggagctcagtcatggctagctctctgcaaatggcccccaaaaggcttttcacaaggggcagtaagatataactggcttcggtatttctgtctccccattcccagataaccaattcaagatgcatgcccactgtaccctgcatgttgttgaaacagaattttaatttcctctgtcttgcaaaaatgttcttttgcctctcttccctggtgccttttctcatcttcctcacccctgggtttcctaactctgtcttgcctactctgatctccaaagaccagtctctccttcatatttggcatgaaaccttcctcagctactcacacagtaattgcctcatttctcaaactctccagagtcacatcatccaatcaaagtactgtgtaatgtgagccacatatgtaattgaaaaattttcaagtaatcacattttttaagtaaaaataatcaggtaaaattaattgtactaatacattttatttgaccccgatatatttaaaatgttatcatgtcaacatgtaatcaatgtaaaaatgattaatgtatgcatttcatattcacagcacatctcaattcagactaaccatatttcaagtgctcaaaaccacaagtggctagtggtggccatattggaccacacagctctagaacttctgtagcccatggtttagcagttaattatgtgtgcacttggcatgttcgctgcttgttctctagtgaagtcattctttctagcaggccaagttctgtttctaccacaggtcctagcatggtgctttgcacattgtgggcactcaacaaatccctaagatttgcttcatagatgatccctgtacattgatagcatcttcctcattcatggaataacaagaatgacctcatctcctctcactttcattccttagctactaacactgttgcaaagatctctggaaaccggaaactttggtcacctatactttaaatggagagagaagtaaaacttgctgctgagaagcaaggactgcatagaaggtttagtttgctggtagaatcaaaataagcactgaatgaagatgtgtgtggttcccagttttataaataggttttgcaagaggagagtgtttgcttctttgtttttggtgcgaaacatttcttcttttagcatgttatctgaaagtattgctgccaaagggatgatttgccagagaaagatggtttctgtccagttccttcatatgtcaggcataacctccaattaatctgaatgaaagagtgggtgcccatgcagacaatgccaacaaatgcccctgtagagaggacacatacagatgccaacctgaaatcagacactggctactgaaacaaaggattgctttaatttttgcagaataaactatttttttcttctgcttttcacgaagtggccctaaagaattcctcttgtttgtggtctcgaaaaaattagaactatgccaatgaggcctgcctttaagggttctattaaacaataagaaggctttgttcttggcaataaaattaaagcaagcagtgtttccattacctggcaggctgccctctcccttcccacaaccctgaccccgatcctgacaaacctcaacagaccattctgtttcccaggtaggaaggttagatggtaacatctgtcaggtttgtttatagaaatatagttgaccttaatgataatgtataaagagggagagatgggggcggaggggggaggaaaaaaagggggtagggagagagagggacacttctccaaataatccttaactcaagctttaaaaaagtcaagtttactgcagaggcttcaagttctcaaaccattgttccagaaagacaataataatttcacaatgagttgaaatgatggaagttaggagtcactagatgaggaaatatacattttggtctgacacgctagatgtcacgtgttttctttttcagggaactttgcctaccattgctcaaacttagacccacttacagtcagttgcaaatgagtgcttgtaggtagattgtgaccctgaagtcaggaatgaccaaggccagtacagaaagcactgtccgatgcaaattctgtttagccccacagttagtcacaagtcattggaactgaaaaattggatgactgtgatgccagctctctctgtcctccatgagagctcaaaatggttatattgtagtctcctctagtgtaagagctcctgcctacagctgtcaaggccatacccatattgcactcacaggtcctatctccctggcctgggaactttttctgcccctcccaggaccaactaattccaaagggaagttaatgcctaccttcccccaacagctttcaaccagctcctgatgggagatgttacataaatactctgcttcttccctattagctggaatgttctgtactgtttcccagagttgcccaatggggttaatctccagttgcccaaggtggtcttggtaagtcacactttactggcttcgtagttgtccctgtttcacttcctacccagtactggtgttttctggcaacaatttgaccatccattcttgtctcatatccttcttggggaggatacaactgccaaccatgtctaaaatgaaatgatagcacaagtctctttttctagtcatggctatagctcacatgttcaatttctctaaactcaagtctctttcattgtgtttgaataaacgtacatgtgaatcactggacatcaaagatatttaaaaatcaatctactcacttctcctgatattctagaatgacaacaacagggcaagatatttcatagatatcacttgtgggtgcgtcatgaaggcagaacaaagcttaacattttccagttgtacctcccagttaagttctatcagtgacgtaatcacgtgtatttcactcactgtacggaataccaaagagcagaaacccaatgttcattttccagaactttgcagaagcagatggcttctatacctgagtaactgaaacccaaaaaggggtccaactcagtatttttccagtacatcacttttcaggaatcatggcacaacaactaaaaggaatgtcacttaatgagaaataacatgtaagattgaaagtgattaaggtaaagtcatagagtagaggtttcctctttccattagaaataacttcccttcccttaaacacgtcacctccatctttcctggcactccattaatggtcatctgctaaaagttattgtttaccctctgaccacaacatcaaatgccaaacacatttgttgaaaattatttaatagaaatcgctacttttcagaaactttatgaaaaagacgtgatagagacaaacacccatggcaggttaagtagatttcttttcattcagtgtgcccagcccaaacggaagggtgtgaagcatttgttttataaagtgtgtaattaataagagaaaggaagggaggagtttattgtttttcaatgaattatgagcaaccccttccattctgcttcttcattttggaactgcttctaacaaagttaccattaaacacaaaaagaaaaggctgtgatattgatgccaagaatataagattgaagtcagttgagtgtagcctaggaaaaacattacagaaggagtaacatttattataattgtgacagaagtcagcaggacatcatggggaaagtgaaaaccataccgcaagtatgttgtcattttcaaattgaaattccattaattcagtacttgtagctattcatgccttaaaagaagaaaactaatatttattgagcatctactatgtaccagattgtttacagatattttcatcaaaagtatgcaaatgaggaaacattctcacagaaattcaaatatttttcatacctgcagtcctctgaatataaagtccatgatttttcctttatgccagaggtcagcaaactgtgacgctcatgctaaatctgactgtttttgtaagtaaagttttatttgaacacagccacgtccatttgcatccgtattgtctatggctgctttcacactacaatagcagagttgagaagctgcagcagagaccgtctggcccacaatgctaaaataattactatctaggcctttacaaaaaaaaaaagtcccccaactcctgctctgtaccacggaagaatgttctctacccttcttcttcccccatccaaaattgcatcaggaggcagccttcaaggaacccagttaggatttaaaagtagcttcaaaaattctggagttaagcctcatgttatagcttccaaagctattattttgatgatgtagatgcatcaaagttttgattcatgctagaaagtcctcaggtaaccagcacaggctgactggtcctagaacctctagttttaattatctatggacattccagataaaaagagtttgttagcaatagtgatcgttcacatttatgtagtaattattacatgccaagcatttgtcaagggcttttcatgttttcactcatttagttctcaccacagtctaacccaggggttctcaatcttgacactagtgggatttggggatggacctttcactgttgtgggggctgtctaatgtgttgtaggatgtttagcagcatcgcacctggtctgccaggtaacaaatgttattttcctcattatgcaggtagggaacttgagatgtagatagttgaagtaaatgcccaataacatacaactagtaagcaataaaaacctggtgtttcaatcccgggaagacttcctcaagtccctgaaccccaaaccactgcctccattagcccttgctccctctaaattattttacctgtttgaagattttgctttactgaaaaactaacagcgacatcaacaacatcgtgaatggccatgttctgtatgctactattggaagtaaaactcctttatgtgaagtttcaaagttttaggcattagcaatggcattttttgctaggcagttttattgccttattacagttgtatttcattcataagaaagaatttaattgctctactcaccacagtgtgttgccatttttgatagtgtcttgcttccttgtccagcactcaagcttcataatcttagaaacctcaagaaaagaggatttatcatgaggttcctcggagctatttttttagtcccatagcaaattcccatctggataatcaatatgtagaattgatctcctctggtccaaataattttccactacgtcactatgctaaagcaggattacatgtagcttctagttgtatcactatatcactgctattacttcccaccaaaagcactttatgaaaggattccatttttaatttttctgaaaagcctttcttggagtttaaaaagatttgatcaaaaatgttaaatattaaattaacacattaaacattaaaaatattgtcccgtactctggtttgtcctccaaagacagagacctcaggagccaggccattctctctctctctcattcacttgagccaggtccacaagtatttgactttggtgtgaaagagtttcagagtgaagattacatataaacatatcagatgaattacggtaatattgtctgctgttcctcaattctccttggctcagttttatatacagactgaagtattagaatccctttcattgttcctctggcagctctgtctaacttttgccccagagtctggaatgttcatcacagctgtctttggcaataaaacccaaagcaccctcatatcatcatatttctttttgcacctggtcagtggtacacagcggggtgtagagcccacttgcatacagttttctccctgtaccctcatccacaggccaaatatcagcttatataaagctctgttttgtttcagttacttcagccttgggcaaattggaattaactcctccaatgtttttcctttggagtgagatgggatggttatgccacattatgtagtaccactaaccccttcgaatttggatgcagactcaaaattacatattcttagttatagagaaaagtccttttgagtctaaacaataacaagaacatcaacctagcatcatgtataaaaatgtttcagcctttctcaagatcaccttaatttgtgaccttggaatggaaggtcacatttattcaccgtggcatgaaacagcttttgtttttgccatgaggccgaatctaggcaaacttgtaaagtagacatttgtcttttaaactcccaactccttggtaatggtttcaaagatggcaaggttcagaatcttaaactaaagggttcacagtttgatggtgcaatttcaagagtgcagtaatggtgggccggggtgagagaggcacaactcaaggggtctaccattcttgcggaattcaaagtgaatagtagcctccggatttgtgcagtgcagcaaccctcttctcaacacccagaaatagaatatcctgtctccaacacgttggggttatcctgtcccaagcttacttcagtgtttccgtctgtgtacgaataagaagtgatatatcaagtcagtgtgtcattttcacaagaggaattataaggctgtattctgaaagtctatggatggctaacttatttcaataaagcactgcaaagtgagaaaatgagagtttctaaaatgcatgctagatcaatttcacctgtgaaaactggccagatattttttttccttcactcatgctccatcctaagagttccaaatatttctaaagattttaagcccacacatgtctgaaatctaatgatgtttatactctgcactgaacatctcattttgcagttgaatacaagtcaaattaaaagagccaggttttagaaataatacttaaaaaccacttacagactgctaaagaacatttcacagacacctagtccaatttctagtatatgtatgtaactaaatccctttaatgtttatacatatatgacaaggaaaaaatatttgtcctctttaccccacccattcctcaaaacactgtaacactattacaccataaaacttagcagggagactttgggcgttgctaaccaagtgccctcgagaaaatagctaatccatttatgtcatcattaactaatctggggaatgattacgcgtaactgcatttctagaaagggaaggtaaaccgtgcacccagtagcaacttacatgggactgcaactgattattggtggcagatatgagcattaatgaagccgagtgaccctcaatgctgaattccatctcaggactaggcaggccagatatgattgttgtgcttctacattcacatcattattcaattttgtaatatctctttcatcagactgtaaaggatcagaaagtcattggcagagagaagcagcagtattaccctaggaataggagaaagtgggtcagcaactccctacaggcaagactgatggggagaagatgcatttcaagacgcgaaagaaaactgactctagatgtagagaaggtatgtgctgagcagatgggtgaggtcaaaaatgagatgaggtgaaagtgactgagtttctcatactggtgggctaatgtgatatttgctcatgagtgtacttgaggtgagaaaaaaccatagtattgaggagcctagcctgagatctcggctcactgtaacctccgactcctgggttcaagcgattctcctgcctctgcctcccgattagctgggattataggcatgcgccaccacacccagctaatttctgtatttttagtagagacagggtttcatcatgttggccaggatggtttcaatctcctgacctcgtgacccgcctgcctcggcctcccaaagtgctgggattacaggcgtgagccaccgcgcccggccaggaaggcctaattttaagctgtatttcatcctgagaagtcaagtgccccatttccagtgtggtccaaaggcaggagacagtaattacccaccactggacatcattcctaattatcttcatctcactcttgccgttagtttaggggccaaggaggagactgatggcacaaaagtggaaagaagagtttgaacttgttttctgcatccttagattggccctcctcagagcacttccatcagccacaatgatttctgaatcaaaagatgtgaatcagaaatgaaagcaaaaatcataaccaggagctgctagcttccaaaccaaacctgggaactagaaacaccagaacataactgcaagtaaccaataaaccctgccatatttgaactaatagaaattaatgagaaagtccaatcaaatcgttaattctttgtttaagtgacacatgaaacagcaaaactgtggaaaacttctttgtagtagaaaaaattctgaaatatagaatagtatttaacttgttttattgtatcttttggaatataagaatactagagttacaagaatttggaaattcatcaaagtagaaaacaagattcaacttccctggtttcaaaaggaaagctaaatctgtattctctgaaagatctaggaaaaatacttggcctaaaatgaatagatcctgttcccaaatttctaggaatttacatattggggtgatggtgattgtgataccagttttctcaaaacacatttgcctcaacaaggaagatttcagcccacttttttggtaaagcaaacatatccattctgtaaatcaaatagtcaaaatttggattaaattgagccccatattacaatggcaactgggatactttttctaccatgcagtaactcaactcccaatgattgtgagagtgaatggaccctaaactaaatcataatctgtttacaaaatcccttctcaatgcagacaacagtacctcagatttgtcaatggcttcataagtttaggtgtttcttcatatattatttcatgtattcaccacaataattccacacggctaagagagcagatattattcagctcattttacaaaataggaaaactcataaatggagatagcctaagattttcctaatgtcaccatgtgggtatattacacaccacatttcatttcacagcccgtactctagaattagcagtgggttctcactggacttagtcaaagccagaagagcttgaagtgtggaatatgttagtgacaacattaaaacttgaggacctcacaatgtggtcaattgatttttgacaaaggttctcagacacttcagtgaaagaaagaatagtctttcaaaaaattgtgctgagacaactggctatccatataaagttagaagcctaccctcacaccatacacaaaactgacctcaaaatggctcatagacctaaatataaaatataaaacttatagaggaaaacagaacagtaagtctccatgaccttgggataggcaatggtttcttaggtacgacaacaaaagcacaagtaacaatagaaaagtagataaattaacttcattaaaatttaaaaatgttttgtgctttaaagggtatcataaagaaaatgcaaagataacccacaaaacaggaggcaatatttgcaaatcacatatttgataagggacttgtattctgaatatgtaaagaaataatacattctattaattaaaagacaatgacccaattacaaaaggagcaaaagatccgaatagtcatatctccaacatagatacacagatgtccagtaagttcacgaaaaagatggtcaacatcattagccatcaggaaaatgtaagtcaaaaccacaatgaaataccacttcacacccactaaaaataaaataaaattaaaaagacatacgataacaagcattaacaaggatgtggagaaattggaaccctcatgtatttctgatgggaatataaaataatgcagccactttgaacaatagcttggcagttccttaaaacattaaacacagttatgtgacccagcaattccacccctatatcaaagaaaaatgaatatatatgggcacacaaaaacttgtacatgaatgttcatatcaatattatttatagtgaacaaaaactagaaacatcagtgtgcatctattaaagaagagataaaaagtggcctgttcatacaatgaaatattatttggcatagaaaggaatgaagtactgataaatgctaccacacagatgaaccttgaaaacattatgctaagtgaaagaagccaaacaaaagattatgtattatttgattccatttatatgaaacgtccagaacaggcaaatccataaagagacagaaagtagactagtggttgcctcgggctggagctagggcaggtagggaaaatgtggagtgactgcacacattatgggtttcttttctgggcactgaaaatgttctaggcttagattgtgatgacgattgcacatgaaatcatctgtgaatacacgaaaacccacaaaactgcacattttaaatggacaaattttatgatatgtgaaatatattccaataaggcagttttaaaaaatcaattcctggccaggtgcagtggcacactcttgtaatcccagcagttttaagaggccaaggtaggaggaccacttgagcccgggagtttgagactagcctgggcaacatagcaagacctcgtctctacaaaaaaatacattttaaaaaaatttagccgggagtcatggcatatgcctgtagtcccagctactcaggagactgaagggggaggattgcttgagcctgagaggtcgaggatgcagtgagccgttatggcaccagtgcactccagcctgagtgatagagcaagagcaagaccctgtctcaaaaaaaatcaactcccttcctccctccccctcaaataaaacaatccttaggtcataattttgtgtctacacagtccttggaaaccaatccattacctgcatgttgagtgattactagtgataactacttgctccattacatttttgccctgtctcttcttggaaggtcattttccctatttatttattcaacaaatattttttgaatgcctattttgtgccagacatggcaccaggtgcttggaatagataccttatttaatacaacagctgaagatccctgcccatatggagcttacattctatcagatttaactcgtattctcaagtacaacttagctcttcgggtttattctagtagatacttttcaagtgtggggtctgtcaaagaaaaactagagctggacagtagttaaagctgtaaaaacattttattcaggactattgtaataaggggaaagagacctcagtatagaatgggactcaactcccaatgtcacgtggaccagtggggatttacagccaaggagcagggtgatgataagtggatggaaaattactaagaggaaacatcaggggtaagggagattctggttaaactgacctaaaaggattcttgctgaaggtaggccaagttgatcagacatcctctggggcatggtgaaggatgaagaacccaatcagatactgagagtgatcagatatggagatggaggattctggctaaaccaactcagcagggttcttgctaaaactggtttacaagaaagtgcgcagaagggcccaggagaaagttcaacactaaagtttggtcgagcaaagaagcttcgtcagtgctactttctagaaattttacttcctccatcataatgtgctcatgttatcaatatggtcccatccttttcataactcagttgtagtcagttattaaattcagtttgaggtcaaaaggaaacagaagaaatttactgagtgtaagtttcaagtaaatatgtcaatagctaaatttatttgagaaacctcaaggggagctagaaatgatgacataaaaataacaataagagaaatgaagcctaatgattatcctccttgaaatattagcctgagttccacatttgtacttctcagtcaatgcatttttaatttttctctttgttcattaaacaaatacttagcaaataactctgtctgctaaactgatgtaggacataatctcatggtttactgcaaatggccaatgactatcatcttctcaataagatgtcttgagtagtctctatgttatgtctgaacaatgatcaggaataaaattcaaggaatcctgggcctctggaaacaggacatggtttctgtgaacagccatcagtggatttttatcttgaactcatgaccctacttccagtttatctcattcatagagaatgaaattactccaattaaagccttccaaatcaaaaaggctagggactgggccatgtctcctccctgagatatgctagaataatcaatgccattgtcattctttgtaacattgcaacttctcctgtggctgtgttaaaataataaacctcatgcctgctatctccatctctcacagctgtggtttctgggtttctgtttgtgaataagcatttcagaattgccatgagatggaggaaatagcatgtgcagagtatttcccaggcctagttgccaagaatgagctaattgtaagcctcccttgaatgcaagtcacaaaaacttcaaatacaagccactctaatgatccacctttccacatgaatgttatgctttcgttgtagaaccttgatctttcagaagtatactaggagtataattttaaattatgtcataagattaataaactattgaaccatctttttgtgctttttatgttttatagtgattagatacaaaattgatgtttgtatttaagagaaatgtcaaatgtgatacaggcttgctacattgcttacggaaaatttgtctaaaagagattgatagtaatctgtcctccataaaagaataatattgattttttttaacttactttttttatgtttaacagggcaaatttgatactttttaaaaatataaaagtaggaattgcaaatatatttcacatgacacatcattttccaactaattggtaatggctatgtacatgttatgttaaagattctgcagctgagtctggcttagtagaaaagactgctgtcattggataataatgttttccaaggatgcaaattaggaagtggccatgtaagtcctatatttgcaatccttgcgtaatcggacaaagagttaacatttaaaatatcttttcagagattactagaaacatcctagtatacattaaaaatagcacttaactgaaaaacaaaggccaaattaacacttaccattgtacttatcctgtaggtcaatgcatcacgtcaagaagccaaattgacagaggagtgtgatcttctcattgagatcattcagcaaagacgacagattattggaaccaagatcaaagaagggaaggtatgatttctagggcagaagatttcatattctctacctggagaaaataaatcctaatacactccagggactttggaaatgttgagaaccctctttttctatacattctataattccctcttaagtctttaagacttagttaaaaggcctttgcttggcagttttttctccatccttttctttgtactatggtctcctgtgaagacctgtgatacaagggctgctccattgcccagcgccaggaggtagcataaaggtcttgtctatcatggccattgttttctatctcacttgtctatgagaaggtgggttctgtggaggcagagtttattttgtattcattgtgatatcctagaaactagcatagcattacataaattaaaaatgaatctgactttatttatagaaattatgaagtactttcccatgtttttgaggaaatgtatacaggtataacttcatggtcccaaaacccctggggtttcactatatcatatactcctttgtggatatagtaataatacttcttttctaatgttctaatgtttctatgttttaatttcctattgttttacagcaaactatatttttaagataaattgacatacattctttatagctgctttcttatttattcaaaattcattcacaaactgttggtcactttataatccatcagtttattctattttaaaattagtcatgtttttattgaaatacttatgatccttttaattttacccaattctctgccacattcagggataatttttctttcttttttcttcttctttttttttttttttttttttgagacagtctttatctgtcacccaggctggagtgcagtggcacgatcatggctcactgcaactgccgcctcccgggctcagacaatcctcctgccttagcctcctgagtagctgggactacaggcatgggccaccacacctggctaatttttatattttttgtagagacagggtttcaccatgttgtctaggctggtctcgaagtcctgggctcaagcaagtcacctgcctctgcctctgcctcctaaaatgctgggatgacaggcacgagctactatgcctggccaaggataatttttctatggatttttaaaaatagaagcgtttatttatgatccaataaattcatccatttctattattattgttcatagttgtactttaaaacaaaatatatataattaaaacatactagcaagttttaagtgaaacacagagataaccgtggctaatgtatgtggttttctgtgttttccacaaaatttaacaggtaccttctaatattgtacaatgttttagattactctgtctatatagattacaaaatatttatacacataaattattaaaatgatctaaaaaatagtgaaatcaaatagttattgatgctggtatagtagattaacagattaacatgaaattattccctggccaaggactcacatgtgccgaaaagctacttttccccacatacgaattgtccaatttagaagagcactgagtgtccatctggaatccttacaggatatatttcatcttccatcatcatcgtgcatcataggtgcacatctcttaattctggaagtattccaggttctcagacacatggccacctgaagtacagtcacaattaattattcatatgcatacagaaggtaatttgctatctttacatggttgcatgcagagattagctctcagtacacatattagtttattttcatttttaattttaaattgacaaacatttatatttatggagtgcaaagtgatgttataatttatggatgaaatatggaataactaaatcaagctaattaacatatccatcatctcaaagccttttcttgtggtgagaacatttgaaatttacttgcttagtgattttgaactgtataatacgttattatttatttgctgttttcaccatgccatgcaatagatctcaaagtaaaaaataaataaataaataatttttttgaaaaagcacttcctcttcctctctaattgaggttttgcaccttactcttactagtttcttattgctgcaataacaaattaccttaaacttggtggcttgagacaacatagatttattatctcagtgtgctgaaattcggaaatccaaaaatcgatctcactgggttaaacaaaatcgacagtcaaggttttggcagtgctgtttctttctggaagctttaggggaaaatccattttttcttgccttttctagctcttacaggtagcctgcattctttggctcatggtctctttgcatcaatctgacctctcttcccatcctcacgtcttctctgacacaggccttcctgcctttctcttataacgacccttgtgactacattgggattacctggataattcagggtaacatccccatctcgtgatccttaatcatgtctgtaaagtcccttttgccatgtgagtaacatattcaaagattcctgagattaggatgtgggcagcattgagagcccttattcagcctgcaagggcactccaccacaacttcctggctagcttgccttcccttctcttacttagcttggacttcccaccaccagggtttctctcatgagctagatcagagtagtgcaggtgtccccaagttccagccatagtgatgcatggagtttatgcttcggtgcactcgttctaccccaaatacatgtcagtaataaagaacttaataaaatgcaaaagcaaagacatatagctgaaccaaaaacaagataaacatctccacaggccagaaatgagacaaaactgaaaagccatgactgtggctgaggatacaggctactgggatttggtctggaagaggccaaagtagctttggctttagctcctgtggataaatagttcttgaagctttggggaaaggacctagaagtgctccagatgggatggggaatggaaatcaggctcattatttaatgccatgggctatagaaggcttcatgcttcagtcaaaaattattgccaacctttccctcatatcatagcttttagcaaagtcacattgttagcttgaagcctgtgttcacactgtttctgatacccacacagaacaggagcacagagataaggatgggattcctgaataatgacctcaagggccaggtgaaggcaactggaaaactatcagagcagggtaggctgagcaaggagggtgagagaggaaagaattataaattacttccctttaaaactgaaactctaagtttaatttcaaagtatataaagaaatcttaaatttctaaacatacagccagcaaaatcagcagacaacattatcttaccccagataaaattaattttataggaaaataagaaaaagactttaaaagaagtagtcttaagatgttcaaagaaagaaatgaaggaataacttctctttcaaaagagcaaaaaaagtgaagccacaaaagaaggaaatgaaataaaaaaatagataggaaagcaacaaattagcagttttggagggaaaaatatagatattgaaattagaaagaaaactcagctgcagtggaaatttggaaactgagttttggtcaccaccttgggaatgccataaaacgcattcttttacgtctgagtgacattaaagtttgacaaatgccgactgagtttgaactcaaaagataggaaagtatataggaaaacctacacatggggcatttttaaaataataatcatgcacttggttgaaagcaagtatttcagcaaatttcaaaaactgaataccatagaaccctgcctctaagaccacacactgtatctcattagatattatcaacaataaaataatagtttctatagttttttgacactaaaatctattcatatataaatatatcttcacagtaatattttttaaatgtagaagtaaaccacagtaaaagaactataatatatcataagtagtaagcagcaaaaaagtatctgaaggcaaacttacaggctttaattcttttgaaaaagaggctgggcatggtagctcacacctgtagtcccaacgctttgggaggccgaggcaggaggattgcttgagtccaggagttcaagaccagcctgggcaacacggcaagaccctgtccccccacccccaaaaaaggtaatactaaaagtaaaaaattagctttcaaataaagctagaaaaagcacaacaggataaacccagtgaaagcagaggaaagaaataaaggaagaaaagtaaatgaaagaaaaacaggaaacaaacaagaacagctgtcagcaaagaacaactcgcagcctaattttgaaacatctgtgaataaaaaaagtgccttttcccccatttttaaaaggttgttaaaaaaaataaagaaaaacaatatatgtgtgacagagacagtatgtggtcttcaaagcctaaaatattgactatctggtcctctacaggaaaagtttgccagcccttaatcaggaggagttttacttgtaaaaaataatttaaaagaccaatctgtagttaaggttgatgaaggaaaaaagagtgtggggccccataaacaaatataccataaatacagtagagacttttttaaacataagaaaattgtgtaaatgtcttcatgccaataatttgaaaacttacataaagaagtagcggaaaacctgaataaaccaaaaatttaaaagcagaagacatttaataagtcattgaaaatgtccatcaacttgcatttctgccccaaaatggcaccagcctcccacagttctatagcttactttaacagaagttccaggaactaataatctcattctcatataaactacttcagaaaatagaaaaaagacattttatgtagagtgtatgatcttgataccaaatacatacaacattaaaaaatctagagtgagagaatatcacccatgaatatagacacaaaaattttttttaatatgagaaaatgtaatccatcagtgttttattaaacacatcaaaatagcctttattcttataatacaaggatggctcaactacagaatatctgttaacagaaccacattaacagaaaacatacatatgatcccagagtaggagggatttttctttttagaccaaacaattttaaaaaaacaaccataaagcaaagactgaaacatctgacatagaataagatcacaatacaaaagccaatttcatttcaatatattagtaacaattgaaaattgaaatttaaaaaaagaaattccatttaaaacagcctcacaaatatgaaatacttagtgataaatctaacaaaagatgggtgagacttgaaagaccttgaaaactacaaaatattgctgagagaaattaaagacgactaaaaaatgaagccatgtatcatgttatggggtaaagactcagaaaagttatgatttctgttctttccacatcaacctgtagattcaacataatctcaatgaaaattccagcaggttattttgcagaaattgacaagccgattctaaagttcatattagaatgcaaaggatatagcataatcatttaaaactttgaaaaatagaccgggtgcggtggctcacacctataatcccagcactttgggaagccgaggcgggcggatcacgaggtcaggagatcgagaccatcctggctaacacggtgaaaccccgtctctactaaaaatacaaaaaataagccagacatggtggcaggagcctgtagtcccagctactcaggaggctgaggcaggagaatggcgtgaatccgggaggcggagtttgcagtgagccgagattgcgccactgcactccggcccgggcgacagagagagactctgtctcaaaaaaaaaaaaaaaaactttgaaaataataacaaagttggagaactaacatcagctgatttcaagatttattataaggcttcagaaatcaatataaggtggtatttgtataaagatagacaaatagatcaaaggatcagcaaaaagacttgagaagtagattcatacatatatggacaagtgattttcaacaaagatgcaaaggcaatttcagtggagaaaggattgtctttttagtaactggtgctggagcaattggatatctgtatgtaagaatatgaagtttgatccatacttcacattatatacaagactttactcaaaattgattatatatctaaatgtaaaaggtaaaagctgtaaaactcctagaagaaaacgtggaggagatcttgaccttgggttaggcaaagattctttacatacagatgacaaaagcattatccataaaagaaaatatttatatgttgggtttcatcaaaattaaaaacctcttcagaatgcactgttaagagactgaaaagaccaaccacaaactaggcgaaaatatttacaaattatttattttaataaaggattgtatccagaatatataacaaattctcaaaactcattaataagaaaacaagcctttcaccaaaatgcataaaagatttgaaaactttaccaaagaagaggtgtggatgatgtattacttagggttctctagagcgacagaactaataggatatatatatatagagagagaggagtttattaagtattaacttacacaatcacaaagtcccacaataggccgtctgcaagctagcagggagagccagtccgactctcaaaactgaagaacttggagtccgatgttcgagggcaggaagcatccagcatgggagaaagatgtagacggggaggctaagccagtcttgccttttcatgtttttctgcctgcttatattcgctggcagctgattagatggtgcccacccaattaagggtgggtctgccttccccagcccactgactcaagtgttaatgtcctttggcaacaccctcacagacacacccaggatcaatacttgcatccttcaatccaatcaagttggcactcagtattaaccatcacagatggtaaataagcacgtgaaaagatggttcagtatcattagtcattaatgaaatgcaaaataaatttcaatgagatactgcttcctacctactagaataattaaaattcaaaagatggcgcataccaagtgttggcaaaaatgtgaaggaaccagagcctctcacaaactgctggaggtgggaattaaagtagtacatgctggaaagctggcagtttcttaagtaagcatacacttaccatatgatccagccatttaggtatttaccaagagaaaggaaagctatgtccatacaaaacttgtaggtgagactggtcacggtggctcacacctgtaatcccagcactttgggaggccgaggcaggtggattgctttgagctcaggagtttgagaccagcctaggcaacatggtgaaaccctgtctctacaaaaaacacaaaaattagccaggtgttggtggctcactcctgtaatcccagctacacaggaggctgaggctggagaatcgcttgagcccaagaagcagaggttgcagtgagctgaaatgatgccactacactccagcccgggtgatagagtgagaccctatccaaaaaaaaaaaaaaaaaagacttgtaggtgaaatttcatgttaattttacttgtaatagccccaaactagaaatggcccaaagtccatcaacagatgaatgggtaaacaatttgtgtcataatcacacaatgaaatactctttggcaataaaaaggaataaactagttacactagttataatgcaacaacatggatggatctcagtataattaaggtgcgtgaaaggagtcagacagaaagtagtatattctgtatgagtagattcatatgaaattcgagaaacggcactttctactaatctacagtgacaaaaagcaaatcaatgattgcttttagggatgggatgacaggaaaggatgggcacagttaattacaaaggggcaggagtaaattgtggggcatgatatatatgtttattatcttgactgtggtgactgtttcatgggtgcatacatatttgaaaaagtgtcaaatttgcactttaagtatgtactgtttatgatatgtaaattctatctcaattcagctgtttattagacatataaattgtgtattatataatgaaaaagtcttcagaaattaaaattaatgaactagggtgatatgtattagcacggacaaatcacaaaaacagaagaaagttatataattatttgtacaagcattatataaaatttaataaactaccaaaaaatcccatacattgtttaggtatgtgtacataaacatgtttgggagtgatcagctctaaatttgagagggtcttttcttctggagagagacatgagtgagattataaagtgccacacagaggctttaatgctatcaataatattttaccaccaggtgtggtggctcatgcctataatcccagcactttgggaggccaaggcgagaggatcacttgagcccaggagtttgagaccagcctgggcaacatagtggttccccatcactacaaaaaataaaaataaaaataaaaattagccgggtgtagtggcatgtgcctgtgatctcagctagtcaggtggctgaggcaggaggattgcttgagcctggaaggtcaaagctgcagtgatccgtaatcatgctactacactccagcctgggtgacagagcaagaccctgtctcaaaaaaaaatcttttttacttccttttgaaaactctgaagctcatatgatgaaaatactgagatttagtaaacctggtactatgtacaggacagttcattatattcttaaattttttgtatgtatggaatgcttcactttttaaaaagtatacatttgctcagcaacattatctcagaaggcaatcttagaaagcagatgttacttgggaaagatgagggccgcactccttttctcttgagctagtactttggcacatgaccaaggactagttcattccaaaccctgaaactcacagtgactcaagtccctagccagggcatattgtgtcagaggcctgtttttaagaggaagggtgtgaatgccaacccgtggaaatctgaggtgccagacagggagggcaagtgtggacttggggttcactgggggacttgggtccctgcaccccaggatggcagtggcaactgagggcattgagtctaaagaacggatggtggggccttctgacaagcaattggaagtgggcaggtggagcaagaaccaggcagaattgtggagatcacaaaagtgagtttcatcaactgccttattttgcccctgtctatctctgacactagtcactcagctgtcaaactcacctcaaattctgcaattgacgaggtcaccaagcaggtgatattattacacgttagtacctactgatgattcctgctcttggaccattgtacattctctgaaacaaattaactcgacagcctttataggtgggcggactggagagtcttaagccatgaggctccctggaaaagaattttcttctttttttcagtagtcggggataagtttcatgtcaacacacaaagagctaaattcagattgagttcattcatttaatgttcagacacagagatctatggtagacttctgaaggccaaagctcaacaaaataagggtcccttttcttcactgccttttatgtacactaaatcttaaaagtttaagaaaattaacttggactaaatgttgagctctccatggccttaaagagatggtgagaacaggcctcattttcagttcagatacttgtgtgaattgaggatgcattgtttggacctaattgttttgggttgtgtatcctacatacatataaaaagatttatataaaaataagtgtttaaaacgcatttcaagcaaaataaagcggcttttaaaagaatgtgtaaggtataataaacagcaaataaaatgatataaacagccctgtgtccctgctaaaaggagattccagcaggcaaactatttccatgactagtagagagtaaattccaaaagttgcaatgtggtaatctcacttcccaaaggaaaaatgaagagttgactggaaaatatttcccttgcagcattaaggcagacacatacagaatctttttatgtgtcagtatctaatttttttaaacatcaaattttattcaccttgtcaacttttaaaaataatacattaaaaagtgttgtctaatagaaaactaagtacttcgctccatgctgggtgtctgagtttgaagtgctgtgacaagtaggacagtgtttcagagtgtgctgcaaatcagggccatctgactgtaatcatttaagccaggggttagccgacttttctgtcaagggccagataacaaatattttaggctttgccatacggtctctgttgcagcaactcacttctgcacaacattgtagcaagaaagcagccatagattatgtgtaaccaatgagtgtggtagtatgccaataaagctttatttacacaaacaggctgtatgctgatttggcccacagatcacagcctaggaacacctaacttagagcagtgtttttcttttttctttttttttttactgtaacccgcagtaagaaatatatatgacatcacaatacagcgtgcacgcatgcacacacacaaaaggttttacaaaacccaacttgccttttctaccaggaatgcactctgctatttgcttttctcctcttctatttggttttttaaaggctagtcctgactgtcctaatgattcatcacctgcaggcttaaaaacatttgttgcttgttgaaatggaaattcctcctgctctgcgaattacaactccttaactcaaatattggagcgtagacccaaacatctactgtttttctttcaaaatgatgcccagctgattcttttacactaggtttgcaaagctcaaatcagatgtatcagatgaaattgtacactaacctataactaaaattatgcccaaaattgttctctgtagaacattccgatattttcacaggcgactctcattttgtcttgctttaatttttgcatgatttagggctcttttattctttttcctgttatgtcacttttaatgttcaatatcatgatagaaaaagaaaagaagaaactggagttcaagcatcatcgcatttgaaatgtgtgtggtctttaataggcatatctaaaggataagtagttgtcatgaagttattctaaaggaatattttgaccttattttcttttgctggaattgtattaaacatctgcaattcggccatgtaatttaaatgattctttatgctgtgtgattaaatattccattcacttggtttgtcctgtggactgtaaattagttttccttctggaattttccttcctctgacagtttcttatgaacatgttctaatatcctgcgcgtactggatgccttccttagctttgcctccagatagaatgatgccagaggctaaattctatttggtgtaaaataagtgttattttattccactaatgaatacaattaatccactggggacagtaactataattataatgcattaagtcttttaccaggctcacgatcctatattatttgccctaaagttttgacacttcattctctgactctttcaggaatttttttcacccttgcctgaaatcttgtgcctgctgcttctaattcagtatgaatttcctttgtttgcttatagtacatacttggaattggatgttccttagaggcctcaagttctgacatctctttccttccttttcttagattagagttatacagggatggtaatgacgacttggagaaagaaagaatttcttggaattagcaggaattctggagagagccttgggccagccttgtctgtaagacagattgactggtctcctccgtaccctttcacccagggctattttccattccagaattatcataaagccggttgaaacctgtccctgggtgtgtggttgggggcagtaggcacacagcaattccaattagctgtctaattttaacttggcttctggctagaggacttcatctcacagcacatttcaaacacaagagcgaacggtcaagtgggttaccttggacttatcttggcctgccccggaggttatggtcaattatgtttgagggacattttcaagcgagacagaatcaggaattggaatggaggttgtgaagcaatcatgcgtttttatcccaactgggaaatgcttatcaaaatagttcctagttatcaagtaagcacaaagtgcctggaaatgacgttcccagtgaggggaaatggcccagctgtgctttttttggctttctctcatctgctcaacaggaaaaatattaatcaatgggaaaaatgctccctttctgttaatttaacacatgagttttaggtagtgtgggaaatagtaacacttaatgctttccattctcgattttattacatgaattacaaaaaacactttttagaaaatggttttcatttaaaccatagattcaccacctataaagatgttttatcttcttgatgaaaagaagataaacctgagatagagaaagttccagggttccctacagtcttgcagtcattgtgtggaatagtccagggaagacgtctggtgaccctttgtaagttgccactgggcaacacctttttttcccatcaacagggaagcaattcacaattcagtgtttcctcgtaaaacgaattagcaatgcttctccaatgagataaggaatatctaaaccagagtcccataacggagctttccatattttgatatatctctatgcctactttttgaacttttatggaaggataacacaacaaaatgaaggatccagcctgatgccttttcattaagcaagaccacccatgtaaccatctctctccatgcctcttttgttcaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagaggtgagtgcaggggcccctgggaatttctcggctgctgggctcttgtatctgcgctgtgattggttggtcttgccctcgccttgcttttattttcattttcaaggctcagtaccagagagaatagaggctttgagctgttttgttccagctaaagatgcttccttttgacatgtgaaagccctttcagtaacagcctggagtctggagttcaaggcctttgaaacaagagtccaccagttagaaagaataaaatcaacctgcttttggacgaggggggagcttatgatggcacaaaaacagcatttattgtgactctcagatgtgatgttatcgtacacttgataacaaagagtcaaaatgaaggcaaaaacattaaagggaatattttcttccatcacagggctcatctatttttttttaaaatcacacaggtgttgttctctgttaggcccattttcatttggttgaggagcttggcctcacctgaaaaggtcaaggccaactcacgcaggagagaaaggaccaaactgtcaacctcatacgggcttcttttaaaatactctttattctcaggtagggagctttaatgtgatgttatctgaatggttggctcagcagtaaaactggcaaagataagtattttttcggcacacatacttggttggtataaaaattgctcatcttcactgacacaaacacctatagcaattctagtggatccaaagaaaagcactagccgggcacggtggctcacgcctgtaatcccagcactttgggaggccaaggcgggtggatcacctgaggtcaggagttcgagaccagcctgactaacatggtgaaacctggtccctgctaaaaaaaaaaatacaaaaattagctaggcgtggtggcaggcgcctgtaatcccagctacttgggaggctgaggcaggagaattgcttgaacctgggaggcggaggttgcagtgagccgagatcgtgccactgcacttcagcctgggcaacagagcgagactctttctccaaaaaaaataaataaatgaaaaaacaaagagaagcactaggctgggccaggtacagccaatgccacataaatgacatctctaactcaggctaatggccttgacttcattcattctaattttcagagtcaactgccctttatccaaagcaataatagaatcctatctctagaagaccccagagagctcatgcatgctgatcttcatcctagagcagagatcagcagactttttctataaaggatcatcaagtaaatatttttccgctttgcaggttgtaaggtcttggtcacagctactcaactctgccattgtagctagctctaaagcggccatagataatatagaaacaaatgggtgtggctgtgtgccaataaaaccattacaaaaacaggcagtagaccatactttgccaacccctggcctaggaaaaaaaatactcgccatcttatgactcaaatttattcaaagaaagagaaaggaaactaacatttattgagtgcttgcttgtttcggaaacttgtgctaattctcaaaatatcgcatagaggaggagtgattgacatctccattttcactcttcttaaagagtaatgtatcgtgtttttacaactctggtctactgtccaatcggcttgactgtattatttcttatatttgaggaaaattccttttgtagctgattagatacttatctcttctaaaaggcatggataacagctggctatcatccctgttatgtacttaagatgctctcctccttactctgagaggcccatttctttcctcctgattccttggttccaaatgtttattttccctgggccatatccagttgctcaatattcaccctaaagttaaaaactgcaaatagcactaatactccagtgtacctaggacactaatagatagcgtttacacttaggtcacggtttccaaccggaatccaggagtacttttctccatctatgaactttgagatgtccagatgaaatggctattatgaactgcattcctcatcaatccctgaagattcaaccaagtgtcacatgaataaattcttacctagtgaccagggatgatgtgaccccataacagttattgctgaaagaagatatgcatctgaagtatagcacaggtgtgggaatgcccacatacaatctccctcagttccagtgggacgtatctgctcccattcagctctctctataacaagcccaactcatcaagagcaggaacatgactttgatttctctttctacaaagaatgtgcttctgtcaagtttgaattcacagagcctgtaaaaatttgccaagagccttgtctctgtttctgcagtcccctctcctcccatcactatttgtcaatcctcttggctaattcctgagcctttctatccttccagcagctaggatatagaaaaaggacactgggcttagactagaagttggcagacctgggttccagtcctagcactgccactttttaactatgggtctttgagctattttctacttagaaaattgggttcaggaacagtttggaggttcctcaaaaatccaaaaattaagctatcatataatccagcaatcctactgctaggtacatacccaaaagaaacgaaatcagtatatagaagagatatcctcactcctgtgtttgctgcagcacttttacaatagctaagatttggaagcaacctaagtgtccatcaacagatgaatgaataaagaaaatgtggtacatatatacaatggagtactagtcaaccataaaaaaggatgagatctagttatttgcaacaacatggatggaactgcagatcattaagtgaactaagccaggcacagaaagacaaacattgcatgctgtcacttatttgtggaatctaaaaatcaaaacgattgaactcacggacatagagagtagaaggatggttaccagaggctgggaagtatagtagggagttgtgggagtgggggtgggtagggatggttaatgggaaaaaagaaagaatgaataagacctactatttggtagcacaatagggtgactatagtcaataataacttaatcgtatgtttaaaaaaaaacttaaaaatgtaactggattgtttgtaacccaaaggataaatgcttgaggggattgataacttattctctgtgatgtgcttatttcacattgcatgcctgtatcaaaatatctcatgtactccataaatataaacacctactatatacccacaaaagaattgtttttactaataaaaaaattatttaaaaaaattggtttcagaatagctgtcactgttgtgatgacattgctttaagttcctaagaacaggtcattagcattatagctactccatgagtgttagttggatctctgttttcacgtttcaacatgtcagtctagcccgccttgtgtgtcttttttccaatgctactctctgtctacctgcccctattcatcaacctgtcacttaacattcttctctaggacatgacttcttttttctgtctcctattgtgcctgccttgggctttggctcctgtatacttccaaacaatctttattcttcaattcaggtgtggagcccagaacaaacttttaatcccgcaggcattcttgaagtgagacttagatgagattttctgcatcgttaagcgacttaaagtggatatgtcctcctacaagctgaatcaaaactgtaaatttttctttcatttcagaaacatcaaacaactccaaaaggggagagagcctcaagctttacattgtaggagatgcttttgctttggaaccggttgtttggctctgtgctaattgcttagtaattatagatagcattgaggctgctcattaacattggctaattttgctcatatactccaagtaggcaggtaccctagccaccttgtttttaccattatagccccagcacattgcgagctgcctgacatgagtgaatgagtgaatgaatgaatggatccataaatctgtaagacgggactaattattcctacctaagatggttattgtggggataaaatgcaataatgtagtaaaaacattagcctagtttctgtcacaagatgaacatgcaacaaatactagttctcttccttcccactcactagatgaatgcaaatgtataatgtactatattctcaagctacactagtagataggtctttggtgtgattgtatatgcacctttatagcattattttaaataagcaaagctattcactaagtccaggcataagaaagttggtctgcttatgaagaatctagaattaaaatcccttatagcagtaacttatctgtatcaagaaggtgataaaaagaaacttccctctgaatagtacctattgttcaaagcacctaggaggttctcagactcctcaaggtgatccttctgttcctcactacaataggcagttcaaggatcttttccagaatacaaagccaagaactccagttgtcaattctgaaaagatgttgcttggttcaaagaattagagcatatctgatcagtggttttggaagtgtgtctgcagggtgttcataggcattaagataactgcacgttttcaaggccaaatgtgtttgggaattcctgggctgaccaaagtaaacctatcttgttactgtgaggcctcactgggttttactttggtgatgcacattgtttggcagaagccttgtgagcagcatagctccagacacgtccaccttctggaaaactggccccatgtgtcccagacatggctgtaaagcaagaagttgagaaagtggcatagcgctaacagccctagtggatttggcaacttatccaaaaggccagaagatgggcaataaggatttgggaaataaaaacatggcctaaaatgttgaatttggcagatttccccttgcctgtcactccaattaggaatttgaagttgtagccaaagataagtatctttccttccatcaaaaaacaaatgtgtaggtgttaaaagctgcagtaatctccactgattcttgctgtcagcctttacctcccaggctaggaactttgatccttttggttcccatgtaacaaagttcctaccatcaagatggtagacattattaacagtgtcactcaatttaaaatgttttatttaattgtttgtagaccatggaaccaggagaaacttgggaacaaaatctattttggatgagactgaataaagaggtttctgccagtgggcagggaaactgctaaagccagggaaatgcaattgcaagtttggtgcttgtttcccagtagctcagaacagttctccctgccagacattatgatggagaattaattggcgtttcactttgcgatatcttttaagggttcaaatggcaccttagcatttcttttaacttttctgcatcgaatgcatatattctgggctctttggtgtgtagcatagtttaagggcttcataaatatttgttgagaataatcctaggacctctatgaagtttaaggactttttgtgttcatgggtcataaggaaagcatttttaaagtataacttgaccatcaatcaaaaatgcctagcaaccatctccgtatccatcagtctaaattagcagctgttggtaacaataattagcccaattccccagggtgcaatatttagtcaacaaaagcactcaactctgctattcactacttcttggtgaaagggtcaggagatgcagttagattctctaccctcattcagacacttgaaactcgtttccagagcttagacctcttcacttgcatctctcaatcccagtatcattacatttatgacattgttgattaggctctctccttccctcctgtacaacactgaaaatctgccagaaatacaactatagaaactgtatttctatgaattttgagcattttacaggtatattcttttttagatgggtgaaatttacacaacataaaattaaccattttaaggctgggtgtggtggctcatacctgtaatcccagcactttgggaggccaaggcctcccaaagggtgatcgcttgggcccaggagttcaagaccaacctgggcaacatagtgagactctgcttctgaatgcacgattcagtggcatttaggacattcacattgttgtgtagccaccacctctatcaagttccaaaacacttccatcataccaaaagtaagccttatactcattaagcagttactccccatctcccctcccctcttagcccctagcaaccaccaatctactccctgtctttatgaatttttgccttttttggacatttcatacaaatggatcatacaatatgtggcctttttgatggcttctttcacagagcataatgtttttaggctttatccacatcgtagcgtgtgtcagtgtttcatccctttttatggctgaataatatcctgttgtatagatatatacccacagatgtaatttttagagccaagatatattacatttgtaaatccaaagctttaagagccattaagagactcaaaaggacatataacccttggagtaactggcctgaaatttttctagatgaaacagaagagtacagatctgaaattctcctccttgctgctgccagctagctttgtggccttgtataaatgagcatcaattttcttaattagaaaataagtaactagatttagtactaaattgtttcaaggttgtttctttgctcaaaaattcccagcatcctacgcaatactccgcatataatagctcttaagagtgttgtttatggaacttaacaaaataccaaactcaacaagattactagtccagcatcatttgatatgctcagaaatggtatgcttcatgccacaattctcttgtttttaagagaagcacttgcatttttgaatcaaagtgttcattattaataactgaaccttccaaatgaacctgagagtacatagaaggagattgagacacaccagtgccttgctttttagtttatacatgagaactctaaccagaaaacctaaatgaagaagagaaatagtgcatccactggggggatttgtgagaaagctcatgaatattttccacagcatctgctgggaatatggtgcaagaaaatgaatacaaagagaaagaaaatgagccagacaaaaaactccctttttaatgtttattttagagagaggctagtaattgattaaactaatccaatatctggaaacattcttttttaatattcactttgccttttatgcagtttgaaattttggagactctcctttgaagtggatcagggttgcgtctgaaaggaacaaacagtttcccagacagatgtgtgaagaaatgcctagagctacgcgcttcttgctggggttagacgtgaccgggccagactgttaaatacacagcaacatgaaatatgaatattcttttgctttcgcagggaattttttttcctgatagtaaaaaggaagagggcaagccattttgttgttttctccaattccttcacttttttttaaagcttgcattcatttgttttatgttactgtgttgtgacattttgagatgcctcttaaaactcatgtgtaaaaaagcactttttaagagatatttattttccttttctttttcatttctatgcagtgatgttgaaagtcatcttgacatttctgaaacattgttttgtttgcattacagagtctccatggcaactgcatcctcccaggttctaattcctgaaatcaacctcaatgacacatttgacacctttgccttagatttttcccgagagaagaaactgctagaatgtctggattaccttacaggtattgtcttttatgttctctttaatattgtgcacacttagtgatataaacactttgccaccagatcagttattccccaataaccagaggaatgggcttttgacctaggaatggcactgatatttccataaacaatttctgtgcattgccctttgttttttcatcaaaacaacacagcccattactaaactggggacaggagaaaaaggagaatctcaaccattaaaagcatacttaccactgtttccctcactctcaaggtgtgggtgctaaaaatagtatctctctgtggtatttttcatatcatagtagtaagcaactcacaatacattggcagagaaaaaattggcagctaactgattggttgtctgtactgcttcatctccttgtatttgtgatcttgttttaatttgcacaacatcgagttgaggtaaagcattataatccccattttgcaaatgacagagatcagccgtcttgctggaaatcaggtaactagggaatgacagaattagaatttggctgggacctgtacaaactccaaaaacttctgctctttctagtaaaagactgaattttatcttggcaaatgtcaccatggcaaaggtcacaaatttacattggaattcctagtgctgtgtttcagtgtgcttcctggttggtgttttgttttgttttgtttctcccttggttgagcttaaaaaacaaaaacaacaacaaaacaacaaaaacctcaggccactcctattcctaagcatgcttctaaacttttctttgctgtcaacttctaaagtaggaactgagaatattcactggtagaacctggactgtttagacaaccttattcgtgttagccaaagccaccagtgcctgcgacttcaggaaagcacaatgtacacagtgaagccagatgtgcgctgcacttaagacatacagccttcaagagaccacgtctctaacttagcgtgacatgagcttctcaattccaattctgtgtgtacatgtttgtgagaaagcgattgaacaaggtggagcaggagaaagggaacattgtgtgatgtttgtttttacagtctgtggatagaaggccaggggttctatattcagggagcattgtacccagaagatgagcattttttctttgcgaggacccaatgtgccgtttttagcctttctgcattgtcaagcaaggcaggcaggcattccacaaacttcttatcttatgtaactctctctttcaaacataccactcctattaaggaagaaagaaattgactaaaaaagcatttaccgtatggaactaaacttggtttcaaatatttgtgtacataatgccctcctatttaagcttttaactctgagatttatttaaactgacactatccaataaaactttctatgatgatagatatgttctatatctgtactatccagcgttagctgcctcccacatggggctattgaaaacttgaaatgtggctagtgaatttttacttttatttaacttcaactaaatttaattgaaatttaaaccaccacatgtagctcgtggctattgtattgaacagtgcaggtctagactttctccagctaagctgtttttcacagtggcatcctgttaaaaatctcctttttcttatatcatttgcgaatgagtttagttgcaagcaacaaaaaatccaactagcagtgaataaaaccatcaaggagtgtttgtattacagtcacagaagagaagcctgtgttccagggctgggcagtggttcagtgacgacctcagaccccaggctctttcttttttcctcctctgccgccttcattgtgttgcctttttgccacatgatcacaacatgactactccacctccaagtgttgtgctcaagctctaggcaaaaagaaaggggtggaggggaaacgatggacaaaatgctctgccagtgaagtttgtttatcagaaaaacaaaaagcttgatcagaagacccgcctagcaaacttccacttatgtctggtgggctgtatctgtgttacaaggtcatgtccagggacagaaaagactggaaaattaagtatttgcctaggcacatggccattctgcccagaatcagtcttattgacaagaatgtgcccttgccatttcccaataattatttcatagtatttcaacaacatatacccattttaatctctataggaatgcaaaagtattgattaaaggggaaattgtgaaagtagtttagactgaattgtaacatacaccatatttcatcccgatggctgtttatttcaaactaaaggccatatggggtacctgctattatgtcttctgagctgtcaaccccaaatacaaattcagtccatttctagacataacatcgatcctgaccataacatatgatgcttggctgatactgccaagtccaaatagtttatgacatttgtaagcaggaaatgaagtctttgtggagtattagcccaccattccttgggtggtgtttgtgacagagacaagaaaataacacttctggtactgattccatgagtattgaaattggcagcatgctgctgttctcatttacactaaattgagtattgacttctcaggacaaactcattgggtttacagtcaaaataaggttagcctgtctcattgtaaaaacaagattttttttttcctatgacatgcctctaagtggtatatcaagttaataacccatagaggtgacatttccttcctgattatggctactaccatgtgtctcacagctacttgcctattttgaacatacgttttctttctatttaattgtatattgcaatacagaacaaaatttttctacaatggttgatggagaaataattcaatgaactgtttaaattgtgagagagtaagtatttcttcactggtccatgcaggagtgatcccacaccaacagggaccacacagacaataataagcacattttacgatgcagctggacctcctccgtggaatgcatatcctgattggtgtcactgattcatgcacatccaagtcataccacatgacactaaatctcacatgtgaatacttcaggagacagatgtacaaatacatattccagaaagaatgctttaaaggttatgtagaacccttctgtcttaatgcacaatttaatgccatgcctgtcacgttggaggtgctcaacaatgtttctggaattcagaaccaatagataaagctaagctaattgacttaataccgtagacttgcttctgtgatacttgtcctagaggtatattcaaaaagcaaagtgaagactactaacgcagagtttaaatttacagtttttataaacttttcttcctctttgggtttgcttaggactcatcaattctaatcataatttagagcaggaaataactctgaaatagtacaagcaaaggttgctcctagtttgtagagtgcaggtatgtttctccttttgaagtgagattctagtgggtagaagagtggaagtaaaggccctggatcaattctctaaaccagaggtcagcaaactttgactgcaaaccaccagatagtagacactttaggctttgcagtccatatggccacaactactcaactttgctgttgctccaaagcagccatagacaatacataaatgaatgaatctggctgtgttccaataaaactttatttacaaaaacaggcagtgggccagacttggcccacagtcacagtttgccaacccctccctctaaaatattatttacaatgcaaagcactcattttctcatattttccttgctcacatactcttctcataaaaccagttactgaaatcaattcagtagaagtcattttaaactcattattttggtaggacttagacttctctgctccagaatgtgttaaagaaataaaacagcagccttctacaatgataaattaaccaaatgccaaaaaaaagttttttccttggggaaggaaaatgtaccttttagatatgattgactatgaatcatggtcttctgaatttgaaatatcgcatgagttgagaaatgagaagaaaatagggctggactagtaagttcttttttttatgtaagtcatcgaaacatctaatgaaagaaaaattcaaacaattatgtggctgattttttgtaggataacaaacataagtattttttcaattgggtgcctaaagatataagtatctggcaccacgtattaataggtcaggggttggtgaactttgggttacagcccaaatctgaccctctacctatatttgtaaataaagttttattggaacctggccatgcccacatgtataagttgtgactgttttcatgctacaatggcagagttgactagttgcaacagagactgtatggcccacaaagctggaaacatttaccatcaaggcctttactgaaaaagttagccaacctcccaaagtgaatgcagctatgaaactttatcttgtttactttttatttgacaagttttccttcatgcacaagaaagtattatttgtttaacctcccaaacatattctcatgatctcatgataaacacagaaagtccatactggctgactctagtcacactccttattaaaaacaaaagcaataaccagccaatcagatattctttagattggggtcaccatctctaggatagtagtcctgatggacctattgagaaggacctgcttaactgtcaaacatctcctctgaaatggtatcccagttgtgtgtgcttttccactgataagcattcttgacccccacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtgagtatctcatggcctatttatttctgtctttggtggctttcttcagattgattgcattcctgaatttaaacttcaaaggaagacaaggaaggaaagaacacacaatatttattgacttgtctttcttgaacaaaaaagtgatagcactcacttgtactacattagtaaaaacagctggctaaatattgatgaaaattaatgacctctagcaaaccacatggatgttaagggaaagaagccagaaacaaatatatagagagaaacaaatatatagagagatacatagagagagaaacaaatatatatatatagtattaatccacatataggttcataacttaaagatcaaaataaactattttgcttaaagaaacattcataggtgttaaaactataaaccctgggcaacctggtgaaaccccatctctacaaaaaatacaaaaaaaatacaaaaattagcggggtgtggtgacacacacctgtagtcccaactactcaggaggctgaggcaggaggatggcttgagcccaagaagcagaggttgcagtgggcagagatcacactacagtactccagccggggcaacagtgagaatgctgtctcaaaaaaataaaaataaaaagtcaggatgatggctacctccaggattaaagggcaagtggcaccactggaaagaaatatacaggggttcttggggttaatggcaatttctaggtgaaagttacatgctttagtcattttatcatacatttagttttatgtactttcctgagtgttacttcacatattttaaaagaaaggatttaataaaataaatagccaaagaaagttaaatacctggtcccattcagaggagagagctgggcccatcacttaaaatgttagtaactggccccacccgggaagaatttccaaccttacctgaaacattagaggtgccccctctcactgaggcctatttgatatctggcatcagagataacttggtgatttcaaatagcagtagtagcaggccacagagatgataacagaggaagcagtcctccaacccacagagttatttaaattgaactgggcaaatggcaatggaccagaagacatggcttttcacgggagcaagcttgaaacttctttaacaaagaaaaatacaatatgtcaaaatagaacagaatagaatagcagtcatgtttcaacaaagagatgttttgaataaattcatatcaatttaatgtgcttttattatataaaccttttctctcttaactacaaactgctctttcctagcacaagtaattctgagtcatacgatgcttaacatagaaatttgatttaggattaattaaaagagtgatgcagaaatacaccaagttctaagggactaaagtataaatgacccataccaacaaatggctccccctaccttccttatatccactctccccaacttctccaacttcctctcctcaactccctcaccttctaccctataattggcctgccgtggaagcttttattaaaatcttgccatttaccaagaatgtgtaatttttaaatgaaagtggagaaagtcatgcaatgtcaagaacagctctggcaagctgcctgagtcagtagggaatatagaaaggtcagaaatggtgagtgggacaaaaatgtcttgggggaagttgtggttaaactaagtcttgaaaaaaagcgggtgcattttagcaagttaaggctgtaccggacagctatgtcatcataagcaaatctatcaagatgtaacgtagcagggcatagtgggaggtcttgcctaattaagcctggctggtaagtgaggaaagggagacagtgagaaatgaagatagagaaatagaaccagggctcaaacctatattggcctagctccaaaaagcacatgttcttaatccttaatcctcagtcacctaatcctaattcacaggcaagagctagattgcagagggctacccaggccataccatgtttggattttaccctgtgggcttgagagtcatgcaggacagtaatgtaatcagaggtataactagaaggtgactcaggagcactgtggagagtggagaggaacagggcaggaccagaagcagagacatcagctgggaagtttcgtagtaattcactgaggcagaaatagccaggacctgcaaatggcaccagcatcagagatggaaaggaaaagataattccaggaagacttctctgcgtctggcccattttcctgggaaaaaatcatcagtgtcctcagatatttgaagtgctttttggggcaagtcgcagaaggcctgtatagcaatggtttagtaacattttgctcaccttctaggattttgaattcttctggtatcattcctcatttctgactctatatgccctactgcaaatcataaagaaatactaattctctaaaatatttttctacatgtgcatatcatacacaatgctttaccttgtttttttcaataaatattatgtctgagatatcattccatttcagcacaaataaagaactgcctcattcctttttgaggcagtatcatatcctattttaaagatatgctctaatttatttatcccatcttctatagatgtttatttagcttgtttccaatctttggcccttacaaacaatgccccagtatccccaaggatgttcaagatatccttgaatatctctccttccacacacggggaattatatctgtagtataatctcttgaggtgcaatttctaggaaaagattatttgcatttaattttacttgacattgccaaattgcccttcagagagatgacatgatttttaaatgcatttttccagctgtatgagcttattgtatttcactgatcttggctacatataccataaacttaacgtggaattaaagtctagtaaaattttaaaccttgattgtgcttcaccataaacctgaaacacaagttaatctatgatcactaatatcatactaaatagtcactccttcatataagcagtgattctcaacaagggcagttttgccccctaagggacatttgacaatgtctctagagacttttggttctcaaaacctaggaggagggtgctattggcatctagtgggtagaagtgaggaaagatgggaaatctcccacaatgcacaagaaatcccccaacaacagagaactatctggcccaaaatgtcagtaatgtcgaagttgagaaaccctaatttaaaacaaggtaaatgtataatatctacatgattacatgctaaatactgagaccataacacactgatccacacacactactatactatgtagcatggaaggaaaaacacaacaaaaaggggggaatataattaatgtattttgtcttcacttaaggaattgttttctcaatattttgtgattaatatcactagcatatttgggataaactgaaccagggattgtatcaaacttgaagaagatgaaattcaaaagatgatcagaaattccaaggtaagagaaaagaagcacgtgaaggtctgagaagagcaggtagaaaatggagagatgattcattgtaaaacaccaaggaaggttctctgaaaatacatagaggactgatagaaccaacgtctgttgatgagtgaatagtctaaccggaaaaagaaaacatttggagtcattttataccaaaagagtggttcttggcccatgtgagaaatgctatatttctctcaaatcattttcgtctgattcaggaaaagtgctaacagttttctattgctgtgaaacaaatttccaaaaacttagcagtttaaaacaatacccacttattatttcagtttccatgggttaggattctggcatagttgagctgggtcttcttcttagggtgtcacagtctgaaattaaggtgttggctgggctgcattcatctggagactcaactaaggaagaatctacttcttagctccctccatttgttgacaaatttgtttcattgtggttgtggaattcatggcagcttgcttcgtcaaggccagcaagggagagagtctgctacttcaaatctgtcacctccaaacctgtctttaaaggactcacttgactaggtcagactcacccagaataatctgccatttgattagctccaaatcaaataattagggaccttaattatatctgtaaactcccttcgccttcgcctttgtcatataatgtaatataaaaacaggagtaataaaagtgatagacctttgtcctttgccatattctgttggttagaagcagatgacaggtcctgtttacactaaggagataatattacacagttatgaataccagggagttggaatcctggggaccatcctagggcatgtcttcctcagatggttatgtctctcctgaaatttcttttggttttcttttattctttcatatatgtatgtgtgtgtgtgtgtgtgtgtgtgtgtgtgtgtgtgtgtgtgtgtgtatatatatatatatatatatatatataaaatttcagacagtcttgctctgctgcccaggctggagtgcagtgtcatgatctcggctcactacaacctccacccccagagttcaaatgattctcctgcctcagcctcctgagtagctgggattacaaacatgtgctaccacgcctggctaatttttgtatttttagtagagatgggatttcgccatgttggccaggctggtctcaactcctggcctcaagtgatccacccaccttggcctcccaaagtgttgggattacaggcatgagccactgcacccagccctctcctgaaatttcttaaatcaaatcgtcatggacactttgggagtacatgtagccttggccttgactgatgggctctgtatccgttggcttttgctgaatagccaacaaccacagggcctaagtagaattcatattgcttatgcatctggagtcaactgagtgtcaactaggaagccctgctgatcttggctccctcacatggcagactgataactgtggcaacccgactgctgcacatctgtctcatcctcctacaatccagctcaagtctgctctcaccctgattgcagagatgaaggagtaaaggcaggaccaattacacacattctttttaagcccctgtctgtgtcacattagctaacatgaggtttgtcaaagacgtcccctgggtgagcccagagtgagaatgcaaagacctgcaaaattacaaggaaggagcaaggaattggggccaaaaggccctaactcaataccagagcttcacctcatccccaaaatgaaaggaagatatttattgcttgaaacttagggtttctcacttggctaaactgtgaccaacttgatttctgtgctatttgcatcgaaaataataccaaacatgatgcattaatagaatagatgatgcaaaaaggtcatgcataaaaaaactcaacaagagcaaaaccactcagtataatgaactcagaactttatgttgggtgattccagagatgttttgttcccagaaaccagttgccataagaaaagaaatgcaaatggcttagtgaagattatcagcctttaacgcatagatgccagaaaggcccattctcccaggatggaagaaaaacagtgaaactgctggtgctgaccaaactgggatactctcaccgggttgtttgtatcaggatgtgttcctcccttgatgcccattaaaccagaatagtgaagtcctaatgcctacaggatccatttgcgacaaagaaagaattcattcagataaaaagctaaccgataggcaaagattttcaaattattttcttcttaaatatttttcacatttgtagtgaccaaaggagacctggatttcaatcttgactttggacctcactagctctgcagtcttgagcaaattatttaatgtcctccgaatccgtttcctcatctgtaagaagggatagtgttttaacttcacatggttgagataataatagtaaacaccttagtcttgtgtttgccacagtggtagcacatagatattcaaagttattattcctacaaaaatacggactgtactcaccccataattgcattttaaaagaaagaccagttttgcaattttccaggattatctacatgatagctttttacacaatcagtatgtgaaaggctttccttgaatgatgttaaataatctgtcctattatttggagaagtatcctttgcagatgttgtattgcgtgacaaggtctaatggtaaaactctactgaaaatgagaagatataatgctcaaaacctggctgtagctccttatatcactagaaaatcttttactgtctctaggtcatggttccttcactcatcctaataaattgtagttaattgccttcaactggcgttagtgaaggagacttagataatatctatggagctttttcaatcttacgaaaaggccctcactaatgaaatacatacattcaaatgcaaaagtaatgacattaatttttattttttatttttgttaatagagttatgactatagatgttaatgaattgcttatcaataactagatatttatttaattttacaacgtttgccacgttttctctaaaactacttttgatgcttcattttaagtcttaaattgggtcctttccccagcagcctattcttattcttagcagaaatcaaaagctgcatttttttcaagccttaatggctaagtagttatctgtttttaatttattgtagtcacttagaaaacattcatgaaaattattaaacatatactatttttacagaggagaaggaaaggaatgttcacttctgtccagtctgttggaagagacaaaggatgttagaaaccagtgtgcagcctctcctaagactgtccacatcatgtgacatttttacacataattttttgtggcaagatgacagttgccatacaaggctctgaaatcccagatgtaattaagatcttataatgagccacattatgtagggaaatgcttctaacccattgtgaatgaaaaaaaaaatgtataaaatcaaaaaactcaattaattaggtttcattgtggacaaattattttccaagctccgttgttattttaaactgagtcggaggaggtgaatgttggaacaccctcaaagatgactgaaaatgagtttggagaaaagtgaagtttcaatcaggatggttgtgtgggtgtttcataaagagatgaataaagcctggtcaagagtcctaacacagtggggtgtcaaggcagagaagtcttgcttaagcaaactcagtgccatatgcaagaagttaggtggtgctggcgtaagaccaacaccggtaatggtgcactccaagtcaccccacttactccagcccccagaagaaaattgtcaatgttgctttcctggcatttttaatcaacttctcaattattatcttggcaataataataacataaaggtaaacctaaacagtaatagtgtttgttagtattcatgaaagtagattgtcccagtataaagctaaccaatgaaattttactacttcataaacattttgttcttttaattttcaaggaaaaaatagggacctcttcaaaataatcaggatagtcagagtccctttttgtttggaaaaggtttctgaaacataaaatctttgttgggttaagactttggattttaggccaagttacagttttcagcaatttcagacatctgctttatgatgttactgaaagcgttcccccaccacattaaacccagcttttgggttgtacagtgatgtaaagtttattgaaacatttttacacttgctttctttgaccacaatagtcatttttttgtaacatattcaattaaacaggaacagtataaaggcagtgaaattgatacgattctcatttgaatctactgaatgccttaattgttctcattcgtggctgactgccattgacaaagatctaggaatatgagtacactatcctacataatagaaaagctaattttttgttttattactactgtaataatattaagtacctaaagagagttataggcctcttggggcccagaactcagagttcaaaatgacccttctttgattggatcaaaatctaatatttggctgtggcattatccagaagtatggagtttattatagctatgttcaaggaaaaggtaaggtgaaggaagatcagaagggatatatagtaaggagattcccatgttactaaactatttgtggatgttttcctgcatcatatgcaaatgagaattggtaggaaaacagagggctaagaattagagaaaataaatttggggaggagggatggattgtgcctcttattgctctgctgaatctccaaatataaacacacacacactcaaacccttctatgagtcctaaattacattcttgcttcaagctggctttttcaaatctggcagtccactggcgaaaatgtttgcaggttagagaaaaaaaaaaaaaaaggcaacagaaaattcacaagaccaaatatgtgtgtgtgtgtgtgtgtgtgtgtgtgtatctttagatatctttagatgatatatacatacatacatatatatatatatatatttaattcactgatgtgtacttgaaaatattatgcacccaagatggaaatcatataaggtgaatttttcaactgtgacaataccatgaataatttttaactcaaaagatggagtaagtaagtattcagtaagattcaaagacaggcttcgggagcctgtgactaccttgaaattctatgcatatatttgtggtttggtgtgtatatgcatttgtgaatttcttactacagaaaggttttattagattatcaaagaggtgagaccaaaaaaagattaagggactgcttcttgagaatctggtaaagtataagttgcctcaagatcaaaggaactaaccctttgacttgcaaatcaattgaaagaggagtggggtggtggctttggagtcctctggaagtggagggggcccagccctctcccagggatcagtgaaggaaattcaacagagtcaggaaacttcttgacagcctggtcaccaagggtttggaaaaaggttctattggagtggagattgatgggtggaaaaaggagagaggggagttggacctgataccaaagagatgttttcagccatcaaccagctgcaaaacaagatgggcttccttttcctacatattcttccaagcatcataaatactcggtctgctccccaacccacatcctgcaggatgcagccagagcaacagccccactccactctgaaaccagtcatcctagggatgatgatcatttcttagcttccctgttggaggtcggttggggttggctgatcgctgcttggttcactcctgcactggctgggcgttggctgcatggtaaagctgttccctgtctcatcctgttgggataaacagagtatcctaggcatattttctccagagcagtggcagacacaaagggtcaacagaaaccctcaaggttttgtcatgcctactcttgcaactagcacattgtcatttcagcctcatgctattgaccaaagcaagtcacttgaccaaattcaaagccacatgacagggaaatatattgcacctctttagaaggagcacctgcaaagttatttgggcctggatatacagggcagggagaattttggaggcaaaaatgcaatctgccacatctacgttagtgaagtcagtttttcgtacatgactaccaagacaaagcacttcacttaccaactctattcaaataaatggaaattattcaacctaaaattatgcaaacattgctccccttgtgccaaagaactgcaccatgtctgattggctttgcaggtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagtaagtgctgtgaactcaacagagctgtcatgtcttatctgctcttctttcagctgactctgtccccctttcttttccttttctctgtcttgggtatcattgacagccccccaaaacaagtaaaaagccagtgtggaataatggaatttgcatcagatacctctaggttccaaaactgattctattccttcacagccgtgaggccattactctctctgcattactcaattttaaaaaattgagtcttctcattttttaaataaatattcctggaggcattcttgtgagaagtagatgatgtatatgtaagacctgacacacagtaggggctctgtaaatggtggatagtgttatttttcatagcagagtagccaactaatcactcttcagaaattcttttattctagaaaacagtcggagtctgtggttctcaatcagggacacttcttcctccccctccaccccaccctaccaggacatttagtaatatctggaagaggtttttagttgtcacatctgaggtggatgctaccggcatgtagtgagtagaggccagggatgatgggaaacatccccaatccacaggacagtgcgcatcacagagaatggtctggcctatatgtgtgtctcatgatactgtcatctccctctctctgtccacatgtgttttgttttatcctctcttctttctttacatccttttgatctaggaatattatgttatgtaacatggtgtttatttgcataagacctcccaagagaaagcaaattggagtgtgtcggtatggcgccatgttgtgaggttgccaggcagtcaacaggaacaattaagtgcttttcaaggggaaccctcatttaacctatatccttgtttctcagtacaagtgttgtatcctagaggaatgtgttggatcctagaggaagaacaagggatgtaaagagagcactgaattacgaatgagaagactgtggctttcccacttggtacccatatagctatatggctagtttcttcatatttttaaatagattttttattttggaatagctgtagatttacaggaaatccatagataatacagagagttctgtacacccttaacccagtttgcccaaatattaacatcttatgtaaccttggtacagttatcataactaagaaattaacattgatgaattactcataactaaactccagactttattcagattttaccagctttccactaatgttcctttcctattccgggacccaatccaggatcccacaatgcatttagtgttccttcagttttaaaatgggaatattttaacaacttgagggttgttatgagttgtcaaaaagaccctctcaaagtaattctaaaagtacataagagaatataacatgatgatatatttctttacagtcatacaacaaatggcacaatacctatgcacacttagatcagcattatttgatttgcatttgaacatgtaaatatttgttccttcaaaagatatgtttgagcaccaagtgtgtttgggatgctgtgcaagatgctaaggatattatgagtatcttcaactccctaaggtgtgcttctctctcaaaaaggtcctagactattggggaataaagcacattaatcctaattaacattcaatatgtgaaatctctgactggaataaccatgagaggttctaagttgacaaagccagggtgccccagcacaaccttgagaggctttccaaggtaggttaggagcaggggatgtgaggacacagtgttccatgcagaaggaacagcatgggcaaaagcccagagacaaggagaatatatttatggaacagaaaattgatccatgtggttaaagtgtgtcttaggttgggaggataggtgagccaggaggctggagacaagaacagatcgcgaaagcctcctgggccacaccagggagtttctttgtataccaatgattggtggagagattgaagagtttaaatcaaacaggcaggatgaaaatttccatgaaataaagctctcttgcactatgatgtggtgagtggattacaaggaaggaagactggctgctgggcacagtatcaaaagattattgaaagagttgtccatgtaagtaaacaacggcctgaataagagtcgtgtcccatacaaatattataatgaattgaattatttagtaaagtaagctattaatctctttcttgaactaatttgtcttcactgaagcaaaagccttgaatttgggcagagtaggtagtggtttatttgggaaacatatctgaggcatgggcagaatttgctcaccaagattgcatgattctgctccacacatgcgtgggtgagggtgtgagccaaggcaggcaggatgtttgaggcagtatgtcaccatcacaaggccggtctttccaatggctctgacattctgatatatctcaccggaaggaggccgagcagaacttggccttcattgtaaatgatgggcgccattaaggaatttcttcctgctctgcccattagtatcctatcaatcatttttaatccatattctaccttccacctttaaaaattgaaatattttaagcaaaactgtcttcatactcttcttgtcttagttcatagtttatctctgatagttgctagcatgatcattcctaaggacttctttttacaagtcaaaatttaaactacacatgtaatccaatagatcttacggcctctgagaatgtccaatccctgctcagcccttgagggttttctctgctccccctttaaagcttttcttttcttttttattgttatttttttgagacagtgcctcactctgttgcccaggctggagcgcagcggcatggtcttggctcattgcaacctccgcctcccgggttcaagtgatactcgtggctcagcctcccaagtagctggaattacaggtgtccgccaccacacccagctaatttttgtatttttagtagagatggggttttaccatgttggccaagctggtcttgaactcctgacctcaggcaatcgagctgccttggcctctcaaagtgcaggcattacaggcatgagccaccagcccagcctaagcttttctttgatatgtacagaaatagatttctaaaacaaaagccagctaactatagctcaagggccaaatctggctgcctgattttgtaaataaagttttattagcatatagccacacccattcatttacctattgtcctgtccgtggctgccccctcactatagcagaagagttgaatagtcacaaaagagaccacatggcctggcctgcatagccaaaaatatttactgtcaggccctttgcagaaaaagtatgctggtccgtgacctaaaaagaaaggattttagaggtgctggtgttgtgttgtgtttgtatccaaaaggcaactggaaatcctttggcctacccacatgtgacaacacacactgtcctatactcactgggtcagtttctcgcccagcatcgtgtattgccacagttgaatttactagaccttttcctgtgattgagagctgtatactgggcagaaggaacctgccaactgcaacagtgactgtggagtttggacaccatggcatttgtatcaggttgcaatgcatttcctgcctttaaacgccttgtacccaatgcagtgttgaatgacaggcagtactccaaaccaatattgaattgtcaaagaagaagtaacaactatgacaaaatgtccaggtgtgactctgccaagatttttttaatacttaaatctttaagacacaaatgtgagtaatgaaatagagaaggccttattatatataaataatttcatgagtagaaaacccaggcattgctatcacattttttcctaattttgtggcctgaaaattgtattctcatcctaaattcctaagagtaatgctttaatttttaataatctcagaataatataaacctctagaatattctatatgttaagacccaagatcttgatttgtttggtttctggtctgaagtctattgagcatgaatgcatcttatgctggatagaacactgcagtggttgaaaatggagtcttcattcattcctccttttcaggatgctatccagccagtatgtacctgtgctgcttgtatacacctggaatccgtgaagctagctcaccctatgttttctggctaagccttatccatgctgttgttgaatagttggcatgccaccactggatccctatcttagaactggtagactgaaagcttatgaagacaggaacatgttctttttcactcttactgtgtactgtactatacacagagttgctgctctctattgtcttttgaatattatgaaaactttgcaagcaaatgtctttgaaagttgcttataatgtttaaattactattaaaatataagataccactttgtgataggaggcatgactcagggagggctggcttgttcctgtcttttaaacctgattttgaaaatatgctattggttatgataaaataaacaatcctcttcctcttcctttttctgttttgtgaatttgttttcaggccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtaagcaacttatttctattgtcctgcagttataaaaaggcacatctcattctgtacttagagagtcaacccatactgtaatgcatcttaaagaataaaatgcagaaaagttgtattagtcagctcttgctaggataatactgcataacaaacacccccaaactcagcagattcaaacaacaaccatatattactaatacccacacctgtgggttctctgttcaagattatagagctctgatcattggatgagctataccatgttaacactgctctttcatgccatgaaacatgggttggcaaaccacagcccatgagccaaacctggcctgctacctggttttgtaaataaagttttatgggaatacagccaggtccatttttttacatatagtccatggctgcctttcagccacaacagcagaatcgagtagttaagagagaatcatatggtctacgaagccaaaaatatttacttactttctggtcctttccagaaaaagtttgccattccctacttttaaacatcactcttcatcattacacaaaactaatttctgttgccttgtatgttttatggttctagactggaccaattagtgcaaatagctaagggttgaatggtgggggtgaagcagtgatcataggctgggaataatttcaaaaggcctgttagatccagcccagtgactttagcccactgagttctctaagaataagggcaaaggtcaggacacaattacattggaattagttaacctcacaaagttaaccttgcctaatccacagccacaactgcacccctttgaccgtctgtctcacaaatgcctgcttgctattgatcaaaaagggagctattttatttttatttaacaagccctcatatggtacaagtatgtgccaggcactggtctaagcattttacagatgtcaactcatttattcagccttacagccctacaaaggtaggtgctaatattatccactttactgatgaggtgactgaggtatatgctgaagatcacagggttacaaagctcacaggtggcagagtcagtaagtctgcagtcaagggtcaggctcttaaccagcagtccacaaacattatctgtaaagggccagagattcaatatttctggttttgcatgccaaatgatttttgtcactaatactcgactcttctgttgtagtgggaaagcagccacagacaacacctacacaaatggacatggctgcgttccaataaaacttcatttataaaaacaggcagagggccagagttggcccctgggtagtagtttgctgttccccgctcttaaccaccatggtatgctgctattcacaaaagggtggtatatttttgaaatgctataattactctctagggtttatgacagtgtacgtaatgagtgatagctgaatccttgctttaaaaaataaaatcaacattcaaaattgcatagcctgaagatggtgagtataacagtgtttctttcaatataagcatgataaaacacttatttatatataaaaaaacctttcaattcaaacctatgcaaataatgtgacatggctgagtcctttatattgtaggtagaaattagccaaaaatctaagaagtgaattgtaagcttcccatctctcccaataatggtacatactatattggctgagcgagtaggttttcctttgttgctatcctcataattctctttgcctagaagagttttctgttccaacatcctgccagaggatggaggacaaatccttcaccccactaggctctgggctagattggcatttgcaatttttagctgcagtggggcaaaattaaagcacaaaggaaaacacaatggatgcaggtacaaaaaaagcaaatgtttctagttaattaatgtgctgtattaatctgggatagaatccagggtctaaatgattattactctattaataattaattatgataaatgaaacctgatcattatgatctcattgccattgatgaatagtttgcaaaattccatcagaccacttcagttatataaacacacatcagcattaccttgaaaacaccctccagatgtcaaaactaactcatgagggggaaaagaaattctaaaattaattgctacacaattaatctttacaaacctgacggtgtcaatttcagaaaaatcttcatgtagaaagtcactttacatttccttggggggtattagcaaggaaggggcaccccctacgattaaatgcctgtgacatcttgacttgcaacagctaatgacatatttgcttatgaaatatagtcctgactttaaattgatgtgtacattatgatctgtgcaatggggcacgttaacattgctccgagagacataatttttatactttgaattctccgtgtctcactgcgtaacttaatggaacattacattctgcctgcacatttcaagctcaatggaaatatgtacctagtttcacagattaatgatactataatggtattttcctttgcttaatggactatacacttagtattttcttactctctaatgctaatgtgcacttggtgttttatgaaatggtgttaactaaatgagtaataacgggttcatgcaaagattattagaccagaaggggtgggggcagcatacaactctggattttgctcccaattttaatcttctgtttctacttgctacatgtagtcagccatacctgccacagctatttcatagggttcagttaaggttcaaatgggaaataaacatcaaagtaataaaaaataaaaatgctgtgccacaacaagaaggaaacaatacagatgtggtgattttgtgatgcaggttccaaattgtctgaaaagcggaaatagtattcactggggtatacagaacatttttggggggtgggagatactgacaattgcaaaatgaaaacctttccaaaatgtatgtattagtctgttttcatgctgctggtaaagacataaccaagaccaggcaatttgcaaaagaggtttataatggacttacttacttacagttctatgtggctgggaaagcccacaatcatggcagaaggcaaggaggaacaagtcccgtcttacatggatggcagcaggcaaaaagagagcttgtgcagggaaactcccccgttttaaaaccatcagatctcatgagacttattcactatcacgagaacaacactgaaaggacctgcccccatgattcaatttccttccaccgggtccctcccacaacatgtgggaattcaagatgagatttgggtggggacacagccaaaccatatcagtgtatcaaataaacagatgacatttgagaccctcgatgcatgccacagaagggagccagaagcttacaggaccctggaagggctggggcatgaagtcagggagtctgctgctctagttcatggagtcatgatgagctgtagctgctgcaaagttgcccacagcacaaggcaggtgtactcaggcgctcatctagaagcttccaccaaccgcacgtctactgtctgccatcaggaaagcgtgtttcccctcctctaagcacttctggatcttgtgcaaaggcatcacaatagcagagcctgacccagactcctacaggaaaggggattctgggaaatgcaacttggattctcctcataagcaggagaggatggacgggagggaagagaggatgcaacattgatgacagacaggcctgcacactgggcttggcagattatcaattccatccttcttttggatttagtgatggcatgttgtgttaattttctttttaaacaaacacaccactcttaaagtgattgtattttaagtccagtgtgattttttttaaagaatgtcattttattaaagacccatgaaatttttctctctgcattgggtaaggtaccatatgttaatatccaattagactggtttctgctataacatattaaaagttcaactgtgagtcatttactctttataaagagtgatgggttttgtttatcttaataactgaaatacgatgaatattacagaggcatgactcagaggggtaaaaagagattaagatgcttagaacattgtagaaagcattctttggatttttttgagcagcaagagaacatttagaataaccagaagatccgtctgctcaaacacgttcagaattttttttccagtataatcagaaaggctcttggcagtgatgaactgcacaatttctggttacggatggcattgtagaatgtagttcgtgtttgtgggttttgagtcatcctgagttcaaattctgattctggtacttattgttaatatgtgccatcaggcaataataataaaataaatagcagttactgaatattacatgccaggtcctgtgcctgggacttaacatgtattctctcctttactccttaaaataacactgtatatttctcaatatacatgagaaaattggggctgagtaatgacaaaggatttatccctgcaaatgggaatcatcttctgtgcttgcccttggcaaagtgcattcagaatcagaaaatgacagacatggtgttaaatgaaaaattataagaaggtcaaaaggagaagtctagggttgtgctgtccagtatggtagctatgagccacaggcagctatttaaatcatttaacttaatgaaaattaaataaatttaaagttcagttcctcagtctcaccagccgcagctaaagtgcccagtagccatatgtggcttgtggttaccatatcgaggagagcagaacatttcagtcattgaagaaagttcttttggtcagcactggtctagcgaattcattgtgtagatttttataagagtgaaaaaaagcagcaaaactcaaagttcaaattctccgtagtgtttgagctgaaaacagaaatgtgggtaaatacgacgcttctttccacccactactttccacccactttccatgtttgggagggaaggagatgaggaacacagatgttggggttcttgccaagctttcacttaaagaaaatgaacagggacaacaaatgatcatgtttttataacccctgaggaccacagaacggatttaacgtgcatgtgcaacatggctcattgtttttgttgttgctgttttgtttccgcaggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaag
